United States Patent 8,781,750 (CELL-TYPE-SPECIFIC PATTERNS OF GENE EXPRESSION) - sequence listing, part 23

SEQ ID NO: 36704 - DNA, 68720 bp, Homo sapiens
ccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcggtcagacaatgggccatggggggaggggggtatttaatgcttctaatcttaaacttgaacgtaagatgtgttattgaaattttctgtgcaaacttggtggcagggatccaactcaaaatataaggaattcaaatgtgatctagaagagatctaggagatgagctgatcccaccccttgtgggtttctagaagagctggaaatatagtctaaggttccatatagcctcccagtctagtagtgatcactgcattgcacccattcaataagaaaaatgaggaaggatgagagagggaagacgagtttactttttctcttaatagaagccagtcagaatggcaagcactagatatattgcatgagcttcctagtatgactgagaacaaaaagctagtgagtaggcacagagaggtcttcccattcaactttctggccctgttgtccttttagaaactcatctgacacacttctactttcctccctgggaactcagacatcatccaagtgttctgaacctcaggattagggattccagtggtagttctaggagcaggatgatgatagaagggactatgagagccattgactagtttaatttgacaataaaagcctgcaacaccaccaatctaccaagattagctctgttagcaggaattgcagcaaacacaatagctgttatctcagggtattagggccacagaggagtggcttgcttaatctctggaattaatagagcagagaggaaatggctcttatagagccgtgggtcggcttccttccttttcatagaactggaagccctgggctctgaggtaatgccatttcacataactagagggcctgtcttctccaattcccagggcaatccactttcagcaagtcagctttcaatttattttaaaattctgatatgtgcacagatgtggatggaggtgattgaaatcttgttttctctttgtttcctcattgtcaaccaccaacaatgtattgagaatgtgctatcaagttgagcatgtagacatttacaaaactgtttactgcactccccagctctcacagagattgcagtcaggtgggatggcagagatggagacattacttggccagcagcctgtccaaattgccaggccttaggcctcttctagaaagaaatctctaacctccatcctaattaccctttatatttcatgcttctcttttatgatcaacaattgagtcagtaaagaaaaacctgataatgctcccagagtccgtgatcagttttagcatgactttaaatttctcttttatttcccacttgtttccattcacttgggccaaattgtagaagaaagtgttgatggattgtggatgcaggggtcctcttccccttctccccaactccatcaacactcttaaaaagtgtggccagtaagtaactgctttggttttgatcagtgtacagttgaatgcacagattccagtgggggttgtccttagaataggtccttggagtggccatctgtgcatttactctggaaaagttgtcattgcttacgtcatttccaggcttggcttctctttgcagatggcctttagagccctttgtaagctttgccaaaaattcacattcattgctttagagtcacactttggatttgatcaagatcagccctctgcctcctctatgccacaccttgttctctgaaagagttctctgttggttctgagtggcttgactctttctaaaacttcaagctgtcctagaagaccaagaattcaccccagttgaggagaacaaagaattttaaaaatttgcctcagcctccaaaagcaactctctcagatggtcttcttcacagttgaaacagcattggatgacattgagagagcccactcctttggctggacgtgacaggtgctgctgtacggtatccctgtagcctcagaaaggtacccagtgctaatatgaaactctgctgcacatgctgaggatctcagcatctgggtgcttgtgaactgaggttgaccaaataaaagcagaatggcctgtgagtccaccaagaaacctgcagtccaaacaagttattgtaaggcctggaaggtgagtggccaaaggaggtcctttgcaagagctgggcttgcatttccagggtgtagccttagctggatctcagatgtttcccttgtttgctctccttctgacacttaataacacccagggatgacaccctgaaccctagtcccaggaaaccatgtgcatctggaagcacgtttcttgcaccactctccctcatcctgaaaacatcgctaacagagatttgcttcaggcattcagcttgactggttctcttgttctttcctagaaaacaaacaaacaaacaaaaaacatgtttcaaatcaatcttgaaataaaatgatatcagtcccagaggagagttctcttttagcagtccttgaatttacatggaaataattgtgagctcccttgaaggaaaacgtgcatctcacgtaacagttgttcttggcctaagactagggctcagaacacctgggttctagtcttgcagctactcctcactagctatggggctttgtctatcctttgccctccctgagaacaaagttcaaatgaacgaaaagtaagaataaccacctttaattcagcattgactaggtgctaggcactttactaagcatttttggggcattatctcctgtaatcctcatgataaccctgggaagaagaagctattattatctccaggaaaccgagactcagagagattaagcaatttgaccaaagtcacagatataagaagtggcaaactcagaggccaatgtcatcaccactatactctaatgcacattgaaaactacaaaatgctgaatacatatcaggcaggggccatcaccataagaaatctcagtaatgcaagtaccttttcagcatctgttcattcatttaatagtgtgactggttaatgactctggcgatctggggaacagaagagtttgaccttttgaacatttgggcatctacccaaggttaataaggcatccagtctctgcacttagtgtatggagttttaacaggaggcagaacattttgtccttccctttgaagttaagatcacgattctttccctagatccctagatcagtaggtcaaaggattgctagtgtgagaatttaaaaggcattagtactccaatttgagagtgctccagagcctgcatggagttgagactcagtgcgcatgtcacatgccatctctgtctcagtccataccccaccataagtggcaaagattcctccagctcggagcaggtacctattcccttcataaggcagctcctagacaaaatgagggtgcaaagggcatgaaatgttcagttggaggaggaaggggacacagtactttttgcacatcttctgtgttcagccatttaatattaagaagcgactcactctatagattacaatgggatgccgtgcccagtatttcttctgagcttcccaaccagtcagtggttgggcagggtggggggattattattattctccttctttatggataaagagaataaagtctgagaaattcagtgactttcagaaggatggccatccagaaggtggggtgctacatcaaggtccacatttggatggccccaagggcagtgtgctttccatctacaatacgatgaaaaacaacccctcagcccatatctttctcacctctaaatgcaagtagggctgaagacgggggagagaggagccctcagtgtaacagcgtatgtggacatttggatggctgcaaaaatactggcctcattctatccatcccttttctttagactggtgaccttagacatatccagtaggaggagctctagtcacctcctccctttgtgtttatgtgacggggttcaagatttgcgcccatcagctttggaggcatatacttcttgcagaaaaagtgctggactcaggaaggagtcctcagactcgattcagggttggaacaagctctttgtgagattttgagcaggtttctttcttcttgaggtcagagggcatgggtatgagctctaagggcctgtctatctctggcctcctgccacatttccagggtcccttctgtgtgcctggccctgtgctcgatcttgagccccaggaattcatagtctaggggcaaattattcccaggcttcctccactgggaacaaatctatcttactctgtagttctcggtgaaacctggaggcaagtgtttgagcgtctctcttgtgcaaggtactttgtgcacattcgctcatttgcttctgtgtcacagagattgatatttccacttccccagggtggagactgaggctcagaaaggatggagactttcccaatgtcacacaggcaggaagttgtagatctcaaactcaggtgccctgcctccaaagctcttcctactcctattcccagattaggagctcaggtatttccagggccttctgcaggccaggcactgttctcagtgcctttcattccagtggcagagacagcccataaacaggtaaagagtagaagcaaacttacttcattctggtagctctctgggatgttctgaccagcgttgtccactgccaagcctggcagaaagctaggctgctttaaaaccctatgcaggggcagccagctgggaacagagtgagttgtcgaaacagctcccttagaagcctcaagagaaaacccagatttacagctttgagtctttgccagcagcccctgcttcatgcaggctgaaggcgcggcacaggtgcaaatctggccccaagagaggggagctcatgtttatgggtccccttccaagacccaggtgatcctaggggctagttaatctagaggcaactgtccctgccacttattgataacttgcatgagcctctgggcctcagtatccacatcagtaaagtagggttaataactctgctctttgcctgcgtcagggtttctgggatggtgatgaacaaggtgtggttgtgcacgtgttccaaaccacacagggcatgatcctaaaccacacactgctgtgagcacttttttttaatgatcagaggttggcattggctcagaggttttttgccatcagaagagtgatggaaaatgtgtgtcctgacccctgaggatgccacagtctcatcagcagccccactacactgaggagacctgaatctgtaatgtagctgtgagcattctgggtcaagggctgcagtgtgtatgcgcctttctactttggggatcctccccatggagcacgcagctgttcgctccctttgctccctcctcctttttctgcagtaagggctccttcctgttccagacacccaactggggtgagaagccaggcagaggccttgccttcacacagacctttttttgcaagaactgagcactgctcagcttgcaggacaccactgggcttggcatctgggtcctgcctgggtagcctggcttggtaaaccagtgacctgcaaatcacagtctgtttgaagggagagtgctggtgaggggagctccatttttcagctggtttatgcaggcacctgggagcatgacactgcctatttctaaacttttaggagcccatgctggcctcatctgcattcctgcctagctctttcccacagtttccttgacataaggcccaaggtaacaggtttctggaggtggaactgccccaggaaggagagggatgctgttagactccaggacagagttgaggctcagaagtgtgcacatttctagggagtatgcagacccaggggccagccctgtgggtgtgggcctggggttcctcaaactctgggctggcctgtgtaggctgaggcctcttgcttttactgagaatccacagctcgaaagcccaatgtttctctttttacagatagatatttgggttataagctacccctggagtgctgcattccagacttctggggaggagggacatgagcttctaagatttgggcaacaaattttgatttccgcagttgatatagaataatttgttggaaaccttcctcctccccttttgcttttcctttccctccccttccttcctgcctttcccttctcctcctcatctccctcctaccttctcaccagatctccaacccctaaattccaaagttagaaaggcaagcatcagccacagggaagtggatttgaccactgggcactcaaacccaaggcgcaggcatgtctctgctgtcattgcctccctctctcttgctccgggccccctcagcacaggcctgtctttgtctgcctccctccagtgctgcaggcttccatcaccctctcaagtccccatccagaggcagggctggcataggtgctcgcttgctcactcactgccctgaccctgagagctcctgcttctatgcccctagagctgtggctgagtatatggcacatagtaaatgctcagtaagatgcagctgctgttcatcttggccagaagtcccttagaaatcatctaggccacccacattgctggacacaagagaaggccagtgtcatacagaggggaaggggtgcaattaaaaagtcattgtctctaggccttacacaggaaatgggaaaataacagagttatttgcagagtaccattttctccaatggttcattcacatccgcagatgccagctgagccctgtcacgaggctttggggttaccaagatgaataggaaactacctggccttcagagagttatgtggtggaggtgggaaatgcatagacctaacatggcagcctcaaggttggccatagcacctaggatggtgatggaaagggtagaaggtgagactgtattatcatagagacccttgagggcctgagggtggagggtgtgctttaatccactagcccatgcaaattgttcaacaatgtacaagactataagaacaaggcccaagggtatcctggaggggatgatgtttctctcctctcttttttttttcttttattattatactttaagttttagggtacatgtgcacattgtgcaggttagttacatatgtatacatgtgccacactggtgcgctgcacccactaacttgtcatctagcattaggtatatctcccaatgctatccctcccccctccccccaccccacaacagtccccagaatgtgatgttccccttcccgtgtccatgtgatctcattgttcaattcccacctatgagtgagaatatgcggtgtttggttttttgttcttgcgatagtttactgagaatgatgatttccaatttcatccatgtccctacaaaggactggaagcttcggagcacctgagaacgggcgcacaatgagaagtgaaacaacttttgggactgctggatcacttgcacggtttagaaatggtcaccttacttgcactacggaagaaatctttacgtttttctgctccagaaaggttgcccacccactcttctgtgaataatgggcctacatggccccctgcaatgtgaggagggcaacttggaaagaacttatttccctccaagaagatgctcagttcatgctctaggtcagaggttggcaaactacagcctgtgagctaaatccagcccacgggctgtttttgtaaataaacttttattagcacacagtcacgcccagtcattaacatattgtctactacacagagcttcaacagagaccacatggcctgcgaagcctgagacatttactacctgggccatcacagaagaagtttgccaacacttggtctgtatcactgggcatttggttcatttgtttaccctaacaaatggtacccatttcaggtagaattacaggccctcatgcggccacgtgtttagcttcccctcctgtgccaaagctggccccaactccacactcccaattccacccttctcaaaagttcttgcccctaaaagtgtttcttttccttccatttctcctcccatcagcatccagagagaactttttcaaagagatgaagccaatccttcctctgcttaagtcccccgatggcttccctacaaacaaaatacaatccaatccctttcccatagcctgcaagaccctctgcaaattcacgactacttccctggtgcattgtgtgacaggcacactggctgcctgcccgtcactggaacagtccaaaagccccaccccagggccttcccacttgctgccctcctgcctgggatgctctgcccccagtccttctcctggcctgctcagagccacctgccattctatcacatcactattttttcagtctttgaaagaatactgcacacactcttaacttgttcttgttgttcacttaccgtttgtcctactagaattccagctccttctctctggttccccacttctctccctggcctgtgctcattctaatggaagtgtcagttctgggccccctaggcagccctgcctgccctttactgtcatatgacttcatctctatagtggaggggagcccagtgccactctgtaggtgcttctttcctagaataagcttcaggccctaaagttgtctagccttagggctgcccatgtgatgctgtcagcaaaactaaacatgttcttgcctcttttcctccctcaagtcaagcccttagagtttagaacaatgaacttggcctatataaaatacctccaggaaatcagtcctcaaacaccaactcccaacatctgctttctgaatatatggcttcaaacagctaagtgtacagtatctaactgctgtccatccttttgttttttttagccacatgacatctaaggaacttagaaaatgccttgccctttcctgtagttaaatttgacataaaattactttattggcagcatattaacaaacaaaaatctcctgtgtttttcccggtaattcagtttcagttttccaggtaagaaaaagataattttgaatgactacaaggagacagactgttttgaggtttctgttaataacacattcagagtgtgccttcttcctctgtcccagtcagtggtgctgttgacagagtggtacaacaagaatgaaatatactgtgggaactcaccctgatcccaacaccctcatcaacaccatcaccaccatcactattgctaccagcaccaccacctccaccaccactaccctcaccttcactaccaccaccctttaaatcaacaccattaccaccatcaccatggctaccaccatcccaccatcccaattgccaccaccacatccaccaccattaccaccaccaccatcatcactaccacccttacctccgtcattaccacctccatcacctctaccattaccatgattactatcgccatcccctctaccaccaccaccctaccacttctctctctatctctctctcatgtacacgtacatggttatatgacacttcatgatgcaatcatagacactgtccacatacacacatacagtgaaataagtacatgtttttaaattgtcattattttcaatatagaacctactcttgttgctatgtgctttggggtggggaacatcaacgtgtgtttatggccaaaattgaattaggattcataagaaagggctatatctccaaatgcgcacttttaaaaaagttaagtttggatgagggatctttcatttcataaaaggatatactgaggatttcctttcagtgacaaatttttgctgcattttattttgatttggtttacaaaagttagcctttcacacagctgttcaggagcgcagccaatgactaaaggcagatctgccttgaatagcaaatgctgctgagtaaaccatgttacaggctattttaggaccaccaagaatgtgtttgcattttcaagagtagaaggagagatcatatttatttggtatctacactatgccacacactatgctaattacatttctaagctcatgtaatccttacaacaaatttacgaaggctttactttccccattttgtaggtaagaaaacaggctcacagagggaaaaatgacttgcccaaggtgaccaccaattagagacaaggtttaaacagaccatgagggctcagggcctacctcaagccctctaatcaccctacactgctaagttcttctattagaatttgttgtgcagaaggttttcttcttcttcttcttcttttttttttttttgtataatcagattatccatttgcctacaaagcctatagtgtgcaaggagtgtgtagtggtccagtcagtgtaccctggcacttgagagctcattaagggcccaggagaatcagcaaattctcagcagccaagctaccctaacgtatatcatagaaactacaataggagatttcttctctgaggtcactgctatctggcactatcctgtgatgtatggtttggaaaaccgtgggtcaaatacaaccgtccctacaggcaagtcaaaatatcgtggctgaaactaaaagtgattttttatcctcagtctaagtgtgaagagctgaagtgatctgcctttcctttagcaccccagaattacctctgggttcattcggggaaggctggcttactgctgaggtgtccacacatctaccactatacatgcctggggttcttgggggttctgttacctgggctgaactctggagtcctgagtgccaagctcttctctgccactatctatatgacttttagtaagccacctgcaactccttcacctcagtttacccatgtgtaaatcagggaccccaagcaaagccctgcctacctcctaggattcttgttagaatcaaaggctgatgaatgagaaagtacactgtccactgaaagggcctgggattttataaaggcctgtagttggtaacaccaagacttggatctgaaggtctagaaaagcacaacatcctgagactctgtgtggatccctttagcctactgtgagtgcttatgtcatgtcatgaacatgatataccccccatacagccctaaaaagtctttgctactagaagccgcatcctgtatgtgtataaaaatacagaaccaacctcccaggtacacacccgttgcacaggcagtctctgctgagtcattgtgcagacacgtctcttgctgcttctggccatgttgttcccagaaatggctctagagggatttcccgcatggctgaatagatggggagcatacgaggagctcaccttttcagggttccagatatacagctgggccggaggggctgggaggcagaagagtgggtgcagcagagtaggcttgtggaagacaaagccttcagaaaagtttcttgcccgaggcaaatgcagtccatgctagatggtacattcccagccaggaagagagtgcaatgtcctctccaactcaaatggcagtgaccagtgggtctccccaaactctgccataggacattagggctttaccaagcactgtccaggttgcagttttagatgggaaagggcacttggccttgagaaggtacagaagccaactccctggtcaccgcatttgttcatgctttttcccttggccctcagcctctggatgccatcatttggcctggagataggaaaagtgttgcctacatctgcctctggtactagcaaagggcatggtacagtgtggtgcagaccagcagcaggaacagaaaggtgcttctctaaggaagctgcagagatttctctgccagtctggagatcagctttgggtcccagctctccctgctactcttccatatacctccaatgatgcaagtttccaagaagaccaaggctgtgaaaaacagtgtggtggttcctcaagaagttagttcaacataaaattacaccatgacctagcaattccactccttggtatacacccaaaagaactgaaaacaagtgttcaacaaaaacttgtatgcaaatgttcacagcaacactattcacaatagccaaaagacagaaacaacccaaatgtccatcagatgaatggactgaccaagtgtggcacgtccacacaatggaatattatttggccacaaaaggaacggagtactgaggcatgccacaacatggatgagcccagaaaacatgatgccgggtgaaagaagccaggcacaaaacgccacatattgtatgatcccatttatatgaagtattcagaataagcaaattcatagagacagagggtagataaatgtgttgccaggagctgggggtttccatttgggatgatgaaaaagttctggaactagatagtggtgatagttgcacaacattgtgaatgtcctaaatgctaccgaattgtacacttttaaaaagttaatttcatgctatgtctattttacctcaatttaaaaagagaggacctagaccatgggaagagtctttggactgactccttatcccatgttccctccaagtttcagctgctctgatgccaagactctcatggcatcagagctcaccagcctggctctaaatctactaagtggggtcgatatctctgcaggctaaaagttggcactcaggagctaaaatgtgcttattcaataagcatgtgacccctctgctaagctacagaggcatgttctggacataaattgttttaaatgtggccattgatagcagcatctctctttggtgtgtcctagcaggaagaggtcatagacaggatgcccctctagaaggttctgaactaatcaggtgtctctggaatcttctcccacctacatagcagttgaatttctcaagcagggaaatattctgcatggtctgaagcttgttgccattttatttagcctactgttggggcacagagagaggtaaggtcacctctggcctaagcttcaaagttcatccctcaagccttctaagacccggtacctaattttgttttaattttatattctgtttcataaagagggccccagattataaaagcttcagtcccaaaactagagacccaaacacctcactataggaaagaaggctctgattaaccagcagctgttttttttctttctctttattctttccagctctattgaggtataagtgacaaattaaaaatgtatatttaaggtatacagtgtgatgatttgatatacatatatattgtgaaatgattaccacaatcaagttagtcaatgcatccatccataacttcatctagttatatttgtttctgaactcatagaactgttttaaaatcatagaaacagtagaaggctggttaccaagagttgcagggggtggagtgtgaaatggggagatgtcagtcaatgggtacaaattctcagttataggatgcataaatttgggcaatctaatgtacagcactgtggctatatttaataatgctgtattgcatatttgaaatttactgtgagagcagatcttaaatgttcttatagcaactatttttctatttgccccatttaaactactctagttggtgtcctggcaatgaggaggactgtcaccttgtttcctgaccttgccactgcaatccaaatggggtctgtttttatcatgccaggaaaggagggggaggctgcgtgggttcagcaggggtgtctcctgactgtgccttccaggcagtctgtcactgtgtgttcccccaggaggccctggaccaaaggccttttcatctcagtaccccaatttctaacctcataaggttacactgaagatgaaaggaattgatgtagttaacagggctgaagcagaggcttggtaactagttgctcttgttatttcctctgcttgtagaggaagttggtatagtctctctctctctctctctttctctagctctggctctccttcaaccattgccctatcatctgaatggcaccttggcccatttcctccaagccccacttctgcttgaggacagggctctggaggctgacaaacccaagttcactccctggttccaccactttttagccagccaaatgcccttaagcaagtgacactccctgtcttcaactgggcaccctcatctgtacaatgagggtgggggtgatcacattagtactgactttcttgagtcactgggaacattaaggtaaagcctaaaatgcatttggaactgtacctgtcacttagtaagtattccaaagtcactcttgaagtctacttataaatcaggtctcccttactaaaacaaaaggaaatggagaaagagaagaaaggagaaagatgggaataagaaaggaagagagggagggatggagggagggagggagggaggaaggaaggaagacaggcaggcaagactctttaatctttgctccttgttctctctagccactcacactcaagttccagcccccaccaatttggagatgattccctgataaacctctaaactgcaggcatctctgttcttcatttctaagatgaggatgataatgggaatatctttctcatagagttgtgaagataactatgtgaatgcatacaaagtgcttagtaccacaatagtcatttgtgtcttgtgattccaggagttttgggcagaggattgtgtgccctggtcagggtgcccacaggcaaggttgccactgatctgatggggccaatccaacaggcatggagcccagaaacaggcttccatgtccaatcccatgtcctgctcttgggaaggctttcccactccgaaccacaaaaccactgggtttatctgggccactctgatgaaagtcacattcccctgaacaaatatcctcaccacaagggcacctgggtcatcctgctctgtgaagcactgaaagagtgaggcagaaaatggagtgactacttccagaaatggaatcacctcaagtcatatcaattctcttgggaagagccccttgggtttgtatagttctttaaagtctgagggacagtggagaggcaggtcccaaggagtgctaatgcagaagtaacatactatggcagcctggcatgggtcagatcataaggggggccagccagggcgtggaggcaggactggcagggcctggcagtaagaagagatattgctactgcattcacacggtcccaatcagaagtcttagagattatctgtagagagagctgtggctaccccatatagtacgtgacttccacacagcccaaactaccctaattaataatgacccagaagctgattgtttctagctctcagattagcagtggctccttattgccccagcttagctctaccagatgtcctgtccctgaaatgtaccagtagcccctctaaaaacccacttggctcatcagggcccagtccagggccctccccacctatcccattcctaatcccatcagcattagcgagaagcctgccactgcctcagggacctcgcatctggagactcagccaagatggtggcacctgtgagaggatccacaggtagccaagtccaggtagccagaggccaggtggcaatggggaagagcataagtgacccctgtccaatatgccctcatcagccaaatctggggcctcagtttgggctttgtggtgtgaaggtaccacccgccaaatgggcctggagccaccagcatagctgccctccttctccctgggtggccctggaggtgccacacttgcagcattcctgggtggtccttctgtgcatgggctgtaggtggaggtgtggaaagctgaagacagggtcaggcacagcccagggcagcctagagatatttacatcatgatgatgggattagacagcccactcgcttgtgcggtatctggacgccactggcttgcagagcatttgggggttactgcttgagagtgttttccactggtcttgtcactccctaggtgaaggaaagtctggcttttgtaggaactgcctgggtctctggtggagtatttccttcctcacctctggattattctgcctctttagagcattctagaaaaggggtgttttctcggttcattggccacacggcatggctgcatcctggtgacattttcccagcatcagatggttggagactgcaatgaggaggctccacacaattcatagccttcagccaggccccttgctaaagtgctgcatgggacggagaagaccaaaccaattggagagggactcgatggaagccacacatggagttttgtgttgttgtccagtacttactgtggttgccctgctcccattgacctggacgatccatgttaccatctgcccctcctcccaaaaaagggaagcttcctgttcttggagttggcactaggagccaccctcagtggcttaaacagatttcttttaactatgaggtagtgcactagatgaaccagactacaggagatgccagctctgtagccatcatttcacaatgcagccatacctaagagcctaggacaggccatacccggtgggcggagcagggatgggccacagctggaggactgaaagtgggatctcagcctcagttacagaggcactccctgatggccaggcagcaatcctgtggagggctttgtcatcagaaaataggagcccatcatctctggaaggttggaagcaccatggtgagatgggatgtgtgtccaagagttaaactggtctggagttctcttttaacaccatcatcacaccccttcatttaatctatgctggactttgaccataaaaaaccaaacttgaaattgggatccctgcaccgactggtgaggcacataggagagggttggtttgggttccatatgactgacataaagcagagcaaatattggcttgggacccaaaccaaccctctcttaggcttgttaaggccccattcaggatagttccctggaggtggttggagagctggcagcctttctggtgactggtgacctggtagtactctctaatagaatatgtcaataagcacagctcatttgaccagaattgtaggccgcctttctcgatccaacaggtgcagacctgctactctcaggattcactttgctagtctcctgcactccacaccggatcccaaagtctatgttcaagtaatcccctatttaaatgtcatagatatatttggggaggctcataatttgattcaagtaacagtctgatctgtgcctctcactgagctggtgcaggtaatactttctttaagagtgtgtgcaagtggctctcctcagcctactctcacccccagggaaagaagccctcgtggatggaggaagaagatttatcttttctctacaagagcagcccaggaagaaagcatcaggtaagcataagcttaccaaagctgggacccattcactttacagtggggaaactgaggccccgagtgtgaaagggacctacaagaggtcacaccacaaggtcctttaagagaggcagagcccagggagaagtgagaaggttgggcttaaatgatctctgcccggtggccctggtggcctccaacctcggttctgcctccacttctccctttgcctgtgtgattttgggcttgttagccaaatttaggtgaaatgtagattaagcttgtgaacctgggtccagcagaagtggagtcatctggattgggacagggccctctcctttgacctttagcttctattacagctacctcaggcagcacctacttcctctatagatcaacctcaccaaatccatccagatgtttctcttctccccacagtaatcatctctatcccactaatgacagaacctgggaatgtgtttggggaagactgggtgaggatttcttcctgtgaaaacagagtacaggcctcaccaggcttaacatgagtgggtgtgagcagcccgtcttgaagggcccagcagttctgacggtctaggagttagaggctagctctcaacaaatgcttgttcaatggcagaataccttgattcttctcaggagatggtacaatacaaattctgagctcattaaattcatatacatctataggttgaggatcatccttagagctgtcagttcttccaactggcatgtctacactacagaaaaggagaaagtagttctagaacactgcccacccaggtttgctcatctctgcctttgtcagtgcacttccagccactccaggctgctgctcagatagttctggcagaagcctgttgaagccccagccctcaggtcagggtggctaaaggctgatgactgtggcagccttcagagtggcaggtggtggcaagcagcaggaggcaggagtttccaggctcagccaccaagacagcatccctggctgtcaggtcagtgctgtcaggtcagtgctgtcaggactaagctgcttgcctccccctacttccactccatccccctatcctagtgaatgcatccttatttgtaagaaagcaacagaggcccaacacgaagacacagggccttgagaatgatatcagtagtgattactgctccccaagtgctctcctcagtgagtacagtggaacctttcactaatgctgtgaagcacacatggtgggccaagtacccattttacagaagaagaaattgagcttcagggaggggagtggcttgcccacagccacacaacaaacggaggagctaggacttaactgcaggtcttctcatgtgcattccagggccccttcctccaccgcagcctgcatctgcctgcatcgagtgctggttcagggcgaatcagggacaccaataaatccccgatttgtaggtcgaggttcttgctccaaaccacccattatcagagatttgctcctgagacataactgactcctcttgaagccaatcagcattagcattcagggttccctgccattcccaaccaccctggtattctccagagcctcatgtcttgcaattctggaaatgctcaaaatcctgtttgttctacagaaagatcagtttcagtttgctgggacattctgctgaaaataaacatgtaaataacacatccccaaatacaggcattgatactatacacacggatattcctttgatcccatgtgcaaatgcaaacatattcattctgtctttctctcctcctcgctctcactctctctctttctctccatcccccatctctttgtctcttcaaacccattcctgatacattattttcttatctattctacagctacctccatcatgccccacgacatcttcattactttcttctgagatagtctactgggggccatccttgtcctcagagggcttgaagtctaatttagttggccaacatcaggtgcctcaaaattcatagggggaaaatgtaacaatattgaataaagttgttcatggagtatggatgtaagggaagagactaggagaactggctagcaaattggcctgaactgaactggtgaggcactagtgaagaaagagcagactaaataaaccacaggcgattttcacctttttgacaattttgcccagggcctacaagcccagtgccctctggagggaaaataagtctccctgagtttatctttcctggttacctttgacctcctatcttcttgcccaataggaacagtgcataccctttgctgacctttttattggtgtccatgttaaacctccaactacagtgtccaaaatcaagcatttataacagcctgccagacttctttggataagttatattctttattctccttatgctcatttcatggactgtattcgtataatctctaccttctctaagaaatttttccccttttttgtcattctggactagaactatagaaagggaagagttgccatatgtcattgttcagacagaaccagaaataatgttgacttcagagctgaacttgtctctatcagaagagaaacctttgttttctcattatctagggggtggggaggccatcacatgccttgaaatgcattttaatgaatgtttataaggtcatggggatcacattggtggctttgtctgccggattctgaaatgggactctgcaggcatttatgtatggagagaaaggaattcgtttctaaaagatgccagggcactgtcactcactccctcccccttcctcaccaccaaaggccgggcctgtgagggctctggctgggagttgggacgtctggggtccagtgtccttttaactaattgtctgaaagcaaatcgagatatgctctgaggaaatcctgccagtggctactgattgtcacagggagaggcctgaaagaagtaggagctgtgggacagctaggactaataccctgctgtcatcaagaccgcagagactggagaaaagcacatgggtgaagcagggagattcatttagaaagggctgggagcttggttggggaccttccgcccctaccaggattctgggaggggaggtcattccggagcagtgagctatctcctgcccttgatctaaaatggtggctgtgggatttagtcagaaacacccagtctgggcaggcaaaacctcagcggcatcagccacaggcacaggtgacccagtgaaggcacgagtgtggcactgggcacaggggaaagcccagccaacttctcgcagttgagatgagtaacagatcatgggactgtgaaagagaagacacgaaagcaagtctttatctaggggcaaaattaactggataatagatttccacgcctcactgatgtctggtgaaggcagacgctattacagcaaggctgagccttccgtgtaaacacagccgcctctcctcggccttgtttagggttggctggtgttcttgctgttcagccagggcacttcaggctcactgttgaaagctcattccatgaaatccaaaacatggagctgcatggcctctgacaaagtgagttctcactgaagtccattgaaaaatgaaagctcagaagaggcttgcagcttgccactctgccaaaacagcagcctctatcggcaccccaaaccccacccctgagaaaagccaggtgagcctgccccctttattaggcatccttatgaaagtcagtgagtgtacatgccagcagctgtccagccacagacttggcatagcaaaagtggcatccgctccagcagtggcggcctgctgggatctactttgttattgagtagtcagttggtttctagaattggaattgatcagggaccatttgcttgggatgcagttgatgagtgctggaaaaggtgtgtgtatacgggctctcatgtaggagaggtgcagcctccttccctttgccagtggccccagctggtacctttagtgtctggtggtcatgccctgcctcctccatccctgcaccttactcccagcaggttagtggcagaccaacaattaagtgaaagctctgggagcccatagaagctgccagcaaatttcagaggctcacgtggcagggatgccagaccattgcccctcacagccccttccctcccttcctttccccaacccccaccccctccttggcctgcctggttctgcattgcttcgccattgttaaaactgtcttgcagttcgagacatcatggacagcactttgggcctgactgttgccagctcagactccctgcaggggatccttatgtcaaatccacatgcaatcatccctgattgatctatttcatacatttctatttttaacctattggattctttgggagaatgtagaagagacacaatttcagtttgggacccagtggcttgtttgtaggttactccataatggattgagtaaatggctgagctccctgtgtgttgggtaatttatgttcctttgtccattgattcgttcaactgccatttactgagcacctgctgtgggccaaacagttagtgagctgctccatggaccagctcagggacactatgggtgctgtgcccagtcagactcctgggaaagtgggcactgatgactgcatgggcctcagccctcttattgtgcctgctctacacctctccaacccattcctgcctgacccatggtattcaggcctcagatgagtttggtgacagagctgtcccttgaagtgcccttgttcagattgtgggcatctcaaaagaaaagtcaaagaagtgtgcaagtcctctcactcaagttggcaagccccttctgtgggggcgatgcagtgtcctaccaacaacatggcgaaggcagtgggtctggaggcagctgagtggtggtggaggggccctgcatctgacctgggccttgttgccctctggctgagcaactctgggtaaggcctgcccctctctgggtctcagagacctctctgtctttaagaagggtattggactcccagaacccttccatacctgccctttataatgccgggtaccagttagtgaggagctattaggtgtcatacaatgtgccccgtttcacttaatagtcagagcaccttcatgagaaaagaactataattacactcattttacacataaagaaactggggctctgagaggttcagtggcaaggccaaggtcagagccctatgccacgctgcctccacccttgctctgggccagtggttttctgttgagaatcagccatggagctgttggaaaaactcccgatgcctgggccacaccctggatgaagctgtcagtttgtggtgggagggcccaggaatgtggatgtttctaagtgattctgatgtgcaccaaggcctgagacatacagccctggggatctgctttgatgttcacttggccatgacagtcatgcccctcatcgtgctggcaagtggccccatgcatgccttgagctcctagtgggctacaagctcatcaaaccagaagagccaaacttaaggtgacatcagaggatgagcactgtatgtcctagtgaaacttccaaagctggaaaggggttatttggggggtaccgggtgggggaagctttaaaagaattctacctgttcacctatcggcattcaggtgatttccagatccctctcttcctttccttattttgatcattcctgcacatactcctttgcccccacttcctttcccatttacctgctaacatacaggtcatggtcattaacacaacagcgatggatgactgtatgaagccatgaagagtaggaagtctcacattgctagtgactttgctttgttcccaaaggctgtgcttctataaatgatgggcagctcccccaaggttcagatcccagattggggccttttctcattgtttaatatctccccaacctgaggatgcatcttcagaggaaaatttcttatttagataactttatacttttttaaatttttggattatgagtcgttctcgttaaagacaaacaagcagaaatgaagagaatagaaagggaattgccagtcatcccaaataaatgaccactccaaattgttgggtataggttcttccaaattatttttgtgtacacatagcaatgtgtgagagtgtgtgtgtgtgtgtgtgtgtgtgtgtgtgtgtaaaaataaatggaacaatgaatacgatgcctacaatgactgttctgaaacttgtgctttcccaaaaacagtattttaaacagctccccaagaaaacacatccagatctacttctttcctgtaagggctctgttgtattcaattttaccactgcagcctgatgcatttaaccaagactagaaggcagcctaaaagttcaattctatactatggtattccttcgttaaaatctatgtgtctgtagacaggaaagaattaaaactatttagctacttctagttttctctccaatgcctgcctttggcagcatggttcatttagtgacttctgcatagttttgttgaactctccttgaagtgggcagattaccctttgaataacgttctatcccgttttagtatacagacaacataatgccttatttgaaatgtaattagacagtttagatgaaacataataatgaataaataagcactatggttccaaagacaggctgtattttatagttttcacaactataagtctttaaactgagaggtctgttttatcatgcacatttcctgttcattagctttaatgtgccaaacctttataaaaattcctctctctctctctctctctttctctctgtctctctctctctctctctgtgtgtgtgtgtgtgtgtgtgtgtgtgtgtgtcacctctcttcccttctcctctcctctcttctcctcttctcttctcttccattcacagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacaggtaagacaatctcatatctggctgtgttcttttgttttggaagtaacaactgtgtttcatgttgccaatatctggctctggagggtaaatccaggctatagttctctctgagactggaaaagactctgaaaaagtctactgaagtcagctaatcctgtgtggttaaaagcacagtgttaataaggccaaggttatggtttcagtgcctgttcaagtcacctaacttccctagaaggagagctgcacccacaaggtgctcccggtggaaggagccaggtgggacaagtccgaatacagaaatgccttccctgcactgggccatgtagaaagactagtgaatccttcttaagatgtaaggaaattgcactgaagcatttaatcttatccctgctggcagaaggacaaacactgagccttctagaaatgccacagcaaacttttgctgagcaacctcagcatgccatttgtcactgtgctggatactcagtcaggtcgtgaaaggaaaaagacaggtatttgcaaggtagtcactctcatcatctccattttacaaatgaagaaactgaggctcagagagttgaaagacttgcccagagtcacatagttcgcaagggacagagcaggaacttgaagccaggtggtctcactccagagcctgtgctcttcttgaaattacttttgacttctcaccctccctcatctcctccaggcttttcaatcatgaaatgcagctgattccacctgggtcgtgtctatcacagttcccagttttcatttctgtgacccctgcctgtattagttatctgtggctgcataacaaattaccccaagcaccagcttcgaaccatatgcatacgttaccaccacatcctgatttctgggtgttaggaatcctggcatggtttaactgagtcttctggctgagtatctcctaaggctgcagtcatctcaaggctcagtggggaaggatctgcttccaagcccactcatgtggttgctggcaggaagcagttccttgcaggttgttggactgaggcctcggtttctcatgagctattggccagaggcctccctcagttccttgccacacggtctcttcacagagcatctcacaacatggcagctggcttcatctgagtgagcatgagagagtgtgccagtgaagcagggtaatggggagagagggaggagggatagtgccagcaagtcagaagtcacagtctctatgacctggtctagaaagtaacatcccaccacttttgctgtattctattcatgagatgtaagccagaggagattgcatgagggtgtaaataccaggaggcagggttcagtggggccaggtcacacgtgtgcctacacagaatactcagtcaccatctaccatccctccttcccattcctctcatccttgcccaagttcaggtcctcttgattctttatctgaactcatacagttgacccttaactggtctctcccaataaaccatccattgctctgagtcgtcttgctaaaacagtgacctgatcatgttttacacttgctcagaagtccccagaggcccataagctggccccaccagcctcctgggcccttcagcatccatcaggccctgccttgcactttgtttctattacccagaagtgcctgcagcacttggcccacgccatctggtctcagcctttactctggccgttccctgggcctggtcatcccttcccacattttctctcctgtccaacacctgcagctacttagggctcaggcaccatccctccaggaagcttttccatgactgtcctcagtacttccatttcccactgtgcctccctcttctggagagtggtcaaggaggagattataaagtgcttggccagagacctggcccaagggaagcacctgtcaagggctgacctcttatttaagagctctgtatgagcacacctgtggcaacccctagagtacagaggttgtgtcttttccatccaggtttcctggagcataaccatgcagagtgcttgacaccagggagttggtcatttgatagaccatgcggcaagcagagctcccatgggggtggccgggggagcggtgtggagataggcaaagcacataggacacggcaggccacctggggctcgggccctggtctgcagttcaggagcactttggtttgattttattatagggctgttgccatctgtttgcatggacttctgcagctagctcggtgaagccccagcatcaacacgggaactctttcactagcaggcaagatcctcagcctggagacgtgtcaccgtctaacattgtgagcctttctgttttgttttgtcttcaattgggtacatttttgtagactgattgtgttgtcccagagctggatcagctggctcagagggagaattcttaattattggggtcatgcaaatcatacccaaccaattacctaggtggggttggagaaagtgttcaggagaaagaccgaacagtcaagctccctggggctaggagcacaataaagggggcaagcgacttttgccagcagaggcaagaagctgggtccccaaattggaaatgctattgccaccaagagctgcctttccagcccatgctggcctgtgcccaggggccaggcatgggacctggtgcttcacctgcctcttctcattttaatcctcagaggcaggggctgttaccattctcctgagagttggggggaaaggcacagagaagtgaccgaagttgcccacagtcacacagcaagctggggccagagcagacaatctggctacagagcccacactcatactcccatgcatggggcactgcctctgtagccttctgtttccactgtcacctcttaactgtttcctcctctacaaatcaaggtgatgataggttgtctgaggactaagtgtgttaatacatctaaagcactttgaacagggcctggcataaagtatgtgctgagaagggatttgctgtcacgatgactctacctcctgaccctgtgctcccagatctgtttcatgggactaagatgtggttctaaaaaccagtagctgtggcaggacagacacaagccacgttatctccagaccctgtacccaccatgagattgataggagttgtgcagcctctgagccttgtgggctccttttgctctaggccctgcctctcctggacaactcccagcctgatgggaaaggggaaaggggaaaggtccatccctgctttgcagactggggatctcactttgctctttcttgagctctccggcactctcactccgctcctctccctagcactctgttctctacctggtattcttccaggcctccaagctgggggaatctcaacagtccttctgtttcttcttatggcctctccctattaactctaagacctaagaactcagccctggtcattcttccaggggagagaaaaaaataaagaaaaaagcgagtgtttgaggcaagagctgggaccgctgtagaaggacagatggtggccccaatggtggggaagaacatatttcccacttccagcaggctaagcaaacctcccaagttttactgatggccaagctgagcctcaggaacactaattacctatgatatggcatttactagcctgttacatttgccatggacgataatggttaccatggaaaaactggacattcatttgaatctggatctttgaggttttgtgcggggggtgggggcttttttggtttttgtctgttcatttctttagaggcagggtctcactatattgcccagtctggtctcaaactcctgggctcaagtgatcctcccacctcagcctcccaaagcactgagattacaggcaggaaccaccgcacctggtctagatcttagttttctaaaggagttatttttaaatgtgagatgagacacaaacgcttgagtaagctgaaaagccaaatccagccttctatagaggagctcatttttatgtacagaccagcatctctctatttggaggattttgctttaccagttgagtgaactattcaatttcaatgcaccattcatgtccacgtaaggtaaaaggcaaatgccacatgactttggggcagctgtttagcatgggaggttgagcaagcaagggcactggaggcagacagaactgaggctcaagtctggctacagatgctgactgattcaggtcccatgagcaatgttactcaactcctgagcctcagctgaaaatggggaaaggaatagtccccttcacttagggcattgggaaggcaaaggagatgctaacctgaaactgcttagaacggtgcccagcacacactacaggctcaatcagggctagggcagccttgtgggcttggacctgaaacctccggggcctgatgaatttccaaattcagaacatttgggactttgggaaggtaatgtggtgcaaataccaaatgtcacacaaccctccagtgtaatctgaagcagtgtttcattacttttgcagagaaatatgaatatttaaggaagtccagagtcaacttttgcccccacataaaatttggcaccaaatttacaaaagtaaaattggctttcagagcttcttggactttaaattacagataagggatgtggacctggaattattaagggagggatctttaactctttatggagttgcaacacccagcactggtttgtcagattttaatgaccccaaattgcgtcactgaattccccaccctccctccaggctgggtgatatatcttgatgtttaatcagactgaggcaaaatgaattttgtttgcatcatctgatgtcccttctccctgcagattactggagataccttggcgtgttgcaaaaatcgcggttaggacttacttcagtttcactattcacgactgcagaacagatcttacatttactcaaagacacaaacaagtatgtcaaggagatgggagttggactgtggaagactggggatagcaagaggcagcctctggccagagtgccctcagtgcacgtgcatttgagccccactcagatctgcagagctgggagtgtggtttcatggggaggagggatgtggatggaggccagttggaataagaacaaaaaaaagcctggaatctgatccttgaggcaggctgtgcagcacagagggaagagggcagctgtggagaaatagaccaaggaggcacatgatgttgttttgacaaatatggagagggtagagaagggggaatcaaacctgccttggagaaggctggattaagcccctactgggtctgatatgctttctatcttaaggataagctttagcttaggcagtcgtgagcaccaggcaattgcagaggcagtgaactcaccatcttccctttctgaggggttgggcctatgaagaggatctgggcagctccctctaaagtggggccttggggaagcccccactatccccacctgtggcctctctcacccctggtagactgaaccctccgaagtgcagtacttccagcacccagggcctgaagatagatggcacagggcgggggacacaggggccttaccctggggccttggcaggggacaggccctggggctgggctcaaggccaagttcaagaaagctcagactttggatcacttgggtccaaatcccagttctgccaccttttccgcggggcaagcgatttaccctttccaggcttcagtctgtaaaatggagatactagcatacctatctcatggggctgctgtgaggattaaatgagatgaggtaacagcgcttggcatagggcctggtacacaattatgctccattgatattagctgtcactctcaggaaagttcccgaaacccagaacaccagtaacccaatggaatgaatttagtcagcctcggctcagcatccaggctcctctctgacccccaggggtggacggtgacttggagagaaagggcaggggagagctcagtccctctggggctgcgtgctcacggacagtcccttaggggcgttaaggaagacttttgccaggtggctgaggagcagccaaggcagcagacacaggttggtgactccagaaggaagtagagccgccaagccaggctgtggtttcctgagtgcccctgaccgtgggtaggggagaatgttgtcttctcttccctctaagcacggccagctgaacttctaggagttacatggatgctgaataacaaatgcaaccacaggacgactttaggtgggcagagaggagggggaaggaggagctaagttccacctgcagccagcgtggatctgaccccacctgcttgcagcaggctcaggggtgcctgacatttcaagactcaggcagagggcttactgatacacagtgacaatgaacagggcggaaagcgtgtacatgagtggccaggaaggaaagctggtcctgcatagtcatggcgcacagagcacgcatcctgaggggatacctcccctctctcctctcgtttccgtccttcttctgcaccactgactctcactcctaaagcctccaaaaagaatctttgcagaaacccaagattccttttggtttgaacttccaaggctacactagcccactcagtagggcataacctttaattactgctgtctcaattagctctgcaaattaaattctttatatttgaaccatgacttttcatggaaaacaaaaaggaacaaaccaggttagtgaggccaagagaatttccgattctgatcaaagttacatctgctccatttacaactagagtcaggagaggcagagacagcaagtgagccttttcctagtctcagaatcactcattaacattttcaaaaagtaattattatattactaaaatacatgacctccaccccaaaatcagatccaccacatattttcaaggaagggcctgtcaccttggacttacaggtcttctccctcacttccctgcattcctctctcgttttgagagtaaggcttgcgggaaagcaatactgctgtctgtgttctcagagaaattttgtcttttactaattctggcgagaaacatcacagattttatttcaaaggttagtcctgctaaaatgcaagaacagaagcctctagaggaatctctgtgttgtccaccagtcaaatgataagtaaggaagtgcctccacttgccagataaaggactggggaccaggcagatttcaaagagcccgtgggtcagagccggggcctgccctgtgcgtattctctggcagacaaggaaatgttttcctgaatgagcattcttattttgtatttaaacatgatggtacatacaagcttagttttaccattctttctaaattaagctgcaaagagctgtttggtttcgggaaactttttcttagctgttttgtgtggaactatgattagacaccgtgtaacatgcattttgaaaattcggggaccgatatctcagtgttgaaaatgttttgttttaacctctctaaattgccaggaaatgaaaccacatgggctgttgaatttgggaaacacaggcttagaacttggtattaatcttaccaagaatcaaaaaaaagtttttttttcagtttctttttcggtttctaagggccattagtgatcctccacctcaaagctatttttctttttcaaaaagcggaaatttaaaatgagctgcttgttaaatgctaaccttttaaatgtcaacattttttttctattaaaagttaaagaataagtgagacgacactttcaaatgaaggtgactttacattgttcccctggaggaatgagccatcagttagtgtggtcaaccccaaaacttacggggatgcacaaggccgcctacttaagatgcatcagtagtagagatcaatagatacaatttttttcattgcttagtaactggcttatgaaagctgaagaggcaatcattttcagaaacctcctgtcaagttttttgttttgttttttgtttgttttgtcttaacatatctgaagagaaacaaggaaacttgctgaagttaggacacccaaaatgagcccttttaaaaatgaagtgcacaaattattttatgctaagttaattaagacaacctacttatttgtcactgtaaagcaaggcaaggaatctcattgcgcttttcaaagaacgtaagaggacagaaataaatcattgtgtcgtgctgctttaagctgtatctccttatgaatacctacaaacccaaaacacagaacaccatatggagcgagcagtccagttttgcgcacacaacaaacatgaaagagaagtgctgtcgctctactactactatgtccccaggtgaaaagttcgcaaaatgtaaacaagatctagagcagatgaaactcacggtagacttgctccattcagctgtggccctaacacctacagccagcactgtcactgagtgcaggagtggatggtgcagagcgccaaggggaatcaaagacgtgacccttccatccaggtgagcaaaggatgagtactcagagggctggactgcaccctcccctccccatcctgtgcttctgactctcagatccacttctgactctcacttccagcttctgactctcagatccactcatggtcccatatcgtggatttatggaatcctttcccgagtctatttgtacttttagcctgttctgtcccttagggattgacaaatcccacgatctgggcctgccctgtaaaacaactatgtggggcctgacctggctgctttttagcttgaaggggatagcagagggtagaatgctggttacatttaaagcaccctgctcccagatccaaaagaaagtttctgctttttcctaaggagttgaaacagtctgggattttatctgattttgttattttgcctacaatgacaaacactgcttttgtttgttttatcatgttgtgttttttgctagatgagtgtttatcatgccggctgcacccatccaaagcagtaaggttgttgaaagccaaaagcagcagaaaggcccaaagagatcaccccacctcacccacaggctcacctctgcaggtgtcttcagacagctgactcttaactctcatctcagcaacagtttctaagatagagagtggaataaagagtcagcattcatccatttcttcgatgttttctcctttaccccatgtgaaccaagtttcttggtaacgtgcagctaggactcacacagacgaaaagcacagagccacaggccttggctgggttattggagctaggtgcacaggaaaaataaaagtgggtgctccaggacattatatatatagtcctgggctaaaggtggccttcagggcctgaaagatggatagctgtacctcactaggaattatcccacctcttgctttgcttgtgggagctttcagtttgcagctaaaggctcaggttccggccagctttttcccctgtagcatgctaccaaatccggccatcttccagttttgagcagaggaggtgagcgtagctgtggagacacatattcttctgcaggcccatgtcggggtggcccatgaagagaatttgccaaagccagctggctcagcagaccaacagatgaaggtggactactcatttgcaattgtgattaatgatcatttatttccatgtgacaaagctttgaacgatgtgggaggccctcacccatccctgagtgggaataactgggaatgattccatgaccctttccctttatctggcaatcctttcaaagatgagctctggaaaatgtgaacagacaatgcactccactatagctttctagtttcacatcttcaaacaccaaaatgttgacacccattgggatggttattataaacacatacacacagagagagaaaataacaagtgatggtgaggatgtggagaaattggaacccttgtgcattgttggtgggaatgtgaaatagtgcagccactgtggaaaaaagtacggcagttcctcaaaaaattacacagagaaataccgtatgatccagtgattccacttctgggtatatgcctaaaagaatcgaaagcaaggctggacacagtggctcacacctgtaatcgcagcactttgagaagccgaggtgggaggatcgcttgaggccaggagttcaatgccagcctgggcaacatagtgagatcccacctttacaaaaaattacaaaaattaaccaggcatggtggcgttgcctgcagtttcagctactccggaggctgaggtgggaggattgcttgagaccaggaggttgaagctgcagtgagctgtgatcactgccctgcactccagcctgggtgacatagagagaccccatctcaaaaaataaaaaaaaagaaagaaagaaagagagaaagaaagaaagaaaaagaaagagagaaagaaagaaagaaagagagacagagacagagacagagaaagtaagaaagaaagaaaaaagaaagaaagaaagaaaaaagaaagaaagaaagaaagaaagaaagaaagaaagaaagaaagaaagaaagaaagaaagaattgaaagcaggggctcaaccagttatctgttcatagcagttttgttcacaatagtcaaaagagagagacaacccaaatgtccatcagctggtaaataaatttaaaaaatgcagcatgcccatacaatagaatattattcagccttaaaaaggaaggaaattctgacatgtgctataacatggatgatcactgaaggcattaagctaagtgaaacaagccagccaccaaaggacaaatattgtatcattccactcatgtgaggtccctagagtagtccaattcatggagaaaggcagatagaactgtgagtgacaggggctaggggagggaggaaattaggagtgcatgtttaatggggacagagtttcagtacaggaaaatgaaaaagttctggagatggatggtggtgatagttgcacaacactgtgagtgcacttaatgccactgaattgcacacttaaaaattgttaaaatggtacattttatacatatttttaccacaatgaaaaagtaaaggctgcaattttaaaacacttgctagtcctctcctaatcaaaagcagtcttttcttttgcaataatattagtgtacaatctaaaagaagcagcaagctgaactgctcattttccatccctggtaagagcagtatttactgcacatccactcatcatgttgtatgggccatctgggttttttgtatgtcttactgaggtgcatgtttgttaaatgcacaggcataaccagaaataactttcctggaaaattgagcataatggctgtccctctcttgacattttggagaaatgataatacgtaggtgggggaaacaaagaagtgactgtaaacaagaacggacattatctctgcttctgaatgagatgagaaacccacttgcttcattagctctctggtatatctgcaagtctggaaacaccgggatgactcacagtttgctgagtaatacaggagccgacagaatgctgctagtgactcgccatctctgactggctttctgtgcaaactgtcactctagagcaagtgctaggccttggaatagagttctgaaaaaggttacggttctcaactacagggagaaccagctcctaaggccttgacactggtacacaaagtaggacacctctgaccaatgccaaaatgacttttagaaagttcacacctggtcattgtgtccctgctcatgctccagctcacaagatctctggtttctgcctttcagggtgtggtgatgtccacttcttcatcagagttctttgtgacttgtctgcttctccacttggtagtaaactcctcaggcataggaagacgtcttcgctagctctgtaatgtaagctgaatgatccttggaatgaatgagtagaatatagaggggaatgaaccaatgaatgagctgtatctgctagccattgcggaatgctaagttttggaaactgttttgagcattttagaggaagtattgatagacactctcagtcttcaaggcttggaggccgatgaacccatattcttgcactgggcagaaaggagaactttgcatctgcatgtagggcccatttacccactgaccatgatgcatttctctggtccagttaagctccttatccttctatagcacttgtgcaatgtctgaaaacatgtgatttcttcaacttccaacaagtacacaattttataccgccagtggtaatttgtcctggtggttctgttgtttctgctgttgttgttgttgtcgtcatttaatgcaatttacaaggacaaaacaaaacttctggctgccatttcacataccacagtgacagcttcacatggtaagaaaagccaaaaacagctagtttcgaaattcaggccactcattttattacttttccctgattaagattcattcataccactttggggtggtgctgatattcctaacataagccaatcgattttggtcagttctgagagcagtgagtggtcttcacttacacacagtgtgtttgtaactctgctatttctttatgactagcacagtataaagtgaacgtttttggaaggctgttaagcatatgttctcctggtaggcttaaatgtgacttataaaaatacttgatagtatatgaacaagctcccactactggtttaaaccaaaaaaaagaggtttattttactagctcataagcacagattctacattctttgtgagaattatctttttaggtttttgtttttatttgttcttatcattttgatagccattttaatcatttcttttattcttttgtttgctttgttgacttttaatttggaaatgtctgctttggcagaataattacatcacaaggaggccctttccccacccacctacccagaaaggtctcctgactcccttatgctctatgaattgccctagttcaagattgatacagatcaaagcagcagaatggggttgaaagagcagcctctggcaatggccttgaccatgtcaattccctgtgcattcatatagatctggaatcatgtagatctattctgcccagcttgttccacagcagctggtgggcagaaccactcttccaagccgtgtagttattctgcactgcaagaggcaagattacaaccgaggactcattcattaataaaattgtttaagttggctttctgaatgacaacgtggtctcaggaacttaaaagacttcaccaagtccctgctgcaaacaaaaagtctgcattgtgatttgtcagagctagattgacatccagtttagagtttagaatccttctccatgccccacttttgagacaaattacaaatcttgaggttcatcaacattctagtacaatatgaccccccaaggtttaagagccctttagagatttgaagacaactgtgatgttcccactaactctccctccttcccccagttctttgcccctatcttggctgctggcctctgaactcatcacagagcactggagtgagggcctctgggtaagtaaggctctgctaaactgatcaaatgctccacgtacatttgtcccagtagagaggaaagctcctcttttccaaacaatctactttattcctgctcccctacatcccacttgcaagggtagcagccacatcccccatctgtcctgcccgagctcattgtccaagccaactccagctcagaaatttcccccagagaagaggttcctgaaggctaagcattgctctgtaaccctgaacttgatttgtgtctatttctcactctctcattatataaagtttttcaaataatattagactaggaattgagaaagagaatgagcgctcacaattgtttctagagccatcacaatcctacccagcaacaccttttacgggcttttaatttttttgtttacagttattacctttgaaaccaaatcttgactttctggtatgctcttggactttttaagggatttaaaaattcaggagtttgatgccaataattgcttttatgagctagcattgcttcttttctatagatgaatcccattttaaatcatcaattattttcttcacagaaacccacaaagtacatattctagtttgcatcagaattgaatatgacccagaaattcttaatgttattaagctagactattgtatctaaaatgtgtatcacattcaactaatgcatattgaagatcttgagtaccacacttgagatctgaatgaagagcccaggattgtgatatttgatccatactgaatgtatttgctagagtgcattgtacagatggttcaggtgtgttagatttgtctctgtaaatgaattggtcagtagataaaagaacatgactcaaggctgagcagggttcagcaggccccaagcttcatcattaaaaatcgggtgttttttaatatgaggctggctgtgtaaagcagacctcatgaactcaggggtctgagaggccaggccagattatcagttgggatgttttcagtcccaattagcagacagcgcagttcacactggcttaaacaataaaggggacttactgattcctgaaagttaaagtccagcggttgggtggacttcagggttggtttgaatcaacagttcctcagtgtcatcaaagatgctgtttctttctggctgtctactctgccttcagtggcatgagcctcatcctaaggctggctcccccttgtgggcacaagatagtgccagcaactccagaggctacaaatttcctcctgccccattcagagagcaggagaatggcttctagaatctctgtcagaagagccaggaagcttctttcccagaagcccccccagatttcatgctttttagtctgaatggatccaacgcctactagcctactgtgctgcttcatgtcagctgtgtcccccgctagaaccttgtgtggagccaggttcctcctaagcacagaggtggtatgggccaaacgaagctgcctaaatgaaaatggggaaaggtgtcaagagaaggaagacttagtgctggcaaccaacagtatttgttgcaatcaatctcttggccatcctcattcatacacaccttccttcccacgcatacacctcccaaaatgcccacacttagggaaaacctatttacccctttcccaaagggatccaactccaatccggaaaccctaggtgatgtgtcatcctctgaatttggtcagtatatagctcttcatgtttcagggaccactggtcaccatgctcaccttggcatagaaagtaagagtgcaataaaaagaaaaaaaaatttcaattgggaaagaggaagttggaaagcagcacacggtggtcactgatccatcatccatatcacatcctgctggacagcagtagcaaggcttgaccaggggtcagactcagtttcctattctgtataatgagaggattggattaaattagtggttctcacattggaatgtggcctggagagcttgttaaaatgcagattactgggttccatccccagagtttctgactccacagatacaggtggggccctggaatttgcatttgtaatagatttccaggggctgctgctgctgctgctgctgctagtacaaggacacccctgcccttccactttgagaacctctgatttagattatccttatgggcccttctgattctgacatttaggactcagggatttttcttagctatctcttctgctctatactgacttatgatggattgttttataaatgggacacacccaactctactgtgtgaacaacttaaaaacatatcatggaattcctgctttggtttgtaatctaattttcaacaattgaggctgaaaatgaaggacaccttacagcttcaggaaagtaaattttctggaattgaagaaattagaaacagaaagataaaggctttcccatcctccccaaccccatctactacagcacagcggtctgtgggatgattccacgtgactgcagaaagcagctcttttcccaaggacatccaacattttgcaagcattctccctatgtgacccgggtattcattgggtcttagaataggagtagcactgggtgaagctgtgacatagatcaagttggtttaggaattttgccaactttcttccccagggcccctcacctggccaacatctattcatcctcaggtcacagcttaaacctcatgtcctccaaggagcctcctctaaccaacgccccaccccagcctaagtcaggttctcctgttctttgttctctagtgtcctacaatgttcctttatagcacttaccagcctttgttaaaaatcctcactgacgtgctccaccatctgccttgtccatcaatgttttcacaacacaggtcctggatcactgtaaatgctcagtaaatgtgtgttgcacaagtgctatcaaaggcagactgggagcagattccagtcacagtattttattacagtggtgaactatcaagcaatctatataacacatcccacagtgtatgattatgcatgctccaaaggaatgaaacataagtcttcagaagacacaaacacacagctggagagtcccagtgtccctggcatctacagccaactttttcatggccctcccccttctctctgggaagctggtgccttccagtgcccaaggtatctctctaccaggcaccctgggcattggcccagctccctcttcccccatgcccatttgggttgttgattgacacttaggtgaagacaatagaagaccctccagcttacagagtgcccaactcagcagggcctggagagctaatctgggtcaacaccacatttttcccctgagaaagtgggagtccagcaaggctgtaaaatgatgagctccaaataacagcctgagtctcctgacttctggctgcatcttgaatgcatctgcaggcagcttcaaatgtgagaataagatatgaacttatgacactctatagtttatcaccattgctataattctctgccactaaatataattttaccattaaatcaaaccaaaccaaacacttaaaataatttctttagagaagccagattatttattacaaataacgtctacaaactgactaaaagtatatcccacatatattgaatttgaagactgtgcctaagtttaaggtaattgatggattccattctcattagatattcacacatcaaaaaagttgtctgctttcccaggcacagtggtaggttatgcttatgctcatcgtttttcttcccagagctggctcttcctttgaaacagacccatataagccacccatttgctgggtcgcaagcccttcatgagggagagagaagtatggtgggacaccagcaccttctctacagaaacgagcagcatgtttgctaagggctgctggactttggcaggtagagaccatcagaggactcaactgaatccccttttatcaggaaccctaggagagtagagttgtcaggagtttccccatgacttacattgtcttttttaaaacaaccaattcatgactgaggtgaagaaggaaaataacagaaaaatatatctagcccaagaaatctacagaataacaataaaactcaggcagaaatgaacccactgatctgtgagccaagtgcttaagggaggggttggggcacttctcatgtggctcactgtcttagtcagttcaggctgctatgacaaaataccataggctgggtggcttagagacaatggaaatgcattatgcatagttctggaggctgggaacttcaagatcaagacactggcagattcagtgtctggtgagagctctcttcctgattagtagatggtgccttcttgctgcattctcatgtgatggaagagtcaaggtagcttccttgggcttcttcttataagggcactaatctcattcaggagagctccaccccatcatctaatcacctcctcaaggtcttgcctcctaatgacatcatattgtgggttaggtttcaacatatgaatttggggggacacaaatactaggtaggtgcaaaagtaattgcggtttttaccattaaaagtaatggcaaaaaccgcaattacttttgcaccagcctaatattataccacagctctctctgtggttgttcactggggcagtgggggtgtggcagaggggtgagggaaaaagggttccctcgatgtttgtggtagaaagaagagctaggtaaccaagtactcctttttgtctgcttaggtctgccaaaagtcaggcacccgtatcgggttagacattcaaggaatgtactgggggaaatgcctgtgaaagataaacagggaagagcaagagaaggtggggagagactcagaccacaatgcaggtggtctgtgacaattggggcgagaaagaggattgggtaagaagagtctcagacagtagcacagttcaggaaaagttcaaccaggccaatagagagtccttgagccaaagtcacctactggaggagtcctgctcctcacagaaatgggcctgcattactatgctcaccatgttcagtcattggccgggagtacagcccaggccaagtgcagcaaaaatgatggatctaagggggaggctgctggaggcaattatgtttcccatggcaggagatgtcagcagccactggtatggtcaccacatccttccattggtagttgtgggtgggaaggcagagtccctggcaggcagtagacagctacaggaacagaaactggtggtagaattagactgactactttggataacaaagccaaggctggcttgactggctgatagctagactatttctttgttactttgtcactcagtgtttagattgttgtttttccccctttccattgtttgtcaaattccccatctgaacccaggtctggaaaaataaaaccctatgcatttggaagaactttaaaatgaattagcttttaggctttagttgccatcataagcatctagagatattcaggcctcggagttggggcagactggagaaactaaggttatttgagaaataagcacactgaatatttggcttcctaattattctacaaggagtctaagttttgcctgcctggtgcctatgaatcactatttcttaattttcttagtttcacagaatcagaggacatgaatactgaaagatattggaggttgtctagttcgactacatcattgtagggaaactgtggccataaaaggggaaggtacaccaatattccttatgaatcaagacataaaaatcttcaacaaaatactagcaaactcaacccagcaacatttgtataaaggattatacaccatgaccaagtgagatttatccctggaatacaaggctggttcagtctatgaaaagcaatcaatgtaacacactatattaacagaataaaggacaaaaaatgcatgatcatctcaatagatgtaaaaaggaaagggactttctcaagttcacacggctaatggcaaagctgagattaaaactcaggtcatctgacttgtaggccagagttctttatactggtgagggtaggggtggagggctgaaccggaccttgcaagactgtccactgcactgaatcctgtactgagggatttctgtttgttttttcatcctgtcctcacaacacccccaagcagtgggctccgttgttattccccctccttttgcatgaggaaactgaggcttagagaggtaacactggttgtctgaggtcatacagctgccaagtatatgaggagctaagcctagatttcaggtctcctgccttgtctctgatattttccagtgcccgccactgctctcctcactcaacagtgccacaggattaacctggttccattggttctcagatcacctactgccaagcacagtggatgggctttttgttgtaagtggatgggagtgccctccaaattctctggaagaatagcctcctctcttgtgccagtgtgtgacaattctcagagccccagctgttgacctcactgtaatctgggctaagtggccatttatatacactaatgactagaaggtcttttcaaggaatggaggaccacaaagaagcaggcagctctggggaagccagaagctgaatggctgggaggtggggcaggggcaggggacagtggggataagatagaaacaaggctgttctttgctccttgagaagctgggtaacaagctggcttggcttctggtggagtctggcccagtgatagctcttgcctcctgatgggacaaaaaaggggagacaggcatctcagagaatgaggtggagagagacacaactgggccaggacccagaaaagagagttacctttttcgtctcagacctgggcatcccagatggaaccgtgctgagcttctggttagtctagcttcctccaggtgtgcaacacaggggtcctgctagggagccttcccagttgagattaaggaggttgctttcaaaatggccagctgcccaagattgcacctctgtcactgttgaggacagtgggggtaaacatgcctgatgttctgccctggaagggctccagagcctttggattgaagccacaaaggaggcctggcatttggctaccattccttcatctggttcactatcaaggatccctcatctcacccattctgctcccccgttctaatgtgggcttccataagcctctgtcccatcttccaaaatgcagtctggagagcgaggcaccaaggctgcaggccatttgcagggcacagccctggaggctaaagtggaggtgcagtggctttcctaacactggtctgcatgttgaactcagaaatacacggtacccttttcagcaagaatcaaagcaaggttgaaacaggccagcaacgtatgggacactttcttctcttccctttcgtgaaatttgcttctcggatagatctgttttcaccaggaaatgaatcaaagccgcatactctgccttccatccttctcttctcttctctcttcaggtctttcagaccagggaaagtggctgcctttgggatagtcacaacaaggtgccctggactgaaaattgagagtgatgagttacactctgccctggcttggggcaaggccctttcctgccatgagtttcagtgtccccacctaccaagtggggagttggtgtcagacaatgtttcttagtgggtggcattccaggagtccacacacaaaggctaagtccctgcaaaacagtgcagatagatgctttctgtaggtcttgctgactctcatactctctgtctttaactcgcttggcaattcttgagcaaaccattgggcctcttcatctacagagaatgatgacctgactaggtgatctctcatttctcctcaagttacaaaagcgttagggtggtaaggagaggaggtggccccaggaaaaccagatgggtcagaagaagacagaaggtggagccttcagtgacaggagagcagagaatgatgtccccctcccataaatgtagggaaggaaggataccagaaaggttaccatgaaagagaggagtaataggaaagtacaggtcatttgtagttgaaatacatacttgagtgtctgtgtggaccaaatctggggtgggaaggcaggcttcaaatcctgaacctcggaagggtcggcattcctgacaagagctcagagagccaacaccagacaaactctaagtcccctgaagagagtgtgctgagctaggtacttgcagccttgaacccaccctaatcccctctgcctggagcacgtccagaaggagcgtggtttgctgcagaaaagacaagtcagttagaccaaaattccaaagcaactttttaagcctataaatgatgatgattttatataaacttgagttgttccttcaacatagcaccatattttctacttatgtgattctggttttctctaaaggaaatctttttttggaatccacaccatacatacggaagagtatataaaacatataataataaaaccaacagtcatgtacccaccaaccaggttcagaaatagaacattcagaatgttttagaagccccttgtgtgcccctccctcttcccagagataacaactatcctggcttccaagagccaaccctagaaatagaccctaggctctggcaagctttgtgctcatcctagtgagatcatgcacgtcaccaatctctttaggtagtattctgtgcggatttccacagatggctcatctgttttgtgttgatccttattagtttcaattttgtctttttaaatatattttatgactttctgattataagagtaatatgtgctctttgtagtaaacttggaaaatgcagaaaagtggagagaaaacacaaacctcatggcataatacaatatataaacatttaatatataaataatccagaaacaactactgtgtgaacacattggagtgcagtatttcagtcatttttttttctatgtagaaatatatgtttcacattactggtatcaagttgtgtatataccttttccctttattgtggaatataacattgatgcagaaaagtgtgcaaggcctatatgtacagtttaataaggaagtaaaaaatgggccgggcgcggtggctcaagcctgtaatcccagcactttgggaggccaaggagggcggatcacgagatcagaagttcgagaccagcctggccaagatggtgaaacccagtctctactaaaaatacaaaaattagctggtcgtggtggtgcctgcctgtaatcccagctactggggaggctgaggcaggagaacagcttgaacccaggaggcggaggttgcagtgagccgagatcataccactgcactccagcctgggagacagagcaagactccgtctcaaaaacaaacaaacaaaaagaagtaaaaaattaaaacctgctgtcaacactgatcaggtcaagaaatagaatattgacaacccccaagtagatcctcatgtgaccttcctgatccaagataattattctgcttttctacatagcttcatcacttattaatagacttaaacttgtaattgcttcattttcaaaaccttagtggcggggccgggtacggtggcttacacctgtaatcccagcactttgggaggctgaggcaggcagatcgcttgagcccagagtttgagaccaacctgggcaacatggggaaaccctgtctctactaaaaacgcaaaaattagctgggagtggtggtacaagcctgtagtcccagctacctgggaagctgaggtggcaggatcacctgagcccgccagggaggtggaggtttcagtgagccgtgattgcactactgcactccagcctgggtgaccagagtgataccctgcctcaatacaaaacaaacaaacaaacaaacaaacaaaaaccttggccgggtgtggtggctcacaccagtaatcccagcactttgggagaccaaggtaggcagatcacctgaggtcaggagttcaagaccagcctggccaacatggcgaaatcctgtctctactaaaaatacaaaaattagccaggcatggtggcatgtgcctgtaatcctagctactcaggaggctgaggcaggagaatcccttcaacctaggaggtgaaggttgtggtgagctgagattgtgccactacactccagcctgggcgacagagtgagattccgtctcaaaacaaacaaacaaacaaacaaacaaacaaacaacagcaacagcaaaaaaccttagtggaagacacaatctaagcatttaagggaagagtcccaggccattagtagatgaaggctttcagaagaagagaggttgacctgtcctggtcattatctgccttcagcttcccgggaatgtgtagagcccaccaccatcaggacactagcagagttgtggacatggtattggatatgcagaagaaatatggccaaagagattggactgccctctgtgttttgctttcaagctcaccacagcctgcctccagtacctccagttcccaggtgtagggcaacacagaacatccctgtggggtgaagtgagtggcctccactgatctggccagcaggaccaggaaagcagagcaggaaattcaccagacaaagggtcaagccagacctcttccagggtgggggacaggcagatgcctggggacacagagtcagagaggggattcagagatctgcctgctccttaaccagcttccagcccaaccccattacgctgaccatgtccccccattccactttacctcccagatctgggaacatctagagctcctcctcctgaggcttgggaagattctgccgtatagaccacgatcctttccagttttctcctctgctgtcttgtgattcagcttccttggtgctgtgtagtcagttaatcctggtctatctgcattttagtttcataaattatgatgctgttatctcctctcctattctctctatcctggtgggattttgtctttaaaaacaaaacaaaacacaaactcttactgtagttttaatgagactctgggaggaagagaatttagatgcttgcattaaactgctgtctaattccagaagtctccaaaggaaatcctgccactcccttcttcggttgcccgaacatgacggttagttggatggctcccttggaagcccaaggtgccatcagggagatactgagagaatttgaggctgggaaggcaggtgggggttggggtgagggttatgttttgaatattgcttcatattgaagcatttgtagtatttgcggttaagagcctggattttcatgtaagtcaactccaggttcagcttccagctctgccagttacatatggtgtgactttgagcaagttactttgcttttctgaaccttattttccccacctgttaagtggggatcataatggtacccatctttcaggcttgccatgggtattgaatgtttcacttagtaaacatttacagcgtttcactcagtgcctggcacattgtatgtgttcaatacatggtagctattgtcatcatcattatcgtcatcatcatgagaaaatagaaaccttccagaaactgtcagggcaacgattgccacaggccgttgttggctactaaaactctagactctggagagccttgatgcccttcctcttttaccccgtccctgatgctcccccaagtagcatgatgcccagtggcccaccaacctcattatccagcattgctgacaacaggcacagccttggtcactgtgaaaatgccccacagcctcaacctcagaagtgggaagtatactgcagattcactctatgccaagcactatgggatatccacaggaatgtgccacagtgaggtaactgcccaggggatagtaattccttcatttctttatacattatggattctaccattttgttattgggttatttttccccttgtcaaagtagcaatttatcagttgaacttaattctctaattaaatttcaaatctgagaatttacatgatgaagtgaatttgattttggacccagtcaatttcagtcagccctaaacatattttgaaatgttaaagttaaattatatacgtttgtggaggaaaaactccaggaaagcctaaatttttccaggtcttgcttaggggataccctgctccaagaaaacttttacaaaatgcaaatttacagaacagatccaccaaatgggtgggattggtgctaccctagagttttctgtagaatttcttttttaaaaaatttttttcttttttttcttttttttttttttttttgagatggagtctcactttgtcgcccaggctggagtgcagtggcgtgatcttggctcattgcaaactccacctcctgggttcaagtgattctcgtgcctcagcctcccaagtagctgggactacaggcacgcaccaccatgcccggctaactttttgtatttttagtagagacggggtttcaccatgtcagccaggctggtctcgaactcctgtcttcaggtgatccacccacctcagcctcccaaaatgctgggattacaggtatgagccactgcgcccagccagaatttctttagtgagacttatctacccccctccacccaccataccacacgtatcataacagaggtcccccaacttggagttctcctcatttcaaggtacagttattataaaaagaagaggacacctgggtctcacagcagccagctctgcggccattgcacagtagaacctcagtggccttacaaaatattcttgctgttagtctacttactgcaataacaaaagtttcacttgggcactttgatcacacaaagcttggcacaggctttgaaatcagacaatacctaggttctagtctaggctctggcacttaactaatgggtgatcatgggcaggtcgcttaacctttttgtgcctcagtttccttatctttacaatgggattataatagtacctccttcataggattgtcctgaggattcattaattgaaatgaccctaggaaagggtcagtgccttacactgagtaagttctcagtaaatatttataatatcatcatcatcatcaattattattattattaatttactttaccaaaacacaggtcctgctgagccatgttggccagaccacacctagaacagcatgtccagttttaggctaatctgtgtaaaattcagtgcctggaccattgaaaggggctcgatatatggtggaggtattattgttaattaatgctgctgctaaccttcctggagtgcatacaacatgccaggcactgcatacgtgctaattctattagtcctcttaacctttaccactctatgaataatatacaattattaatcccttttgcagatgagaaaattaaggcacagaaacgttaagtaactctcccacaattacaaagcatggaagtggcaaacccataattcaagtctagactctctttttccagagcctggactcttagccaccatgccaaagagctgtgctgtccactgctgtagccagcagtcacatgtaactatttaaattaataaaaaatttaaaaaacaagaattcagttcttcatttttactagccacatttcaagtgctacacacttcatgtggccagtggctaccatattgaacagcacagctctagagcattctattctttctgggatgattcagcatcaactcaggaagttctgttggatggtgatgcttacagagattctgtttcttacaaaatctcagacttcagttgtacagctttcttgcattgttattaatagatgcatacttatgatatattgaaatcccatttgcacttggccaagtagggtaatggcaagaaaaaagccaagaagcgtgacttacattacgttttcctgtttccccggtgcattatttcaaattcacaaagttgtctcctatcacctctctttgatatggggcaggaggcattcatcaacttgcccaaaaatccaggttcttccacatgtctgccttcacctctttgggctatctggataatatttagtgctctagcatagtaacctcacaagtgacttgaacaacggaggttggcttctgaagtcagtgagccacagaggaccttggactctgagcatctttgacacactcatcaagtctccagttcgctttcttgggttttctctgctcatttctgttacatggttagtaaaggccagggaaagaaaaggtgttgaggatccattaccttaattccagaatgattaagtcaagaaacctacaagctctcagaagccagtggaattagagtgcactactataaccttgcaaatgtgcatatgcctccttccgaatcaccagagtggagattgggccaatatccaatctagtcaataatttataaagccagagcattcatccacttcttgcaaagcagctgaatatctatgggggttagtcataatctgagctccttgcaccagagccatttgagctacagaatagcacagagtgtcacagaatagccaaaagtgcagagttatttcagtatgagagaaggaggagcacctgactgctcctcgccatgtgcagaggaggagcccatgcatttccaaacccaggggttgcttggtttctagcttggtttctgtctgtaccccatcttgctattgtgtgacttgagtaagcccatctccacttcctcatcttattagctaggaacaatctatctcaaattcacatgtgcacagagttcagtgcccagcacactaaagcatgttcagtaaatatgttagctgatgttattttcaccatatgattatgatcactctctgttctactgatgggttttataaacccaccagcattgaaaagagatgagtagatgtgctaaaatgagagtaaaggctcagtttatcattggtgtttatcccaaaaaaaagactagcacaatgctcaccagattataatctcccaagtgcctagaacatcatgccaagctagtaacatagtaaagtttattgaattttgcaagtatttgctgagccctttgcctgggctagatactgtcggggcaccagagggatttagagatgattaagacttggcccagcaagaatgttcagtcagccaagggtattcagccacaggagctggacctggaaagagaggcagaatttccagggtggaggagcttcatctcgaaagacacacagaattcccagagtacaatcatggagaaagggcattccaggcttggcaaaccaaggagcacaagcacagagggccgaccacacatggcagcctgtctggagagctccaaggagattggtatgactgggggtacgtgacattatggaacgcaaaacctggctgctgagagggtggatgtgcttgcacttgcatctctagtcttggtgcgagccattggaggatttttcaggggaagggaaactgggctgacctggttccagcaaactctctgacaatcatgagaagcccagggtccagggggatgagtaagtgtgacctccaggaaacggggcaccactatcagactctatctgtcccatggcttacttctgtgagattcgaaatagtgtagaccttgtcagtccatgagctagtaattatgcccaccaattactgatttatttgcctttctgagatgtgcagtgatcccaaggacaaagatggatttaccttatgtttagaaacttctagaagttgaaatgttcctaacaacctttcctgtggaggttgtacctcacacgtagagtgtgtgataagcatttcttttcctaattaaataaaatggagaaaagacacaagcatcagctataaagctcccagtcagtcacagtcaagagactgaatctcatctcttttatttattttttgtgttaactggggattgcattggtctgcacagtgcttgctcccatcctgctccacttgattgagtggctccaggccccctcttgattgctgctgaaatagaactgcccacactgtcggggtatcttccgccgctggtcatttccatgtgccatctgcagttttttctgcctgatggactactgaggcactgcgtatgttatgctgatggggggtcctgtttcttgacccatcactaatatcttgcaagtcacaggaagctaccagggattcctgagcaaaagcttaaaatgcttcagttctctacaaataagccccattcattgcttttagagtgtgttatcatggagcagacaagtaatcagaacctgagtaatatttgcatattgaggtcttcaaaactccagtgtggctataaaatggtatttaaagttatcaaggagctaggtatgcaggcagaaagaactgtccattgcagaaagcaatgcctctgctcatgtcccagataaccttgctccaaggacaaactggagcttgataacatgaagctgcagatggccggtgagctcagctctgtactcactaaccaccccatgggaggggcactgagccctctatggttggcataaatcccattagaatggtaaagaaatccttttcacaagtacatagaaatcgcttgctaagatttcatgggttttcttgactttgttgtttttgtttgggttttagagggtgggcatgagtcatctctaaaactgttcaggtagttaggttgtcttcttattcccatttttaagtatttataattagttcttaaaaatttgtccggaggtccacacctccccttggaaaaccttgcctgtacttttcttaatggcacattttaagtttctatgtttcaaaacttgcttatcatataacatgctaatgactaaacacatgcacacctccacaccaatgcaaacgacatgtgggcttgggaacgaggcaagcctgggtttgcatcctgctctgccactagtgggctgtatgattttgggcaacttagttaacctctctgggcctcattggcctcatttgtaaaataagggcaataatagtccctttctcatagatggctatttatacagatcgaataagaccaaatatttaaagaacctgggttagtgcctaaagcacagcaaatgctcaataaattcagtggtggcaatttttattgttatttcaaatattacatcaaaatatctactgaactattatccattgcaaagacttgcccacaataggtgcttagtaagtgtttattgcaataagttgaagtgattccaactatgtagcttagatttcgggtatgagtgtttccttctccactgggatgtttgctaatggacatagatgatcactcacagctcaggtattaaaagcaggagagtagaggtgttccttcatgtagaaagaagagcaacttctcatcaaggcaggcttccagctggtcctttggacaccactgttgctaagcacttggtgtgctcgtcagggtaccagggctcttagcagccacccatttgcgttttgcagcttttgctgacatggatatcaagtatgaagttattttaattgcctttggctgaaaaaaatgggtcatatgttcaatatgttcaattctggtgaaatccctgtcttctaaagcatgatagaaaggggaggtcccacccacacacaagtcctaaaatcttggggccctagtggggtatagttcaacaagggctgcagctcaggacgtggttgttgtgagatttactcgtgactgtttggttttgcactcaccatttggttttgcagattcctcagcgtgttcacacacacatacctacaaaccagtttagagttgtgtgctccattgtggggggtggtcactggggtggggtggggtagggtgggatcaggcttggtcaaagtcattgctgatgaaccagctatctgacttagctttgttcccattttcaacaagacagtgatttctcaagccaggggagtcttcacatgagatccatggatgggtattaagtggtccagaaaacccccccaaattagatgtaaaatgttggtgggctggaaagggggagacaccataagtgctttttctgtggagagaaaccatagcttataactggttctcaaagaagtctatgacccaagacaagctaagatcacaaagctgtttggtttcgttccaccaaagcagttggtgggtataaccacaacacccagatgacccagctagacactcagggcagtgacaagatcagtcagaaccattttgtggccaagcagctgatggattgttcaatcggttgttgtagactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacaggtaagtcacttccccctgagcctcgctttcctcatctgtcaacggggcacagtcccctgctcagcctgcccgcctgcctcacagggttgttgggaggaacacaggaggtgacagctccgaaggtaaagctctgtccacccatgagggacttctagtgcttcctgggcctgcttgttctctactttctgcccggcattctttggcaaagggacaacccaagcaagcagagtgctccaggtgcctcagccccacctccagggaaatgagtgggggattgaccagggtgcagctgctctctccctcagctgtatgccttccagtaccccgtttccatacctacctgcctgtctgtccctgaggccagactgggaacctgagggggacaggggctgtgcttctgcacctccgaagccctgcacctgatacctgcctgcttggcacctagtgggtgctcgggaactgcctctcctgccagccatctgctgtggattccaaaccccgcccaggactcccacaccctagaggcaggaagttggattgccctgctggaggactggcagtctgggtagtacaggcagaaggaatccaaagcaagcttgtccaagaggcctgtgagttgggatcatcctctagattctagagtctagaaggaatggcttgacttgcccccagagtcgcatcagtggtcatgagagcaagcggatggacaccagccagaggggacctttgcagagaattgcatctggtgcataaaatatcaatgtgcacaggatgtctgcactatctgcagagaaaactggagacatgaacattttctaagtgatagtgatcagaagatggtcattaagctgaaagggcctcccaggattctggcctttaatggaaattcggctttggtatgtacagccttgttctctttatcctgcctgccctggcctggaagaacaagcagtgctttcctttcaagggctattgatttctctctctctcagagtcacagagctcctcagctgttcactcttcagctgaaaccagagaaatcttgtccagcacaaagctgccagggaaacagaattagcaaaacggacgtcgtcccctcaggatgtcgctgtttccaccctggtctgccttgcctttccctgtctttggaagccacaaatgaaaggatatcagctagcttgccttgagaattattgtccctcacctattctctctcttctcaagccaacagctttcacccagcagtgaagtggcagagcagatttgtggccccaaatcttctctaagaaccttggaaattggccccacctgagggcctttgagggtcaggcctggcatccactaaatcctccctgtcaacacagccactttgtcagtccagcctgtgagtcagtgcgagacagaggatgcaggcaccacaggggaagaagaaaagcaagctggaaatatatttgtttcctttgcccgggatcattcccagcatctaaaccaagttcttcccagaccggccaagactgaggaggagtcagaatagagtttgcagcagtcatagatcatgtgggaagacagaaaacaaagggtaaaaagaatttcatatacagatctctgccgtttgctttcagtggcattcattttgtgaagcccccagtgacagcttcagaccagttcaaacctgagggcagcatcattaccatgggtgaggtctctagaagggcaaggaaagacccctaacatagaaaatggtgtggcagtttccagttccccattggggtcccatgacttgaccttaggtttctgccagcacctgcccaccctccatcccttcaccctactgggtggtcattagaacattatctgctttgattgatttacttgtgtccataagagtagagacacacggtgttatccccatgcccggaacagagcctggcccatagtagacccatgaccatgtttgttaactgagtgacagagggactgactggactgtcatgtaagcaataccttcccgtcagggtcttgggaaggtaggttcaggggccccagagttactgtggcccgtatccctctggctgcattctgggcaacgcaaaagggcaggtgttcagtgggttccaccccagatctcggcgttaacagtccactgggagaagtggcccaattcgtgctcattactcccagtggtcctgcctccctgcaggcattctggagaagctgagtcacaggctctgagagttagggggaacttaggaaacaatcaaaacttgcctgccattcattttaggaagccgttgtagtttctgagggacgactaaagggaattttttcctaaaagcatccatccgtcctccaactaggcttcagatagcagtgtgtatgttgtcactatctatgggccatggccagtcagagcccacgggtctcagggggctccacccatgtgggggtgggggtccccacaactcagatcttgaatgtgtggtggtcccatgcagtatactatcttcctgtcattgcaaagggaaagtcagaagggtgaacgagttgtttctaattctggcttccaaacagtacaaaagaaggtttttttccttgtggaatacactagtgctcaacctttgggacagatagctgagcaccttctgctgtgtggcaggctggctctctgtgggggcactcatggagcagtgtctgctggaaaaggagacaggagttccctagcatggaggggtagataatctccccgctccctcccctcttctgtcctcccttccccttctccctcctcctctaccctcccctttttcctctcccctccccttcctcctcctcctcttccttctcttcctcttctttattctctctccctctcagtctccccttccctcccttccttcctcccttcctccacattctttataaaacaaggctttggatccattcactgccatcccccagaagtcttgtcatttgaattcttgtctgagtcaggatgctctcctccaagggctcatagggcaaggaacttcagcccgaatccggctaaaatccaggaacattttgtgggcatctgtctcagtccccgaatcgtttgtcctctgcctttcccccgttggagtccttttgcctgcttaagtggttgaattggtaatgagatcattcttcccatgcagtggtgagaaagcagcactcaggtgattgcacctgggtaaacaggagacattagcatgtggtagctggtgagtgaagctggtgcagtgcctggcgtgggctcagttgtgccagcaggcagtggtggagtttgggctctttcccctctctcctgcccagcacacaacccccagggacaggtgggggctttacagctccctggcgtcagcctaaagcttctagaaaggcatccccaggacttccaaggttgccatcttggctgagactgtctgtgaatgtggtcccttgtctgacagtgggggctgggaggggtgtgacagaggaagagctgggccttagttctctgggggtcaccatgagagaagcacacctgggcttgcatagaactcagtgctgcttgtcagtgtcacctggcacaacaggacgtagtgccacagttgcagccctagaaaatttgacgaccccttcatagctttgtttataaaaggccacacggcctaggctgtccttcataagagagcagaaagcgagtgtcccagtcactaagcagcaactttcaggcacggtttcctcctggtcactgaaaccatttgccatttcctgttttctccattttccaacgattctaattgtcagtgtcaaaaggcaacaactgttttcttggggcttatctttggagcacattgattcagaacaaaggatgggagcctccatctgcaaaacaaaggaagcagcctcctcgggaggcctggagagaatgctctggctcctttggccagggacagcaggaccagcataggagcagaggactggcggtgcctctggacactgccgtaaggtgaagagcccatggaggaccgtcgcttgctggtggcaccccagacttgaagatcctgcagagctggccaccggcacccaggctgggtgtcagcagcgctgtgtggccttggcagtttccatagtgataggctggccagcttttccattagactccggggtcctctggaatgtgtgcttcccgggatgaagacgccccagcacccgctgaagcctgccctgccccggcgtggcctttccttttgtctggcacgcccctgggcttggctttctctttccgtccctcccttcggactttaccgcacttcccctgctgtttccttagtcacactctccagcctccatctgcccctgcccctgaacccctacctctgtacaactgtgttatttgatgaaactaatgcagcaaccggtggggatggagttaaggaccgtttagacctagccagccacgcaggaatctgtccccagaagcagcagaagcacctggtctgcagttaggagatactgtacttcttagccgtgtcaccttgggcaagtcatttaacctctctgagcctctgctgtcacatcagtaagctggggactgtagatcttctgccctgatgtcctgagactggtacaagaagagccaaagcgaaaggactgccttcagaaatggctgccaaccctgaccatctcaggcagatccggatggtgtggccttgggcagtggtcatgtgacccccatgctcctcagtgtccacatggggtgttgctagatgacataaaataatgggtgagacgtgctcagtataatgagagcttgagaaggcagatcccaccccccatccccacccccaccccttgccgccttgccaatgctttggcagggagagggcagctccatagggcagctgagaaacagcccctcactgcccacacggcagctccagtggagggggaggcagggaccaggacaggaagcaggctaagggcgggatagaaaagcaaaccccagtctggtggaatcgcttctggtgtagtcttcccggtgccatgtgtttgtcctctctgccttggcaggaaccaaggccaggaactgctgccaggcctgagagctgggcacagtcccaagcactgggtcgctaccccgccccactcccaccagccccactgagtgcagagaagggttcccagaagccctttgctggaaaagcaggcactgcacgggcagcccgtgttgtagaggcaagtcctctggcatcttgggggggacacagaccagaaagtggacttggagcttgtgctcccagacagagctgccttggtggttgagaaggggagagagatggcagcagttgagcagagatggccgggctcccctcactgtgtggggtgaggcttcaagcactggactgggagtcagacctggatccgagtcacaacctgacaccaaccggctgagggtctcagagcaagtcatgccttttctgggtctgggggccttcatgttattccctcctggctatgttcttcccctttgctccttgagccgatcccagactgagtgctgaaactgcggccttgaaacttggctcgctcctccccctgcccacccagccagctttcagatggagacaggaagctcctcccaattgcctatgctgcaactagtcaggagaagggcgggaggttggcagtaagtgtttggctactcccagtgttggagactgtgtccacctgaccatgtgatcatctggccgttcatgccaggaccaccaggaacaagcctcagtcctcttctcaatgtcctttccctatgacagccctgcagaggctaggtatccaccactacatagcccacagtctgctctgccccagccacagcatccttggcttgctcagccattctttgtctgggtagtttgaagtccaatccccactctcattacttaccatcctctgaatgcagccagtctgtctgggtctccctgagactggcatgcccagactcctgtgggtatagtctggccaaggcagagttagcataggactgtcacctccctccttctacatactctgcttctattaatgcagcctaatgttacatttgttcttttggtgaccgcatctcactgctgacccatcctgagcagatggacatccaaaatgcctaaaacttttttctgtgtgctcttgctattaagttctgtctctcctgccccattctatgctgttgcagttgtgtttttaacccaggtgcagaatcttactttatttatacctgtggaattttgctcgagagggtggggcatgcatgcgagtgtatgctggtgtgtttattcatgctttctgctgcaccaaagccaagtcctaggtccccacgcagcgatcctaaggctaattattaattggtagctgtaatctaatttgtctttttcatcttctgtttagcaagaggaacagagatcaggtcttatggcaatgacccctgaacggcagaatgcatatatctcccaacagatgagtccatttgaaggtaagcagttaaggccagtgttcccaaaggggtgggcaaggggtgcatatgtggaagtggggtgagaattcatttcagagtaagcagttactgtgcttctgaaagcattgagaaagaggagatctgaaaatcagttaaataattcatccaactctaagagcaggatcccaattgaaggcctggtctaaatgactccaaaatcaccacttaattcaagagactgatttccctgagtcaggccccttaaagcagctatttcaatgggacagggaaacaaccctaggatctggattagaatcacttgggggctgccacacccccagggctctgatcctgcccttctcccacacgcacattcacatactgctgcagtgaccttccatttctaatgggttcctgggccatctgtcaggtatagggaatggaaaaggggttggggaggctctgcttcagaaagtttgtgtcaggggctcccagagcctccacagatagatagcaggggtccccaccctaccatggcagctataaatgtgatcaacatttattggcctaggatacagcagttagcaaaatgcctgatgtagttcccactccgtggaggttgcaggctagccaagaagtcatgagttcagcaacccttacgcaccagtgggatgagattggaccaggccgagggtagtcttgggaacactcagcatttgtctgagggccagaagaggctgcttgccctcagacaggaggtcagcatctttattgtagcccatgacacctctacaccattgctcttctggtcttatggaagacatctttgggcctgataacagcggagtctgtgtcccacttgtccaggctggagtgccacatcaggcacactccagttgcagggacagcacagacaagtttcaggaaggctggtggcctccaggaggttaaccttataaggccagattgtaacctagttgaaaaacatacacatgccatgataataaaagaacctaggcaccattacaagagaaaaaatcatttttgtagatacgagcatggattcttgggtgggtcagacacactgggcttgtgctctgactgcactgtctcccctacctgaccttgggtaaaccataagactgctgcatgactcagtgtccaccccaaaaaagtaccggtagatattggccacagtagatatcagctagagtggactctcatgacaatgaggggagatgtattccccatcttaggcacctgggactctaccttccatcttctgctccgtgtctctccatccccaggctcttcagaactcagggagtccagaatgtcagctcccagatttcagccttcagaaaggaaacccattaccgttcagttgaacaaatgttgtctgagccccagatctgggctcagaggccatctaggctatgagacaagaggggaacaaagcaccgtctgcactcactcaccacactcacttgctgtcccaggtcacatccatcgggtagagaatctaagaggctgagctagctcccgccaccagcccagcccaccccacctggccccttccttccttctacaaaatatgcaccacctgtcaaagggtgggcagtgccaggcctgcatacagagcactgagtgtaaaagcagacatggaccctgacctccaggagcttccaattttcttgaagagacaaatcagctggcatttcagtccagtgtgatctgctcttggtgagcacagacctagggagttggggcagcttcccagaagaactgcagtccaggctgagggcagagaaatgaggggaatggcgaggaattggggagcaggggggagctcagtagagagccaagggcgggaggtgagaagtccgtgttgggccaggagctaccctccggtggccacagccgaagtcgaggatgcctttggaactcatccccacttctctctttctgtatgtagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggag

SEQ ID NO: 36705 - DNA, 52640 bp, Homo sapiens
gcccgcggagcccacggagcccacggagcccacggaggagcccacggaggagccccagcgtccgaacgggcagaccccctcgagccgcgaaggagcccgagaagcagccacgatgtgcggtgagtgccgcgcccgcccgagccgcctcctccacgccgtccgcgggtcccggcgccgcagcctctccgcgcctccgcccgcaagcaggcgccgaggacctggctgggggcgccgatctgccccgggcccctaccgaggggctgtcgtcggccgggcctggctgcccctcacccgcgttccccgagtggccgtctcggaggtgtgggtgggggatgcccaacccgactcctggtctcggacacagtgagggggaccgaggcccggtccccacggaggggagggacctggtccggtccggcctggaccccgtaacagaggggtccccaccccatgccgaccgaggtcgctctcctccacgtctcccagtcgcccacaaaggcggccacgcgcaggccggcgcatcccgagtgcggggcgcccatcccgactcagcccgccgcgcccaccgaggagaggagaggcgaccccgccccgccgtccccgcagcccgcccggtcgcccccgctgcgtcagtgcctcaggcagggcctgcgcgtcctcctcgcgaccccaaaggaacgtctggtccctagaagggtcgctgccgcgttaccgcctctttgcgcggggaagaggcagtcactgcccgaacctcggcccgaagccacgagagggagtccggggcggggagcggggccgggcgtccgattcccgcggcgctcccgcgctgtcccgcgtggctgcgggaccgtggggagggcggccgcggcccggagcgcacatctgcaattctttactctcctggctgggccgcctccgctggccgggagagagccgggaacttctgctgggacaaaaggtcactgtgctcttttttttttttttttttttccttgagtaggattcggttacccattccagcctcctgtggctggaggacctggaggaactttcgaagccatgaaaggcctctctctgactttgctgagggccggggtggggtgcgcccgcggtgagccctggccgaggtctgtgcaggcctcttgtctcggaggccagctgctcggcagaagggaacgacctacggcggagcgggcagcgtgcttcgggatgccgcctcacccaggctgaacaggcatccgtggaaattcctgaaccctcagctaaaatctcgtgctcccagacgccattctccatgtgtagagccacctttgggtgtttctgggggcagagatgaggcaaaggtggtagttttgccagatgtccaagccctgatgttccacacctctcagtgtagcattcaagacccttggccaaaactggtggccttggggccagacttgtgcaggagacccttgaaccaggagggtctgcccacagcaccagaggctccccttccccttcctttcagatgctcctctgcccccactgccacccctgcctgtcatcctccttcctactggcatcttgctttttcccaagtctctctgagctttgggggggctctacctcctccagctcacaaaatcacaagtgtttttgttctgcttcttaaagggacacacacgcgttgtctcctagggaaaggttgagctttggggtgtgaccacctgtatcttcagattttctggtactgacttgtggttgtatgtgagaaggagcttgaggtccccaaaggacacccagggctcaggagtggctgcggtccatgggggtgcccactcggagccagaatcaaagagtgcgtgctggcttaggtgccttctcagaattcccagatttgctgatttggggctgggggcagggtgggggaagtggggagggcacagctcagcaggaagtcgtggaatccctgcatgggaaagttatttccttttcaagaacatcaggagaaagtttcaacttggtgctaacgtgtccttaacatctctctgacacttgcttaagtatcctgtgcagaggggaagccattcctggctcagagcaggcagcagcagctggctagaattgaatacattggtctgtttgggggggatgatggtctgagtatgtatgacaagtgatactgattttccttttatggttgttttcttttggcatgaattcatttaaatttttgaaaatttaatcaaattctgcagaagaaaaagtagtgattatgctattagtacaaggatactgcaagaatcgtgaagatgctcctagaaagaaccagataagctcttcactttacgctggggaagctgaggccctgcgaagtctgtgcgcacctggcgtctgagcaggcctcgggtctcagatctcctgggccgttccctcaggggcggagacctaaggcccttccttatcacttggctgatgacactgctgagattatgtcttgctgtcctttatcctgctgcttctctcatgggaagccaggactcggcagtagttgatcctctacaaacagcagatgattctcaaaaactttcagtgcactgagaatttagctgaaatgacactttggttttattgacatctgaaagttgctggcattttgctgactttctgcgacagaaaatttacaatatttcctccctgtctctctcctttccttctctgcttcctttttcattcagccactagtggaaatgcccagtgttttccaggccctgggggactcgaagatctcatgggtgtggtcctcccctcaaagaaggggcaggtgagccgcagggctagtccagagactggtcaccagcagggacgggatgccgatcagggcagtgctgctgtggagggaggaccttgagcacgggctacagcctggtagagtactggccgaacagggaagacagacatctttttgtttggtgcacagggtttaaaccttttcctctattagttaccaaagtacaaaattgggagatttcacataagtaggtgggagttttggcttctcttgacaaaatctgaagatgagcaacctggagtccttatttccaaatagggcctgggtgaccccttgggtgatggacacaaactcgcctgttctcccagtccttcccagctgcctccctcactcatgggactctgcacaacagaggcaggagctgaccttcctaggaagaaggggagggacctggggcagtgccacaaggacccagacacgagcacgggccctgcagagaggagggggtggcaggcacgctgggctggggcacagcatgagctggagtgtggcagcatggaccaggcatgcatggggatttggcaggaaggatttgcgcttcccatccacgaatttgtaaactgtccctgtgcgtcccatactgcacttagtaatctgtgagggagaaaaaaaaaaaaacaatcactgtgaagagctggagaattcttagttcttgccagaaggtgaagcccttgccttgacatcaccgtcttttgtcctggttggtgtgttcgtctccactggctgctgtaacaaatgactgcaaacttactgatttaaaacaacagaaatgtattcgctcacagttctggagaccacaagtccagaatcggttttacttggcccagatcaaggtaccttcagggctgagcctcctccagaggctctgaggagaatctgtcgccggcctctcccagctcctggggctgccgcgttccttggcttgtggctgtgtcgctccagtctctgtgctggctgcagccctccactgtctcctcaggggattcccaagttcagaaaaaccttctttttataactttatggtatagcatcagtaaacagtgcttttcaattgagagattatttttgtatctagcaaaattagcttataaagagtgattaatttgaggttataagtttgagagaaaattctgaaaatgaatttcacaataaaacaattaaactatttaggtattttatttttatttttagaggcagagtctcactctgttacccaggctgggatgcagtggggcaatcatggctcactgcatccttgaactcctgggctcaagccatcctcccacctcggcctcccaaagtgctgggattacaggcatgagccactgtacctgtccccttcttttcttaagatttttttttcttttaattaaatatatatcacttccctctttgtttttggtgaaactgtaagaatgaaagggacactggcaacttttctattaaaaaatagaaatggccgggcacggggactcacacctgtaatcccagcactttgggaggccgaggtgggtggatcacgaggtcaggagatcgagaccatcctggccaacatggtaaaaccctgtctctactaaaatacaaaaaattagccaggtgtggtggcacgcacctgtagtcccagctactcgggaaggagaggcaggagaattgcttgaacccaggaggcagaggttgcagtgagccgagatcgtgccactacactccagcctggcgacagagcaagaccctgtctcaaaaaaagaaaacaaaaaaaaaaaaaaagaaaagaaatgtcctgtccaggttaccacaggaagcagagtctattatctcatggattccaatggtgaggtcactttaactcctggggtcccaaagaggcctggggcagtctggggctgtctccaggggagccaagtccccttcttaccctgagccaggtgccgcgtctgctcagggcccccgccaggcccgcaggctcctctgtctttctgtaagagcctggcgtgggatcacatgcatccgcggcacctccagctttgatcttgtttctgcaaggaggtggcaggaattgtcatccctgcttcaccaagtgacctttcccagtgtatgagaggccacagctcctcagcagcccttgcccaaggcccaggggactctccacacctgtgggcctcacccaggagagtggacctgtccctcttcccccaacacacacaggcaggcccaggcacacacgtgcacacgctcgggaatttcacgagccctcattgaggcagacattcaactggccgtactcttctgttgaggcaggaagtaatccagtttgggacctgggatgatacctaatctctaggaggctcatggactataaaggtcagccccttcagttcggagaagcaacagatggtgggagaaagacagatctctgaggggtgagtcctggcctgggtgggtggtgacatagcttccagagccaacctgtcctgtgtggagcactggctgggcctctccctggaacggtcccctcactcagagtgagggctgggctttcgttgggaagccgatgcttggaaagttggagagatttttcaaaacaagcgtcaccagaatcagaacgtgggcccaacctggctgctgcgaagtggtgtcttccccatcccccaggccgcaaatcatccctcccctccacccccacgctcagcactccaggggctgtagaggaaatcccaggaattcagtgccctagtgtggctgaccttctggctgggtgtccagggaatatcatctccctgcgctggccattgtcgttatctgtcacttgggggttgaaccctgagcttcagaggccctgcctgcgtgccccttcatgatgtctttgctcctgacttcctgtgtgatctctcgggccttgtgcagagaaagtgctggaagccccagaatatagcagtgagccggggccaagaggctacagtctcctctcggagggctcatgtcgaatcccttctggaatccccttgagtttttctcggtccctctccttctgggacctttcccggttcattttatctatcaattttgaggatagggccctgaaaggctgtctggaagctctgggtgggtgaccacagggcacatgaccaaactgggtggtggggccagggcagcctctgcccccaggccgggcctttctccaagccacctgggctctcctgctggtaggaaggatgcttggcccagggccatctttgcagaggttgcaaagtgctccttttctttagaaagatctccaggctcctgtatctcagactttccataaagcctgcattttcaggctctcctgccttcggctctcctggcctctcaatcccaaccctctgcaggctcttgggaacctgaaggcacctccctgtccagcccctctgggcgctcagcatcccccacctggctgggtccatcccctgtctcttcaatgtgagaaataagactgctcccaggtttgctaggcctgatgtctgttccctctcagttctgcaaggagatttccaagctaagaagagtaacagaaaggggaaaactttcccccaaagaagtttggtgttatttactgccccgttctcagctcatttaaaatcctgtcgcctgccagtgatgcctttcttacgccgtgggcagccctgggagtggaggctaggaaagagcagtagatcaaggtagaaagtgacagatgccttgaaaaggggacggaaagttggaaaaaggggttcagaggagggaaaagatcttcatctggggtagggggttggagaaggcatcacatgtgcataggcctgggggccccaggggcgcacgcactgggctgagggcaccctgcaggagtgggacccagagggcggaagctgcagggtggcatggggagcaaggcgggctcaggccagacagcaggaggggttgacgtcacgcggtgggcccgcggggcagagaagacgagagagggatgtagctggaacctgccttgccgtggtcaccgaggccctggtggggtgggggctgaacaggaggagaaaggtggagttggaagctggactgtcccgtggtggggcttggctctcagggggcagcacctgtcctggacccatctggtgctaggcgggcatctcctcagaagccagggaccctctgtgtgagctatacctttcttcttgggataggtttctatgctgattgtggggaggtgggggtagaagtggtgagcccaggcttgcaaaaaggcagacctggctgtgaattcctcaagtctttggcagtggagcctccgatgccatctctatccctgggaaccacagtctcttcacacaggatgtcatgaggattagaggaggtgaagctcgggaagggttggcatgcggggagccactgtagatggtggtttacccagcagggttctgggagccttccctaggccctggctcatttgattagaaggctgtcctcatgccagtcctgggatcctcatggtgcatggggccgggggtgttgtgcggggggatgtaagcctctgtgtttgattatcttggggttaaccgagagttctggtggcaccgtgctcccattgtaagggtctggcactcagggacctcctgcctctgtgtccctcttgtccttgctgtgggtcccagtgagcggagctgcttatgcttggctgaacgtggctgtctcagacccagctcaaaggctaccttctctggcattcctccatctgttcattcattcactcaacatggatttattgagcacctaagatgtgccaggccctgggccaggtgctggggactcagcaatggatgagacagatgtggtcccatcctccagaaggttacaatccagcggggagccgaagaaaaagacaaggaagcaagtgcagcgtggaataaccagggctatgtggctggagaaggtggtgggaaagatctgctaaaacctgcagaatgggtcagaggcgcctttgcgaagagctagcaagagccagccttgcaaagagctgcctactcccaccccagcgggaagccctttcccacctcccctgtgggcttgggaggtccctgtgcatccctgtccttccctggagcgctcagtgaggccccccgatgggtccatcccagtagcttgcagcacctagtacagcaacgcggccttgtgggcctgagaactgcttacagatgaattaaatcttgaccaagccacaaccaagtaacgcatttggtttaaccattatttccccaggcagaaggccaagatgaaatgacagtaaatggtactatttcccccttggttttattgaatgataaatctctcaagggataatttctcaagctccttgccctgtggcaggcactattgtagccatcaccctgtttcactgacagggaaactgaggtccgaacattcagtggcttgctggagagtgcactgaaatcaaggggtggagctggggttcgaggtgggttccggcactggccacggcctctgtgcttctgggtatgccttggctggtgaatggcagcagcagggaggaagccaacccaggcgggtggccctgggctggtgtttttaaggctggggcatgtgcttaggttgccccttattacagccctcttatggccgttgctcttccaggggagtggaacaggggaccagccaagtcaggtgggcccggcccctcttgtcgaggggcaagaaggcctggccagggcaggcctggcgtcccctgcagagggaagggccattgtggccctggtgcttcggacatgccaggagggttcaagcaccggtggaaagcagaaccagccagaggtccggcctggctgggggtcccaggtgccgcacggtcactcctcctgtacccagaagctctcaggtcccactcagcagaatgcctgtgccacaggaaatccaggtgaaccaggcaggtctgcgtcatgtacaccactgtccaaacagtcggtccatgttaaccctcaggccttggctaggacatccccctgtggatagaatgaagtctttgcttatttagacattatctggcatctagataatggtgatgtactcatcaccacctaattcacataggggcacatgtgccatggcacacggtgaaatgtcttaaccatctaaagaggacacgtgcagtggaaaggaagtttctgctcaacatccagtgacctcagaggctacctttgactgccctctgggcgtggtgcccttctagaaatgctccatgctcctcccccagcccttgcgtaatttactcatattctgcaagcttctttttcccttgacacatcttggagatttaaattgccttccaagagaatgcacagctttcccttgctctctgttgagggctgcctgtaaaaggccctgctgtgtggctgcactgtcccttgcctgtcccttgcctgtcgcttgccagacatcagactgtcactagtctttggcaaccacaagagccctgagcagctgtcctcgcacgtgtgcacatgcatctctgcaaaaagtccgctggataccttcttagaagcccaacagctctggtccacagatgtgtacatttttaattttgagagattgccagattgctttccaaagagggtatgtgagtttaaactctcactgtccaactgtttgatctttaccgacctcatgggtttaaaaaagtggattctcactgtagcttttatttatggatggaaggaattccaaaagggaattctgatgtaaatagcaggagaaattcctgggaaaggagcttcattttattctgtgttttatttttaaatgataagagcacagcgtgaacgctattttattcacttgagtgcagtagagtgcagggaggatccagccaagaggatgagctgcaaaagcaaagaaacagagcttccttcatgaaagaagtgaccgaagggatgtcactacgcaagagggctcgtggtgaaaatgagatttatgctttcttgcgccaagatggtgaaaaccacactccttggcagcttttctcactgcagtcagctcccctgctgtgcctgagtgggcaccgggcctcctggctgggtacggacacagctggtggtcctgaggacaaggaccccttatgcccccgctgctgtccaggaggctgtcgtgggtctgaaagtcagcggtgccttgcggagcgtgccgaacgttctcgcctgacgtgtgcaggagtgaagtgtggctgggaggtgggggagctgcaggggggagttgcagagctgactcattatgcactcgggaacatcattcagatgcaaaaccttttcagagttggcaatgggtacatttctgaacctttgtgtcatctgtgatgtctgtctgcttcccttagggtggtacaagtataattctagaacattcccagcccaggatgccaggaaagttcagtgtaaaagactctaacagattttattgagttgttccctccctcgcttaactgtggtctttacattgaccacaatttgaccatgtccccacagggaactttctggttgttgtttttttctttctttctttcttcctttttttttctttttgagatggagtctccctctgtcacccaagctggagtgcagtggcgtgatctcagctcactgcaacctctgcctcccgagttcaagagattctcctgcctcagcctcctgagtagctgggattacaggcacgcaccaccatacccagctaatttttctattttttaagttcagacagggtttcaccatgttggctaggctggtcttgagctcctgacctcatgatctgtccagcttggcctcccaaagcgctaggattacaggcgtgagccactgcgctggcctctggttgtttttagaagagttaatgttatgaaaagtttcacctaggctgggcactgtggcttatgcctgtaatcccagcactttgggaggccaaggctgtggggatagcttgggcctgggagttcgaggttgcagtgagccgagatcacaacactgcactccagcctaggcaacagagcgagaccctgtctcaaaaaaaaaaaaaaaaaaaacatttcacctaaacatgaatggtgataattgcacaactctgaatatactaaaccactgaatcgcatgctttagatggcaggctgctacggtacatgacttatgtctccagaaagctgttaaaattttttaattgacattaaaagatgtattagtccattttcatgctgctgataaagacgtgcccaagactgggcaatttacgaaagaaagagggttaatggactcatagttccacatggctggggaggcctcacagtcatggtggaaggtgaaaggcacatctcacgtggcggcagacaagagaagagagtgtgtgcagggaagctcccctttataaaaccatccgatctcatgagacttattcactctcacgagaacagcatgggaaagagccgcccccatgattcatttacctccttacacgtgggaattgtgggagctgcaattcaagatgagatttgggtggggacacagcgaaaccatatcaaaaaataactatctttttaaaaaataaggtgacaaaagtacctcccatgcccagatgtttgggggctgtcgtgtgagcctctggaaccataaatactcagcagcagtgctgcgcggccctcactggggacactttggccctgccggagaagggcctgaactgcacacacagcccatacattcagctcctctcacctgatctaaagatggcaaggaagacaaaaatagcctaccgagaaaattgcccttggctgattttaaaggaaaacgcctgtaactgctcagaaagcatagtgtacatatttttatatataaatcccccaccttaatacatatgtgcaaacatatcctgtgtacagtagctttcagtaagaatttaagtataatttatagtactatttaattttattgcctatttttgactgtttatagattaattaagtttatatgatgggaccccactcactgtttaggaatataacattcatttcattgaagtttatcatttattcagatgtagcatattgacatgaatctgatcttcttaattaccagagatattccaggtggtttcgtatataatcacaatcagctgtctgttatctaggggcaggttgtcctctctgaggttcacctctggaaaaatttcaatcctgatcagacctttctctcatcccagcaaaacatagttgggaaaataaaccttcttgtaaccctcgtggcatccatcccggggtactggccagtgggtaggagtgtttaagtcctgagtcggggattcttggttccactctggctctggacgagtcacaggctcccctgtggctctggtccagaagttaagaggagggccatggactagcctcagaggctgttttgagcataggatgaccctgtgggaactggtggcccagtgcccggcccacagggacttctcagtgaggcgagtcgctgttgtggcctgagagtttgttcccccgtcattcatctgttgaaatcctcagctgcatggtggtcttactaggaggtggggccttggggaggcgattaggtcatagggacatgggcctcacgaatgggatgagtgcccttatttaaaaactgcggagccaggcgtggtggctcacgcctgtaatcccagcactttgggaggcggaggtgggcagatcatgaggtcaggagattgagaccatcctggctaacatggtgaaaccccatctctactaaaaatacaaaaaaaaattagctgggcatggtgtcgggcacctgtagtcccagctactcgggaggctgaggcaggagaatagtgtgaacctgggaggcggagcttgcagtgagccaggatggcaccactgcactccagcctgggcaacagagctagactccgtctcaaaaaaaaaaaaaaaaaacctgcaggccaggcagggtggctcacgcctgtaatcccagcactttgggaagccgaggcgggcggatgacctgaggtcgggagttcgagaccagcctggccaacatggagaaaccccatctctactaaaaatacaaaattagccaggtgtggtggcacatgcctgtaatcccagctactcgggaggctgaggcaagagaatcgcttgaacccgggaggcggaggttgccatgagccaagatcgtgccattgcactccagcctgggcaacaagaatgaaactctgtctcaaaaaagaaaaacaacaaaaacaaaaacaaaaaaaaaaacctccagagagaccctggccccttccaccgtatgaggttggaatgagcagtcactgtctgtgaggaacgggccctcaccagacactgaatctctggcaccttgatcttggacttctcggcctccagaactgtgagaataaacatctgtggcttataacccaggcagtctgtggtattttgttacagcagcccaagccaacttaggacagttaccgtgaatatgcctgaaacccagtgacatttctatgacccatactattgcctccctccagggatacagatacacactcatcacatattctgttccacatgtgaacaggactgggtgccaacacacagtgaggaatacaaagatagaagcaccagcctgtgcccttggtggggactgtgggtgtcccatgacgtgagagcactgaggtggccagagccaggagcacacctgcccagggcgggggctggagctgagctttgaagtgggcaggttttcctgagcagtgggagcgaggatgaaaggacagagggatgatgggatgaggatggggcatgcacagggcaggagagaggacatcaaggatctgtcatcacaaacaaggagtggaggaatctggaaggcagaaccaacacaacggctaactttctgtttggaaaattatcttgaaatatgaatacagaaagtcaagtggaacaaaatcttcttgactcataggcctaccttgaacataaggattctgcaggggccaaggggcatgagatggttttattcttgctgtcataaaagtagtgcttttttttttttttttttttttgagacagagtctagctctgtcgccaggctggagtgctgtggcacgatctcggctcactgcaacctccagctccctggttcaagcaattctcctgccccagcctcccgagtagctggggttagaggcacacaccaccacacccagctaatttttgcatttttagtagagatggggtttcaccatgttggccaggctggtctcgaactcctgacctcaggtgatccacccacctcggcctcccaaagggctgggattacaggcatgagccaccgcccccggctcaagtagtgcttatttaaggtcaagttccagccttacggagaaggggaccgtggaagcaaaggccccagcgcctgtcccatctgccctgggggctgctgtccctttctatggcactcctagatgtgtgctctgcaaatcagggagtgcatggaggtggggacttccggatgtcctaaggcggttggatttcattgctgccttttctattatggacattgccacgctgaaagctgcctcctgcaagtacagcataggataagttctcagcagtggaactgccagcccaagacatgtgacacaggctttctgggggtttttgtcacaggaggaagaaggggtgcaccgttcttcagctgtgctcagggaggggcatacccacctctgcaagcccctgggagacctttgtgatgccacctcggtgcatcccccagaagcgttttcttccaaacacgagctgagtattttatgaatgcaccatttttttctctttgaacaggaatctttgcctacatgaactacagagtcccccggacgaggaaggagatcttcgaaaccctcatcaagggcctgcagcggctggagtacagaggctacgactcggcaggtgggtgtgcggccgcccgcctcgtggctggggaccgggctccgctgctgtggtctcacccatctccactgcaggggggtttacaaccagggcattttttctgctactttttaacgtctcttttcaatataaaaataacacttgtccgttaaagaaattcgaaaactatggaaaaatagaagaagcaagggtaaaaaaccccagaaaacccccttcatcagaagtccccccatcaggaagcagaaagggtacaaagccacagtcatgcagcatgagtaagtcctggacagctgctctgccgtgcggtgcctgacttgagcaacactgtattttgcacataaaaatttgccaaaagggtagattttcatatttttatttttatttttgttactcaggctggagtgcagttccaagaaattggctcactgcagcctcaagctcctgggctcaggcgaccctcagcctcctcagcatctgggactacaggcgtgcaccaccacacccggctaattttttattttttgtagagatgaggtctcactgtgctgcccggcgtagccccaagcgatcctcctgcctttgcctcccaaagcactgagattgtaggtgtgagccagtgagcccagccaagagggtagagcttatgctaagtcctcttatcacacacagaacaatacataaagagggcaggagcagactctcggaggtgataggttgatggcatagacggcagtggtggtttcatgggggcacacgtgcctccaagctcatcgagttgtagacattaagtatgcgcagcgttgtgtttgtcagccctgcctcagtgaggtggcttcattaaaaaaggagcccccatcagtctttgggacccttctccggtcgctgttgtctgtgggggtggtctgtggtggaggtgttgtacgttgatattttttgtttttacctaattataattatgcaattttgtaattttatattcttctcttttcacttggcatttctaggatcctaaactcattcattctttttttttttttttcgagatggagtctcgctctgtcacccaggctgaagtgcagtggcgcgatctcagctcactgcaagctccgcctcctgggttcacgccattcttctgcctcagcctcccgagtagctgggactacaggcgcccaccaccacaccctgctaatttttgtacttttagtagagacggggtttcaccgtgttgaccaggatggtctcaatctcttgaccttgtgatccacccgccctggcctcccaaagtgctgggattacaggcgtgagccaccgcacccggccgatcctaaactctttctaagtagctttctaagtggctacacaatgctccgctgggtggctgtcccagagttcaggcctccattcactgcaaaggtggatgtttagtctgttgaccttgtttaattatgcagcctgaggagaaagggggagcccgatggttttaaatccttgtcgactcttaataggaagcacgtccgatagacgacgggaggaacactaacgcagtggagataccaacgaaatatcacaatgcgaggagcccttgggataaatgccctgcctgggcccattgccatcagccgagggcctgggagcgcctgcagcggggaagtgtcccgaggggctcaccctagctaggcaggagcagggctgggggcagctgcggcctggaggaggcaggggcttcctcacttgctgttaagcctggccgcagtcacagcctctttcagagcagatttcctgaaaactgtacagctctccaacctgccataaacggacagcccggggcatgcagccctgaccctgcggagcacctgtgccaagtgtgtgagaaaaagctttggttgcaatataacaaatgctgtctacatcacaggtgtggcgatcgatgggaataatcacgaagtcaaagaaagacacattcagctggtcaagaaaagggggaaagtcaaggctctcgatgaagaactttacagtaagtggaggacctctgagtgggaggagccgctgcagcgccggccgctttctaggaccgtattccaacagcgccggagaatggagattctcctttgtcccagctcagataaacagagggagggctaagcccgtgctgtaaaaccgggcttcgcagggtatgggatggtttattttaggtggtggcggcgcatggataatttttttaagtgtgaagggttacatacagtagttattttaattattccagcaaatgatactgcttctctgtttatggtagggatatatcattttctttttaaagcaagtttatttctgtgaagaagtgagctaagctacagacaagtagtaaataaccttcagcacgggtggtttgtgggcctgcgcggactcccagggtgggagctggtggggaggtgccatcggtgtgggtgacgtgacttgggtaacgacaccaggttgcactcacagtcctgggtcgaggcttgttgttcaagtgcggcaaactgattttcctttcatttagaacaagacagcatggacttaaaagtggagtttgagacacacttcggcattgcccacacgcgctgggccacccacggggtccccagtgctgtcaacagccaccctcagcgctcagacaaaggcaacggtatgtggcatgcttccccgtccccatggttccacctcaccctgagctgtgtcagggccagtgcccgccaaagcaggttccgcgcccacctctaactgacttctcagcctacttcatcttcccaagagaatgcggatgtcccctctcccagagctctgccagtggcctgggcctcagtcaggaggcaggcagcctggtcctagggtggtgctggcctcccaggagtgcacaggaaaacgatggcacttaaccaggagagctgctggctccttggaacccagcccatgagtgggatgaggccgcgtgagggactgaggggcctgggcactgttcctccccaagtgacggaaatgctgcagaagggtgtacccttcaggcaaggatgggttctgtccttatgcagctaaacctgtcttttccccacagagtggtccaggtgagggcaggggctgtactggtcttgattggtgccaccagacacaccgtgggccccagcgggagacctcagcagccaggggcttagggtttggagaagtaggggccgcagcccgaagcccaggggctcttcccaggtggagagccctcaactcagcttgcttcatgttcttaaaagttgagaaccactgtgcataaaagtccagacttctggcatcacttgaaaaactggaggatctggaaacactgagctgacagcacgttggagcaccacagattggcagagggccaaggttgctgcacctgctgtccttggtgggtttcaggctctcctgttcgcccagtcaccccctcaggccagctcacaggtctgtgtcacttgcatgggtcgccaggacagttctccacgcgtgattctcttaaatgacacccttgccccctctcatgggggaaagactggtaggtctgcagctcctggtggcagttctcaggggtctgtggtcagccccagggcgccgggtcccctgcagtgggatgcagtaggcatggagcagaagagaggatctaatccctgtctcctcccaggcctccaagggcaggcaggagtctaagacataagctgggccttccagggggtcccccactctaggtgaggcctggtccagtcacgagcccctgaagcccccaacctggacatgccaggggagggtgtacagcaaagacagtgatttctgaagtcaactggaccccccaacccaagacatcctctggcatagtgtaagttcgtgccaagcctaatgttagataggaccaaatacatcagagcagttactgggagcttattagcaggcactaagccttgacacttgacaagtcccactgcggttaatccttgtggaagtcaggccacaggagagcagcaccagcctgcttggtgtcccccacccactgctgatcagtggttctccgaggcagtgtaactgggcgggatgggcaggcacccccaccacccacagaaagtgcagtggtgctgcttctccccagagcactctgcagggcctcaccagctcaccccgcccaatttggaagggaaggcgtcccccagaaaacggaaggagagccccatccaccctgctcagcagagcagcttggtggtagcacaggagccagggctactcatgcatcctagtgatcagggtcttgagggagtgaggtttttgcgagggcctcttccttgggtctggctcatgccctgaaccatagggcatttcgtgactgaggcacacaccctatgtccaggaggaggacagcagaccccatggtgctgaggacctagaatgtacatctggccagagcccaggtcaagtgcagaagctggtccctggggcagtcgtgctggccgagaaaacactgcgcccagaccatgtgccctgagatgttgccactttagccacagcctcctgcccttcccagtgataaaatgaacctcattggaaaatcccccacttcagtgtagatgatgattctcattgtgtccccaaagcagggaggctcccaggaggcccacccacacccaaacttggacactccagccctgactcaggatgagtaattgaaaagaaaacaacaggacaataagcaaagatttataaaatttctttgacactcagcagtgatagctgaagagcatgcttttaaggaagtctgaacgcccagcaactataccacacaaggaaattacacaaagattctgcagagacaacatggattccagaaaacaaattaatgataggatcatagactgagatgaaagaaagtgtagcagaattaagagaataatgtaaagaaacaatatcaccggccaggcatggtggctcacgcctgtaatcccagcactttgggaggccgaggcgggcggaccatgaggtcgggagatcgagaccatcctggctaacacggtgaaaccccatctctactaaaaatacaaaaaattagccaggcatggtggcgggtgcctgtggtcccagctactcgggaggcggaggcaggagaatggcgtgaacctgggaggcggagcttgcagtgagccgagctcgcgccactgcactccagcctgggcgacagagtgagactccatctcagaaaaaaaaaaagaaagaaaaagaaacaatatcaccatagatataaaaaaatggagaaggggatggacgtggagccagttaatatggatccaacatatgggtaactggtgtgcacaagaagcgatcagagcacagagcagtaaaaaataaataaataaatacataaaaaataaagctgagctgtggtcagcacatctgttgaaactgggcttttcttatttaagccctcccatttttgggtgtgacctcacaaaaacaaacactacaatttttttaaatagaggaaatcatggtgagaataaagaaaaagaataatggaaaagatttcaaaagatgctgtgggagaaatctttcccgaactgaaggaaaacttgagttggatatccaaagaagggatcaaaaatagtcaatagaccaggcacagtggctcaagcctataatcccagcactttgggaggccaaggtgggtggatcgcctgaggtcaggagttcgagaccagcctggctaacatggtgaaaccctgtctctactaaaaaaatacaaaaattagccgggtgtggtggcgagcacctgcaattccagctacttgggaggctgaggcaggagaatcgcttgaacccgggaggcagcagtcgtggtgagccaaggtcacgccactgcactccagcctgggcaacagagtgagattctgtctcaaaataataatggtaataataaaaacaaataagacttcacagtgatgctttgaaaaaaatagtcaatatttatgaagcgtatcccacatctagacacctcctggtggaattattgaacctcaagggtaatagggaatctttctgtcctctagggggagagggaaacggagctacttgcccagaaaaattctcaggctggccttggatctttccctcaaggcactcatatgcgggctattcattgagaaaatgcagtggggtggaggcagacatccctcaccgcatcccccgcatccccctgctccccccgcccccccgccacctccccgccaggatcagcggggtgctacctgtgcaggaagccgcccgcgtgagctgggttgtgcggcaggaactggggaggtgggaaaagctgcagctggcagatcctgctgtgcaggaatgtggctgagcctggggatgccagaacttctgggatttttcccccaaggaaaccaggattttaaagtgaacactcagaattttaaaaactcaaatatttttacaacacagtgtgggtcaaacacagcacggtgctggactgttctttgcgacctctttgtgcctaaagccagttgagagtgcctggaatcacttctggaacgaagggctcatcatccccgtgggacatgaaccccaaagcctgtttgatactataatagcgcacaggggagagctctctgcacggtcaggctggtggctgctggtcactgaaagagggatgtgtatttcctccggatcccattgtagtagccgctgccctagacatccctggtgctaatccctggttccactgtagttgctgccgtaaacatctgtgctaatcactgtaaacaaagtgtgcttaacagaagtcttgaggcctggagtttgcagagagttctcaagccttgaaatcatctctcttcacatctgacatgaacctccttctcaatagcatttctctcttaacttttctttcagaatttgttgtcatccacaatgggatcatcacaaattacaaagatctgaggaaatttctggtaagatgcttcccctaggtgatgtctcagtccggtgggattggtctccccagaaactttccagccagctcatttccttgcggaaaccagtgtgggaactgagtgagacccacactcagccacgtcaccgtgttgagaagaaacctctgccttggctgagccaggccctgcagatctcgtttgaggagataacagggcattagtgtttatctcaagggccactgcagattcccagaatcaaaataacaggagcttcgttttattaaactgtctgcattatataacacagcgactcgtataccggcggagttgggacggaaagtcagacagtgactgtctgaagtttgaaaggctctgtggtgttagttgggatgtgggtgggtttgactcaacgtattttatcattttgactgctgttattttgcaatgtccagattagtggcaagggtgagcttctgaggtgggatgatctcagggcctccgggagtgactcagaggtatttggctgtgatgctggcaaacatttttccccccttcccggttttccctgttcttgacttaagtcactccaagggcagatcaccagggaggagagggagttggccaggcaggcattgtgcaatgaccaatctctcacactgtgccgactgcatattccaggaaagcaaaggctacgagtttgagtcagaaacagatacagagaccatcgccaagctgattaaatatgtgttcgacaacagagaaactgaggacattacgttttcaacgttggtcgagagagtcattcagcagttggtgagttacaaatcccatctgtctaactcattccttcattctttcattaaaaacatttttttcaagcagcaagtgccaaggaatccttcattttttataagcccttgttagacaaacttgcacagagtcctggggataaaagacagcccatctgcagagcctggccttaagatgttacactcttgtagaactggaagacgttctgtggtttgggtagtcaacatcaaatagaaagtgccctgcttcatcgtgacacttctgaaattgtgactggcattagagtccgtggctttttatgatgcacacgtgagcttggtggtggtgtgcagagagagttgtggtaccaagcgaggatgtgtttctaggtttttcttttttgagacagagtctcactctgttgcacaggctggagtgcagtggtgtgatcttggctcactgcaacctccacctcccaggttcaggcagtcctcctgcctcagcctcctgagttagctgagactacaggcacgcaccaccacacctggctaatttttgtacttttagtagagacagggtttcactatgttgaccaggctggtctcgaactcctgactttaagtgatccacctgccttggcctcccaaaatgctgggatttacaggcgtgagccactgtgcctggcctgtttttgtgataggtgatatcacagcatgtctgtatgtggaacggaatggcccaaaagagggagagagggagagagattggggacatcccagaggacagggcccagggagaagaagtccctgagaagggagcacacactgggcgtattgtccaaggggaggcccctacactgaggaggaggtggagcagacacaggcccatgcagggtgcgggaggacgagaggggtccgggcctctcagagcccatcctgtcagacagcagtgccacccagtagctcccccagggctgtggcagcctggacactggcccagagtccagaacatctggcaggcaccatcctgtagtgtaaaatacatcattcttgagcaggtgttttcagagtctgatttaaaaagtaagtctactgttgaagcctttttgtcctctaactcccgtttttggaggtccatcatttagaggacgtgtttataaaaaacagcctatcccacatttaatgtgctggataaggtacagtgagccaattaggtattacagcatgctgtttcttcttttccatttttattttgaaatttcagaaatacctctctcataatgacacttttaaacttaagacttttcctacctgggacagtaccgggctctttttggcagagaacgtgcagtgtttttccattcagtcctattttattgttgacaaaagcaccagggtctgcctgaagccccctggtttggggcagtttgaaagccccaatgaggcctggggacggtgactcaggttcctggccctgtagctgagttggcaacctggacccgacacgctgaccacccggggcctggggctgcccgtggcttccacacttggaggatttcttgtggaaattcagatttgcagctggttatatataactgagctctgctagggttgcggtaagttagtacaggatggtcaggacgtgggggaagaatttacaccaagaatttaagtcaaaaaaccatctggcctcttgtgttaggagagctggattctagttctggctttgcacaaaccaaccagctgaggcccagagggcaggtggcagtcgtatccatggaaaggataatagcagtaacggtcatgacaacctgtgcttctcttgggtctccggatgccaggctcagtgcattagcttatcatcgtcacggaagccccgccaggtggcgctgttctcacttccttcaccgatgaggagaacgaggcgccaagaaggctaaagggagagcccagtgcaggggtggagccaggatttgaacccaggccctaccgtgtgttgagctaaagtgcacttcacaggggcttgctgagtaggtgctgtccctgagcagggcagggaagcctggtcccagctatcatttcctgtgactctcactgccccgtctacccagctggcacccctgccgggctccctgtgggcctgggcaagccgcacatcgctcaccgtggaattcacatgttctggtttgtggtacttcccgtggcaccgtctgttttgctttccctcgtgatgtcaccccggatgcgctgttctgcactcagctccccgagggaccccaggacctcccgccatcaggaggggcccagggagacgcacctgggctgtggccaggctgcagcagcggctgctggaacgcgttgaccctcactgtttgtgtgttttcaggaaggtgcattcgcgctggttttcaagagtgtccactacccaggagaagccgttgccacacggtgaggcaaaacacactggcatttcccataagaaagaacgaaaataaaatcacttagctggagggagacgggagaggtagggcctgtggcacgctgaaaggtgctcgtggtgtctaaagaacaactgtggctcagccccggggaccgcgccccaccatctccatggctggtggtgctacacttctgaattaaaaaaaaaaaaaaagaaaccagaaagttggatttgtgtttgaaatctccacagatttttagaggtgggcaacaaattccagttataaataaaatcgtacagacagggcagatccaggttttgtggggcttgaagcctgtacaatgtgggcccccctttaagaaaaagcaaaattatgaacatgaaactagggagcaaagtgaatattgatttggatccagtacagcagaggccttgaaggcccggggctcaagcttcaccttcacaaaggagcatgccaggaatcggctcagagagcctgcttgccccaatgtgtccctctgttacggtgggcccccagtgctgcatggatttacagaagcaggttaagtgccatcctgtttatattcacataggttgatcatccatccaaccatgcaactaatatttactgtgcacttactgtgtgctgggccctggggacttagtgacatctgacctggtccctgccttgaagggctgaacagttgtacaggagggcagagaagggcagaggatagtgatgccctgtgcccggccccagcacaggatatcaccttacctggcaggggggcaatggcaggtagccccaggcaggcagtgggaagaggaaccagcatgagcaaaggcaaggggcccagagggagtgggacctcccaggatccccgttggcaaggtgggggcatggtgcaagggcattggtgggacggaggcgttctaggcccagtgtgtgtttactgacacctgctgtgtgccaggcatgggagacagtggtgagcaaggtggtatggacactgctccagggcctcaaaggctgtggggagtggagaggcggacagaggccggctctaaatggcctcagtgccctgtgggctgcgggcttcatctgaagccccaggggagccatctggaatgaacctgtggcctgggagacggccggagagggtgaggctgtctcttccagactggcgtagtatctcagcaggaaacaacaggaatttatcatcattttttttaaccttttctaaaactggaactaatttgccatttggaatttaattccttcaattcatagaattataaaataccagttggttcctatcaaatttagaagccctttttaaaatccaattttatcatgatttactattttaaatgaactcagaagaaggcagcgtgaagaagcaataaagctttatttttctaaattgcctataactgagggctctataacctgcagtacaatcttcgggttgtcttgggagaattatatgtctcaaggtctagagaaaccacagagctcaacctacagcaataaaatttgggggagtcatttgccaagaaaattagatatccacctactttctcactgccattattataaactatttatgctagttccccactggccccagaactatgtctcagatttgctttacacaataaatgattaaaatattcaaggtgttcatagcaccttcctcaaagccccagactttgtcccccgctttgagaagccataagtggggtccaaacaggccaacgtgactggaaaacaaggtctgttattgttgaagaaaaatttaggaactgcattgagtcaggctaacagattatggatatatgtggactggattcaagccgatgagcaagcacttcattagttcattgatctaagttagcaagaaatcacctaaggtaaaatgttactggattgtattccaattcatgtgtttgaaacagctctcttaaattgtcttattacagtgttcgtcggtgttttcttcttattaataaattaatgtgtagaggggaaaggcacacatcctttcgtaactactgcacttttacctgcctggttttgaagaaccgcaggtttagagcgcatgtgttaccagagtgagcctcttatttctgtgcacacctatggtagattttatttgcatgctataatttataagaatgagcaaaggattagattttggaatcaggatatcatttaaatcatgagatccttttatttatttatttatttatttatttagagatggagtctcgctttgtcgcccaagctggagtgcagtggcacgatctcggctcattgcaacctccgcctcccgggttcaagtgattctcttgtctcagcctccagagtagctgggattacaggcaccccccaccatgcccagctaatttttgtatttttagtagagacagggttccgccatgttggccaggctggtgtcaaactcctgatctcgtgatctgcgcgcttcagccccgcaaagtgctgggattacaggcgtgagccactgtgcgcccagccaaatcatgagatcttcatcacgtccaccactagaagttgtgaatcagaggaaatatcctaaagctctttcctaaagatcccctgctgaggtgctcagagagccgggctgcagtggctgagacagtgacgctgggacaggaggcctgagtgagggcccctcaccttggccagctgcagactccctgagattttgcctgtgacagttattgtcctctttatgatgaagtctacctggtgcggggtgaagattctaaacttccatccacggggtgtcactttggcagagacaaaaaaccacccaagaaatcaccttatgtcacctacaaagtagagaatatacaaaagtcagtcagactagtgcccactaatgctagagaactgggctaggggaagggaaggaacaacagggggtctttgggcagatggtgggtgcagagccctattgttatagggatgcgctgccgtcgaggctgggtggagacctagagtgcccctgtgccccaccagcgcctcctctgctgccaaacgctcagcctccgccatctaaccttgtgggttggtcacatgtggggacttgactggactggaggaggcccggcctaggagggtgggagtgagacaggttaccaagctttctgggcaggtgggtgatgccaagtcagggacctgggactcaggagctggcctttccatcctgtgctccaggcgtccgtcctgtgggacctaaacaggatcctccaccactgggaaagggctagatttggggatcctacctcagatgctgggcagacacccagcactgggcgtcaaaggcaatgggtaatgggatgcctctttctccctacaggagaggcagccccctgctcatcggagtccggagcaaatacaagctctccacagaacagatccctatcttatacaggacgtgtaagtttctcaagaagtaccggaacagcacagctgctggtgtcgcaggactcggcagctgctctggcacagtcagctcccctctgaggcaaggaaaccccactctgagccagacccaacaggcgcacagctccaggtctaaaaggtttttgtgcaactgagacttggctccattttttttaagctttttatcatggacatgaatttatcatgattttgtatattgtcaaacatacacaaaagtgccattgtataacggcaactgggctttgatgtgagtgcttctttggtttgtttttgtttgcattcctctcacactgtagccatttaaatgcttttgcagtggtactgtgctattgggggatcttttacacgatttggctgacacagccaaagctaaaaattgcaaatttctcccacacatattcagaggggaaattggttccttgctgcatattatgcaaacaaaacatcccagtgggatttgcaacccattcctccatttgctaggcactctggagaatgtgaagaatatctgtaagacacggatgaagaggctggacagctccgcctgcctgcatgctgtgggcgacaaggccgtggaattcttctttgcttctgatgcaaggtaactgagccttcttctcttcgcttcctgggattacataatcaaagaatgcctgtctaaacactgccggttcttattcatccttccatgtgagctatcgtggctcagcaagtcgcagggccaaagaagagttcagccatccctgggcctgggcctggagtccttgtcctaggagcacctgcatgactgtggtaggcagccctggtggccaaaggccagatgcactggtgggcacagtgcttcgagcctgcacaaaatgaatgggttagttgccaatgttgtaaaatttggagatttcacagagaaatctgaaatctctagcttctctggaagaactagcagatcggggcatgctgtgcagccctctctcaggtggcaggtgtctggatctgctcaaaggctgccccctttagatgagacaactgtgtctagacctcagtccctcccatgcccctccctgcctttgcctggggtgagaccatttgtgaaagacagagccaagacacagggagtttttcaattgattctaaagtccatgctctcatcaatccactgaataatgattttgaaatttgagaaattctgctttatactcatttcagaaaaaaaaaaagttatacacacactcacacacacacagagagagagagagggagagagagaaccagagcactttcctgccatttgaagtagaaaactgctgtaatcacctctggtaccttcttcaaagacccaaaggcttgggcctttgttatgtttccattcttgatgggttttctctttcccgaccagcctctaatagggccgtgctgtgaggcagggaggacaccaggccgggtctcctgggaaacgggagcgacagggaggcgaggcctgattaaacgcacagccagcatcatacttaacgctgaggtcaaggcagcgcttcccaaatggtgccccttagaacacgccgagaataccaacgagacgctggtattatttcagtgattctaaaacacggagaattgtagattttggcatagtaccattagaatttgttgaagcttttatttcttagaagtttgtcaaataattgtgatcttaacgatcaatagtaacttatattcaatgaaatatgatagatgtttctttttttatttttatttatttatttattttgtctcactctgtcgcccagactggagtgcagtggtgtgatctcggctcactgcaagctccgcctcctgggttcaagtgattctcctgcctcagcctctgagtagctgggactacaggtgcccgccaccacgcccggctaattttttgtatttttagtagagatggggtttcactgtgttagccaggattgtctccatctcctgacctcatgatccgccctcctcagcctcccaaagtgctgggattacaggtgtgagccaccgcgcccatccagatgtttctttttttttaaaaaaaaggcatgaatgcctgaaaggagaggaaataattatttgtaggcaatactattacacatttttaaatccagccaaaaggctgttagaactgatagtactagcagctgggagtaaaggtgtggaaatcctatatcctggccttagccactaagctgtatctggttcaagtgggaccttgtccaccttattctcaggtgtcacctcacgtgaccaggcacgatgcagtcagcaaacgttaggtgaaccaaaaaagcaatactattcaccacagctggaaaaaaaaatgctttagagtaaattttaacaaaaatactctagaacatatttggagaagtctacagaaatttaccatgaggaagtaagagatttgaatataggaagagattccacattcctcagtaggaaggcttactattcttttctttttttttttttgagacagggtctcattaagttgcccaggctgtcctcgaactaactcctggactcaagggatcctcctgcctcagcttccagagtagctattttcaaaaattaatgcactcaacatttaaaactaatttaatgattacaagttatttttaaaaaatattgactctacccaaattattctgtgaattctgtgctgtaattaagactgtccaggccgggcgtggtggctcacgcctgtcatcccagcactttgggaggccgaggcggacagatcatgagatcaggagatcgagaccatcctggccaacacggtgaaacccggtttctactaaaaatacaaaaaaaaaatcagccgggcgtggtggcggaggcctgtagtcccagctactcgggaggctgaggcaggagaatggcgtgaacccgggaggcggagcttgcagtgagccgagatcgcgccactgcactccagcctgggcaacagagcgagactccgtctcaaaacaaaacaaaacaaaacaaaacaaaacaaaacaaaaccctccatattattttatttgtttatgcctttggaacttcaggaagtgattctgtcgcgtgtagtgtagagataagaaagacaacacatgctgagaaaggaatggcaggtggccctcccagatgtgagcacactgtccagcttttgggcaacggtggccagtgtgtgcggggcacggtatgagagcctcaccaggatcccatgcgataatcatgacagacctctggggaaggcacagctcttttctgtttacagaggcggaacctgagacaggaactccagggggttatgtatgttgcccacgggcacaggtctggcaagtgacagaggccccgagtccacctcaagcctaactggtgggccattggttttaatgactagattacatgactacccattttggaaataaaataattatatttaaacaaacatgtacatgcacacataaatataaacacacatgcgtcatgcattgttggttggttaatgctacaatggaagcagtgttgatctctcggagacaggatagggccgtttttacttcttgtcactccatgtttctactttttatacaaaaaaatatatttctatacaaaattttgtataaagctctgtatacttttatacaaagcatacaaagttatttgtacacttttatacaaagcatacgaagttatttgtacacttttatacaaagcatacgaagttatttgtacacttttatacaaagcatacgaagttatttgtacacttttatacaaagcatacgaagttatttgtatacttttatacaaagttttgtttaaaatattttttccagtacagtggcttgccatctttctttctctttcttccctaggatctggctggatatacgtcttttagagccttagaccttgatggtttctctctttacctttgcaccaggagtttaagtgttcattttcaggcagtcacgtgtgggtgtggctcttgatagaatgagagtgttttttttgagacggagtcttgctctgtcacccaggttagagtgcagtggcacaatctcagcccactgcagcctccgcctcctgggttcaagtgattctcctgcctcccaagtagctgggattacaggtgcccgccaccacacctggctaatttttgtatttttagtagagacggggttttgccatgttggccaggctggtctcaaactcctgacctcaggtgatcttcccgccttggtctcccaaagtgctaggattacaggtgtgagccagggctcccggccgagagtgttttctccagtagtccttcaagcccaacctgatggtttataccacaactatataccattaatcacctttctttttcatttagcaacttttcaaacttaaaatgattttaaaagatactttgtattatgatctcaagggaaaaaaatcattattcttttccatacagagaaagttataaaaataaacacaatgggctgggcacggtggctcacacctgtaatcccagcactttgggaggccgaggcgggcggatcacgaggtcaggagatcgagaccatcctggctaacacggtgaaaccccgtctctcctaaaaatacaaaaaagtagccgggcatggtgtcgggcacctgtagtcccagctactcgggaggctgaggcaggagaatggcgtgaacccgggaggcagagcttgcagtgagtggagatcgcgccactgcactccagcctgggcgacagagcgagactctgtctcaaaataaataaataaataaacacaatgaccctatgtttctttggtaagcatagcttgtagactacttttagggctcctttgtgtatgtgtgtgtgtgtgtaagaaactaggtcttttgtcctgatgagtttcccattgtctgggttttgctgagtgcaacccctggtgtcatttaccatcttcctctgtcccctgtgtttcctgtacgctggagtttacaagtgttaaaagctcgatcttattcaggtttgattttttttggcaagactacatagttggtggtgtgtccttccatcaggaggcgggtgatgtctcaccatctctctttttgtgctaagagccatcaggggtttgagtgttgccagccttatccatccatgataaagcttcgtccagctttttaccttctggtttcaacagccatgaatggtccttgattagagctattaataattaggagttcataaattgattcttctattatttcttcattactagctgtatcacttcttagagaaacttgccttcataaagtatgtggttgttctgaaagacagattgtttagaaaggcgagataaatgctttattctttcccttcacgattcagaataatgtgttggttctcgagtatcttccagaggtgacattgtttggatcctgatttgaagaaaccggttataaaaagacagccgtgagattattggagatatgtaaacatgctgaatatttgatgatataaaggaacaactattcattttagatatgattatggtattatagtaggttaaaatagttttagagctctatggtaaagtgtttacagaagaaatgatataatgtctgggactggcttcaaaataattccgtggggacaggagggaagagtggagaagaaaaggaagattcacctgcaaatcaatgtttttagtgtggtctctctgtccctcctaaaatgccaacgatgtggcctccacgcttgggaaccagcaaggggctgctgcctcgtaactgctcagggcagggcactgatgatgcctgtttcccttgccccagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactgcagcaaatcatgaaaggcaggtgtcctccagagtccacgtgcggcagcctcgggagccagcgcgcctggtggagctcctgacactctgcctggtcctagtagaggccacagccctcctgccctctgtggccaccagggcggggctgcaggtagcctgtggcttgcacaggtgaggggatgtggggaggctggcctggcacctccaagcgggggctcctgtgtgcagccagccgccaggtctttcctactggaactgagcccagtgtgtcagctgccttccttcaccgactccgcgggacacatgcccaccctcaggcatcatttctcctctgggtggaagtctgcaggtctgcagtaaatggggggtgggggtacactttctccctacaaggagagcctctctgtctgcacccatttctgtccccttacaacctctaccccacagggcagcctgagcaaacgtctaagaacatgaatcagcccctgtgatcatcccgctgctcaaggccctccaatggtttcctactgttcttagaataaaatccaaactccctgccacagcccacaaaccccacaccccagtggggccaaagcctggccccaccacactcaaccctctgtcccactgtgccccgccacagcccctgcattcgctgttcttctcataggactggttccttttcattgcctccagctcccttgaaatgtcaccccctcagagactccttctctgctcctgtgtctgccatggtccctccccagcccctcccctatggtggccacccctcattcccctcacttgcttcatttgctcgtcgcacaagtgccaggtcatgggagacaggccgggagcatgggcgatgttggtgtcatgagtgtgcgtatcctagagaacacggcctgccctgcctgtgggtacctccagagcatcaggtgcaggggcttgaacaccctgcagccccattgtcccatcagcaccatccaatcccactcaaatcagagccctggaaatgcctgtgtggctggaaaggtttttttttttttttttttgagacggagtcttgctctgtcgcccaggctggagtgctgtggcgcgatctcggctcactgcaagctccgcctcccgggttcacgccattctcctgcctcagcctcccaagtagctgggactacaggcgcccgccactacgcccggctaattttttgtatttttagtagagacggggtttcactgttttagccgggatggtctcgatctcctgacttcgtgatccgcccgcctcggcctcccaaagtgctgggattacaggcgtgagccactgcgcccggcctggaaaggtttttattacggaaaccaggagggtatttattagaaggaaaattgcctgtttctttgggcctgcttagctgtactttcctagctggatggctttttgggagtgaagcactttactttcttttggccttgctaagggagcatggcccagagggatcagccaggccatttgttacttgcatgccttgggcaaatccctccctttctcaagctgcagggtccaatatgtaaattggagatagtcctggttcctgacctgcttccctctgatggtagtgagtgtcaggcagggtaatccctggggatgcctttgggaatctgcagtaagctttacaggagttactatcgctgctgcataatgaaaagcagtgaaatataatgaaattaaaactgaccagacgtttatttgaccaggtaacttcagtgcgtttatgcagaaggagatcttcgaacagccagaatcagttttcaatactatgagaggtcgggtgaattttgaaaccaacacaggtaattcctacactcggtggggagcctccgcccgagcctagtctcagggaatgcggtgactgtgtagactcagcattaacgccttgtcgtgtgccctgcagtgctcctgggtggcttgaaggaccacttgaaggagattcgacgatgccgacggctcatcgtgattggctgtggaaccagctaccacgctgccgtggctgtaagtgtgacacatgtgcgtggggaagtcgacggcagtctaggaccagacactggccttcagttttatcactcatgtggccttctgaatttggctaagcccttgtacccattcccatgagctagcgtgagaaatgacacggagcccttttatcttcgaggtggcctgtgggtgaccgaagtcccctcgccacctggacagtgaggttccgtgtcacaaactgtccctagaagcccagctgccccatgtccctgtcgtgcctgtgactgactttagtctccatgcttgcttgttggcttcagacgcggcaagttttggaggaactgactgagcttcctgtgatggttgaacttgctagtgattttctggacaggaacacacctgtgttcagggatgacgtttgctttttcatcagccagtcaggtaagggacacaggcattgtggccagccttgcatcaggtcagctctgggctctctcctcttctccttcattcagttaagtcctctgcatggctaccctgtgctgcgaaccctctcttgcagcggtcatttaacccgtagagccatggattactgtcgccattgtacggggagggcaagagatgtctaaggccatgcagtcagggggtgacagctgggattgggctggaaatccacgcacgttagtctttcccctgccccgtggcttctccctcttcttgcctatccaagacttcaaggaccacttaccgaagtgctcataaatgtttgctgatttatgttaatagaaaaagcatctcctttaacattttgttaggttgagagtcacgtggaggacccagtatgggctctgtgcccaagtgtccaagccgagctgcctgtggcatgcagtgcccatgctgcccagcagggggaggtgtgggggagacagtgctcccttttagggccaaggaaggtctcccaagctacatgcaccccatctggtgccatcccaacactgggcttgacatttgctccagctgtctcagggaggtgatccagggccataggcttggagtctccttgagctcgtggaagatttttgaaatgttttaattacggataattccaagcctttataaaagtagaattttcatataatgaatatcctagccttatccagcccatcttgtgccggtcggacacactcatattaacccctcgtctccatggggttactttgaagccaatcccgggcatcatgatattcatccatataaatacttcaggctgcatgattaaaatgacaaaagaaaaacatataaccggccgggcgcggtggctcacgcctgtaatcccagcactttgggaggctgaggtgggcggatcacgaggtcaggagattgaggccatcctggctcacacagtgaaaccccgtctctactaaaaatataaaacaattagccgggcgtggtggcgggcgcctgtagtcccggctactcaggaggctgaggcaggagaatggcgtgaacccgggaggcggagcttgcagtgagctgagatcgcgccactgcactccagcctgggcgacagagcgagactccgtctcaaaaaaaaaaaaaagaaaaagaaaaacgtatgaccacggtgttactaccacaactaaaatactgattgtaatgccctatcatctattaggacttttagtactcctgccattttccattttaaataccatttccattttgttgacaagtgaagaaaaaccagtacagatacaccgaccatccggcccaccaccttatgacgcaggagctgctgccgtgttcacctttgggtttctgatcccaccagagcctcagactattttataaattggtgggagacattaacaaaagaacagaggtggagctaatatgaaaataatgcagtggcagcttccgaatctctgtgtgtatagaagtcagccctttaatgagattgaaaaaacactatcgaaccctagggcgcgggtgacagaagttagaaccccctttcccgcaccctcaccgcagtaccccgtgacactccagtgccataacccagggctctgaagaaagaaaagcagaggagaattgggccacctagcaccgggcggcacctgcctgccctgcaaagctgggacagacacagccaagagcagtggccctgcaaacagaacagcctcccgactcatgaggatttcaacagttttgattttatagtctggcttatgctgaatttaatttgagtgctttaggactcacaaacatagggagcttgtgctggtttatgcatgaagctgtttagctttattctaaaaacaatttgagtccacactgagaggcttgcaagaagtgtcctttcaaacaggatctagctgagaaacaccacttggggacattcctgcttgtcagatgttaaatctgttccatctcagcacgttctgaataaggcagcttattcagttgcagagagggcgctgggagccaagcccacctgtcaccagctgtatggctttgatcagagcaccggtttcctcctgtctctgagccctcatcctcaagaggaaaatggggacgatggtcctcacggggttgtcacgagatttaaatgaaaagatgcttgccacaaatagtaacacaccttgaatgtaagaatcaaccgaaaaggctgttgagcgagcgttttcctttctgaacacccgctggctgtgtctcgggcgccgatttccctgtaagagccggcggtgaaggaggaaggggtttggggtggggccgaggctggcggagcgcggcactgagagggcccctgggcggcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggagatcggcgtggccagcaccaaggtaggaggagccacgggcgcccgtcccagggagagcctggcggaggcaggtgcaccagaggccgccctcctccggcctgctctgcccgcgccaccgcctttctttccccttcccgcctcaccccttctctccgctcctttcctttcccctcccctcttggattcccgtatcttcattttttttatttttatttttattttatttatttattttttttgagacggagtctcactctgtcgcccaggctggagtgcaggggcgcgatctcggctcactgcaagctccgcctcccgggttcacgccattctcctgcctcagcctcccgagtagctgggactacaggcacccgccccacacccggctcattttttgtatttttagtagagacggggtttcaccgtgttagccgggatggtctcgatctcctgacctcgtgatccgcccgcctcggcctcccaaagtgctgggattacaggcgtgagcccccgtgcccggcccccatatcttcatttagtctcattttattcccatgccacgttcctgtgtttcgtccatgttgtcctgtggctctttgagcaccttggagatgcttattttaaagtcctttagggctggcacggggctcccccctggaatcccagcactgtgggaggctgaggcgggagcatcccttgaacccaggagttccagaccgccccgggcaaccccgtcccttcaaaaataaaacttaggccaggtgcggagactcaggcctgtaatcccagcactttgggaggccgaggcagggggatcacctgaggtcaggggtttgagaccatcctggctaacacggtgaaaccccgtctctactaaaaacacaaaaattagtcgggtgtggtggcgggtgcctgtaatcccagctactcgggaggctgaggcaggagaatcgcttgaacctggtaggtggaggttgcagtgagccgagatcgagccactgcactccagcctgggtgacacagcaagactttgtctcaaaaacaaaatagaaataaataaatagataaataaaacctaaaaattaactgggcagggtggtggcacctgtagtcccagttactcgggaggctgaggtgggagaatcacttgaggaggttgaggctgcagtgagccgtgatctcgccactgcactcaggcgtgagcaacagagtagaccctgtctcaaaaataaaagttgatttaaaaagtgaaaataaggtccctgccacctccttctttgtgcacaggcttataccagtcagttcatctctctggtgatgtttggtttgatgatgtctgaagaccgaatttcactacaaaacaggaggcaagagatcatccgtggcttgagatctttacctggtatgttctagaattcagctttccatgttttcagatctagtggactgttgctggccattctctgttgactctcacctgtacaggatgttgttcatttcttcttcctcctaaaacttcctagcttccccaactccctcctggaggccttgctgcctctgacctcatcctgctcggcccccacctccccctgcgctgccgcgctgcctccctgcctccctgcctccctgcctccccgcctccctggtcctcagcctccctgcctccctggtcctcagcctccctgcctccctggtcctcagcctccccgcctccctgcctccctggtcctcagcctccctgcctccctggtcctcagcctccccgcctccctgcctccctgcccctcagcctccccacctccccgcctccctgcctccctgcccctcagcctccccacctccctgcctccctggtcctcagcctccctgcctccctggtcctcagcagtgctcagtgctttctcaccgcagggccttcgcactggctctttactctgctgaaccatcttcttcctgctctgcatacagccgacagcttctcatctcccaaacctcagctcaaatgtcacctcctgagaccctccctggccatgctcacagaggccccgacgccagcactctgtgaaacattagcctgtttatttttttcataacacacctcatgacctgaaattccctgttcacctgttgactggcctgtctcccccaactaacatgtcggctccgtgaacacacagctctgtctgccagagctgccactggacagctggtgtccagcacagggcaggcatacagtaggtgctcagtaagtactcgagaaagagcaaatggccccaggtccttcctatgccaggcgctccttggcagccccaccacactttccccgtttgctgggcagcagcagtcgcagctgtcgtagctggtgagatacaatatctgttgcactaaatcatgacctccttggggaccgtggcctcccctttcttcattcatccaccacatatattaagaaccagtgccgtgccctgtcccatgtgctatccctggcctgccaagataagcagcagctcacctccttcagtcactcacatgccagagtaggagagagacttctgtgcaggcctgagaggcggagatgaatcgagcctcgccccaggctggcatggaacgctcactgcggacaggacatcatggggcttctggggagtgccctcccagagacagagtggacgctggagcttccctgggagccagggccaaaccccagagcaggcagttggggaagggccatcatagagaatggtcaattccaggccctcggggcctgacactggccgagacagcttgctgaaagtttatttctgagaaaagcattcttcctttaagccaggtcataaccatgcaaaacaggacccaattctgacgtctaagtcagtggttctccagatgtggtccacaggtcctgggtgtctgcaaagccctttgaacaaaattgttcacatagtaatacattctttatactaaaaattttttttttttttttttttttttttttttttgcctgtgtccacatttgcaaaggcagtggtggctgtgcccggcacccagcacactagaaggcctactggtcattgtgtccttcaccagcacacacccagtttcccttaagaatggccttgatggccgggcgcggtggctcacgcctgtaatcccagcactttgggaggctgaagtgggcggatcacctgcggtcaggagttcgagaccatcctggtcaacatggtgaaaccccatctctactaaaaacacaaaaagcagctggatgtggtggcaggtgcctgtaatcccagctactcgggaggctgaggcaggaaaatcacttgaacccaggaggcagaggttgcagtgagccaagattctgccactgcactccagcctgggcaacagagtgagactccatctcaaaaaacaaaaaagaatggccttgatggtgaggcgcagtggctcacgcctgtaatctcagtactttgggaggccgaggtgggcagatcgcctgaggtcaggagttcgagaccagcctggccaacatggtgaaaccccatctctactaaaaatacaaaaattagctgggcgtgctagtgggtgcctgtaatcccagctacttgggaggctgaggcaggagaattgcttgaacccaggaggcggagattgcagtgagccgagattgtgccattgtactccagcctgggcgacaagagcgagacttcatctcaaaaagaaaaggctgggcacggtggctcatgcctgtcatcctagcactttgggaggtcgaggcaggcagatcatgaggtcaggagatcgagaccatcctggctaacatggtgaaaccccgtctctactaaaaatacaaaaaattagccgggcgtggtggtgggcacctgtagtcccagctactcggggggctgaggcagaagaatggcgtgaacctgggaggcagagtttgcagtgagccgagatcgcaccactgcactccagcctgggtgacagagtgatactccatctcaaaaaaaaaaaaggaatggccttgatgaggtggtaaaaattattagtctgtaaattgcaactctttgtaatatcctttatgatgaaatggggagtacacgtagcgcctttctactggggccaggcgtggtggctcatgcctgtaatcccagcactttgggaggccaaggcgagcggatcacctgaggtcaggagttcgagaccagcctgaccaacgcagtgaaaccccatctctactaaaaatagctgggtgtggtggtgtgcgcctttaatcccagctacttgggaggctgagtcaggagaatcacttgaacctgggaagcagaggttgcaatgagctgagatcacgccgttgcactccagtctgggcaacaagagcaaaactccgtctggaaaaagagaaaaagcctttctgctctacactgaagtgtgatgcttgtctcaagagaagcagccatcccattgagtagcaagctgattttggtgtttgttagacattttctcaaaatgaaaaatcagctgacgcatcagtagaagcaacccatggtatttgttgccaatgataaactttaagctcccaggcaaaacttttgagtgttagaaaacacctctgttaccatgagcttgaccagttcctaacatttaaagacttctctagggccgggcacggtggctgatgcctgtaatcccagcactttgggaggccgaggtgggtggatcatgaggtcaggagttcaagaccagcctatccaagatggtgaaaccccatctctactaaaaatatttaaaaaatttagctgggtgcagtggcaggcacctgtaatcccagctactcaggaggctgaggcaggagaatcacttgaacccgggtggccgaggttacagtgagccgagatcgtgccactgcaccccaggttgggtgacagagtgagactctgtctcaaaaaaaaaaaaaagtcttctctgatgagatcaaggtgacttcaacaaggtgatttttaaagaacattttataataaaagtgtccattttaagaagatttacatacctttgtggccagttcacgatgtcacagagttatgcacttgtaaatgatccatttaaaagcacaagacagaaaaataaattttaacctaacaaagtagaaaaagtttattgataggatttcagattctatattggcacctaccctttcaagaacctactgtttctcaagtttgatgtactgtggtgtcaaagaacaatattcacaattatttgtaaaataatttaaatactcctcgcttttccaactacaaatctgtatttgtaggctgaattttatttttatacttcaaccaaaagagcttatcaccacagattgaatgtgaaagcagatattagagtcaacagtcttttattaaaaaggcagacactaaaaagatttgcaagaacaaaaagcagtgccattcttctcactaattcttgttggaaatgaagtaatgtaatagatttagtgttgttattttaaagtgaatatttttaaatttctcattgttagtttctttctttctttttcttcttttttttttttcgagatggagtctcgctctgttgcccaggctggagtgccgtggtgccatctcagctcactgcaagctccgcctcccaggttcacgccactctcctgcctcagcctcccgagtagctgggactacaggcgcccgccaccatgcccggctaattttttgtatttttagtagataccaggtctcaccatgttagccaggatggtctcgatctcctgacctcgtgatccgcctgccccagccttccaaagtgctgggattacaggcgtgagccaccgcacccaaccacgcccggctaattttttgtatttttagtagagacggggttttaccatgttagccaggatggtctcgatctcctgacctcatgatccacccgcctcggcctcccaaagtgcggcgattacaggcgtgagccaccacgcctggtcctcagtgttattttctaatctggtaaatgttgacagatttaactcaaaaacaaaggctcttggggatgtgcaataatttgagggacttgcaataattttcaagagtgtaaaggagtcctgagaccaaagggtttgagaaccggtggtcccacttacaggggccttgtcttgagacacagcaggaaagaggggtgttaactggtggtgtcagctctgtctccagtgggtgatttttgcctctctgagcctcagttgtcttacctgcaaaacggagtgagaaatggtacttcctaccttgttggtgctcaagaaagtgttcacacaacacgaatccccatcctaacagaatcctggccaggagcccaagttatttcctgtaatctacgtttgaaacgaatgcgaggaagcaaagtgtgctaagtgatgcggtttcaaaagctcctcttaaaccccagcatttgtcttcatgaatattgctttaaagtcggcctgactggttttctccctctgctccgtgcatggcccagagctgatcaaggaagtgctgtctctggaggagaagatccacgacttggccctggagctctacacgcagagatcgctgctggtgatggggcggggctacaactatgccacctgcctggaaggagccctggtgagcccccacccccagcccccacccccacggaggacaggcacaggagaccctgaggagccagcgggaaggagggcagggcgttgggcttggggagggccgggcctaaggaccccttggccagtcctgtgagcctgcgctgagcaccagctctccaccaggtttctagccctgggcacacagagatgggtgaggcaggtgcctgcccccagggatctcccaatctactgaggagaaagggacagggcgcctggggtgtgcccctccggctgtccaggcactgccagggtccacttggaacagctcactcagacctcatgagctgcttctgagaggttggcggttgctattcaccctcattcaggaggaaacaaagcctctgaaagcttaagtatctcactcaagatgacgtaggggacccgaatcagacctgagtccatggggccttcgcttttttccaccaaaattgaggggtgggttctccgcagagtttccttgttacccctcaaacttccaaggggagtttgagatcctgcaggaattaacttcgaaggccttgctttttcaaaaattggtgacaggccatttgccccctgcagcattaaagatccacgccaggaaagagaaagctgatggggcagggacagggtgccagggccacagggctgcccagagggtgggcagagagccgtgcagggtcctgcatctcggacttgccctttcctcgctgtcagcatgccatgcacggagcagatgctcagcccaggtgacggggacagtgctccagctgaggctgcactggccaccaagacgagggcattaaccgtggcccagctgggctgccatcctctcccatctcctccccaccacccccatttgaaagacaatgctaggctggcacagtggtccacgcctgtaatcccagcactttgggaggccaaggcagtcagatcatttgaggtcaggagttcgagaccagcctggacaacatggtaaaagcccatctctaccaaaaattcaaaaactagctgggcgtggtggtgcacgcctgtaatcccagctacatgggaggctgaggcaggagaatcgcttgaatccaagaggaggaggttgcagtgagccaagatcatgccactgcactccagcctgggagacagaacgagactcccatctcaacgaaaaaaaaaaaaaagaaagaaagaaaaaaaaaagaaagacaatgccagttacaagtggttaccggaaacattcagagttgatttccttggtcttggtggggagtgcagggctgtcctcactgagctccatctcctgcacctgccccctggagattctgactcctgttaaagaacaggcaggtgctgcttcttggagtgcagtagaggcaaggcctggggtgcactgtcagtccccagatgactctgcgtcatgggtgggggctgagctgcggtggctgaacgtgctggcgggagatgcacattgcagctatgcctccgcatgagtctgctgaaggaagaagcgtttaggtggctgctggcacgagcccatggtcctctggtcactgggaggccggcactgcagctgtctgcgcctccagactggagccgcactccttacagtgtggccctgacctaaatcagcagtgctagcggggagtcgagagatgatttatttgactgtctcaccatttcaatgacgtggatttgtggtaactgaatagagatggatctacctgaacacaggaaaaaaattaattcaaataacaccccagtttgtgtgattttgcttggaaccactctttagaagttattaatgggcaaatgcttaatcagataattaactgaaggtgtagctaagctgaatacgatgctgtcgttatacacgtggctggctagggaggagcagggggtgagctaggctgactccgacttgtttgtcctaaggggtggctgtgcgtgggactggagagagacaacagcagtgcccggggctggtgtggggacacagaggttgtgtcccgggctggtgcatgctctggatggtagccaggcctctccccaggcccttgctgggtgtcctcagtgctgtcaagcactccaggcatctgtctgccttgcaacccttggctctctgccttccagagtcatccttcccctggttccccttcttcccctctggctgatctgctccagccccatctgcccagtgtgactctgatctcacctcctgtttccagaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccaggtgagggctctccactggactgggccagctctctcctgcttttccccatgcatgcccacctcaccactgtctgccagtaccagtgatggatggtctggccagtgagtggctgtgaccacacaccctcccccgggccgcctgtggggagtgcacacacttggaaaggagctggtcagcccgcagctgtcccacacagctctttggtggggcccagggacccacactgctgtgagcagcaccagatcctagcctggagctcaggggaggtactcctggtggacatccctggggcagggtttccccaggttctgcggccaagcagctccgatgggaactacctggagttaggtcaggtctcatagggcaggggcacagctttccataagactgccctcgattcaggcacctgttgcaagccaggggtccacccacacatctgagcaactgactatgaatccaaggattcccactctcccctgaagttcagtaattttctagaacgacccatagaactcaggagatgactatatgattacagttttattataaaagatataaatcacagccaacccaaaagaagagacccctagtttgagggccccagatgtgaagcttgtgtcctcaggatgtgtcaccctcccagcacgtcactgtgtgtcgcccgggagctcccctgagctgctagctccagtgtccagagtttgtattgtggttttattaagtaggcaggatggagtgaaccattggccatgtgatcaaactcagtcgccagccccacttttgtccttggaggttgggaggtcagactgacaggctcatgtctcaaagccccaaccttctaatcatgtggctggcctttctagcagggccagacgccatcctggaactatctacaggcccaccacgagtcgtcaccttagcataaagttaggtatagtccaagggacctcccataaataacaaagatgcttttgtcacatgggaaagtccagaagccaggagctcccttcctggaaccggccacaaagaccaaccaaatgctttgtacacagcagctgccctgaggtaggagggcagagttcatgaagtttcggggaggtgaaatccaatgaggtgccccatccagatgttgccacctggctcagcacagaggtcagagtgagggtataaaacacaatggcatcatttccccacttaaaaccctcccatacctgcctgtcaagccacagagacccacagtcctgcgttatctggccctttcctcctgtttcagtgagttccaggcactccagctttccttctgcgtcccactctcattgcgcccgcgcccgcctccgggcctttgcgctggccgctcctgctgtctggaatgcccttcccacagaatgctccgccgagggttgtcccctcatcatttagggttcagtccagatgtctcctgtttttgagagagctttggagacctcaccagtctcccaatgacattatcctgttttctagccttggtggcatttctttggaattcattttttttttttttttgtgacggagtctggctctgtcgcccaggctggagtgcagtggcgccatctcggctcactgcaagctccgcctcccaggttcacgccattctcctgcctcagcctccccagtagctgggactacaggcccccgccaccacacccggctaattttttgtattttttagtagagacagggtttcaccatgttagccaggatggtctcgatctcctgacctcgtgatccacccgcctcagcctcccaaagtgttgggattacaggcgtgagccaccacgcccggcctggaattcatctttatttcttggtttgcttgtctaggtttttgttttctaccactagactatgagccccgctagagttaggagtgagtctgccccgctctcggcaaggcacaaatgggtgccaaatgatgcagcaggatggcaatctccttaccagggaaggggaagaaacccccaaaaagcatcagacactttatcctttccaagcatttgtgtcccacacataccacctcacccatgactccagcaaatgcaaaagaggactgttctcatcacagtaatgtagcttccagatactctgtatgcatcagggatagcttctttcagagagggtctattttatgatgctatttctctgctctagggtcgccccattatactgtgctccaaggacgatactgaaagttccaagtttgcgtataagacaattgagctgccccacactgtggactgcctccagggcatcctgagcgtgattccgctgcagctgctgtccttccacctggctgttctccgaggatatgacgtgcgtctaaaaactgcacctaacagcagagaggagagacataaccccagagttcctttctgttctttaaatacttggagtaaatagtcatagagtaaataattttatttaaagtagctttcttttttttttttttgagattgagtctcgctctgtcgcccaggctggagggcagtggcacaacctcggctcactgcaagctccacctcctgggttcaagcgattctcctgcctcagcctcccgagtagctgggactacaagcacccgccaccatgcctggctaattttttgtattttttgtagagacggggtttcaccgtgttagccaggatgaccttgatctgacctcgtgatccacctgcctcagcctcccaaagtgctgggattacaggtgtgagccaccgcacccggcccagtagaagcgtacttatgaaccattcctacctttccttcccactccaccctaaacaaataagtcccatggaattcatatatattcttgcaagaaaagttaatttttaacagtacacaccaagttacctgtgtttaaaagcatgaaccttattctttaaatcatgttaacagatcatgacacacatcaggtgcacagtaaatgtttattgagggactaaaccttatacggttaaatgaggcttctggactaaggaatctgcctccaagacgcaggtctctaggttggtgaccatggtgaacatctgtctcttgtttttaagtactctgaaaattgtctgtgagaggtagcatgttgctgagatctttggggtcctgaacagtcactttctttcattttaggttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttttttgtgtg

SEQ ID NO: 36706 - DNA, 130613 bp, Homo sapiens
agaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcggtaggtacctaccttcaggtatctttccggaaaagtcctggctggcgtcccccggcagccctcgggcccagcaggctggaatcgcacacaccctgccttccagctctgcctgctgcctggcatatgaaaaccccgggacgccctgcagacccacgagccccaagcccctgagtcccaggcctagtgctcagcggatgggtctccactaccccgggaggggtagcgccatctccatggtttctcttggaagctacagctacgtggacagcagttcaggggaccctgaaagacccaagattcccaagggccagaccagtttcctgctttctctgcagacgctaaaccaagatgagcagaaggaagagagcagggaaggaggccagggtccgcgcggcttgggcacagtgccctggctcagggaccttcctgggagtgaggtgagtatctgaatcgcaccaagcctttcctgacctctgcaggcaagagaaggaggggagcaggcgggaatcttcctgaggggagaggtaaaataggaaggccaggccaaaattgcccccgttacactcccagccgccccccctcccccagtgaacacagcgggtgaccaacttcttgaacgttaccaagctaacaagccagaattggcatttcatgatcatttcgtgtttttctttaatttcaagccatttgaattttcttttgtatgaactgcctgctccctgggcactgcccattttcttttcttttctttttctttttttctttttttttttttttttgagacggagtctcgctctgtcgcccaggctggagtgcagtcgctccatctcggctcaccgcaacctctgcctcccggattcaggcaattctctgcctcagcctcacgagtagattggattacaggcacccgccaccacgcctggctaatttttgttattttagtagagacggggtttcaccatgttggccaggctggtcttgaactcctgacctcgtgatccacccgcctcggccggcactgcccattttctattgaacggtctgtgcaggcttttgtgttaaacctagttcttctccactgtggcatttaaaaaaattcctcatgttgtcttctagtactttaatggcttctactttatcgtatttagaatttgatccagctggacttacttcgtataaagagacaggaaatgttggtgcttctgaaatgtttagtgcagtaagatggtctctcccacaaagtgaccgcttctgtccaggataggttagcagggtcaggcacagaacggagcagagaagggttggatttctcatcccagctgcccttggaaggagagagcttttctggaaattgcagagcgtgccctggagactgcgaaaagtaaaaagtaaggctccctcagcttctttagaccaagcgatgccgagtcttccgcgcgcccagagccggggagcgcaggccacagccaccccacgcggtggcctctcgggcgctcccctccgcctgcaggcagatgtcagccacacctgggctcacgggctgcgcagctgggagggcggcagataaggtgctggcagagcgcctccaggccaggtgggctgctaagaggggcggagctgggcgagaaggggtttcccagcagagcatcccacaaggccgagtggacagcatacattgaaataggatcactaccagcaggaaatggcttcacctcctcagtctgtttgtgtatctctacgcagttaaacactaaaggttttttgttgttttggggggagggttactttttttcgttactgttactactgaagtttaaaaacaaagccaaacaatacagatgtagaaaggaaaaggcctctccccaaaaccgtctaatcccactccatgcaaggaaacactgccctatactaaggtgtctcatctttcattgtgttctcacacagggcttatggggcagtttggggagagggaattacaccgcggggtcagacatacacattgctctgcatctttcttgcttgcttaatacagcaggtaaagccctccagcgcctcatgttcatggctctgtttagaagttccataatagttcagagtatggccatgctgtatttcctttcacggttcttctactgattggcattgaggtaatctctagtttggggtctttataaataacgcttcagcagcacccttgagcatgcgtccttagatatcgatgcttttatttatgtctgttggatataaaagtgggattgcacaaagggcaggggtattttaatagctttcagattacttctgaaatgattggcaatcaacactcaacagcagtatctgagtgcccatttcctcacacccctccaacttagttgcttattgcccttttgtgtttctgatcacctgaaaatacatagagaacttgatttacaagtaaaaagacattttagtgttaggcaactcagagttaaatcaagtagtcaaaaaaagattttacagtatttgaattaacaagcctgatttaatagtgatataggccatgcgtggtggttcacacctgtaatcccagcactttgggaggccgaagcgggcggatcacctgaggtcagaagttcgagaccagcctggccaacatggtgaaaccccgtctctactaaaaatataaaaattagctgggcctggtggtgggcgcctgtaatcccagctacttgggaggctgaggcaggagaatcacttgaatccgggaggcaaaggttgcagtgagccaagatcacaccactgcactccaacctgggcgacagagtgagactccctctcaaaaaaaaaaaaagtgatatatacatatctgtctctatgtgtctgtgtatacacacacatgcacacacatacatggtgcagaagcacatactggaaggcagatattcctggaagtggtccctgtgctcacgttgtgcatgggatggagcaggtgctttgggcctcaggcacacacctggacagcctgcttggtttgttggggtttttttttgtgtgtgtgtctttctgtttgttttttgtttattttgtttgattcagcgtcttgctctgtctcccagactggaatgtggtggcgagatcacggttcactgcagcctggatctcccaggctcaagcaatcctcttgcctcagcctcccaagttgctgagcccccaggcatgcgccaccacacccagataattttttaattttttgtagtgacagagtctcaccttgttgccccagttggagtctgcatgggttttaacaaatagtaagtgagatgatgattataaagtatacagcaaagggccaggcatgaagcgggtgccagataaatgtgagttcgtattcctctttatgtttcattccttactggagaagaggaaggcctagtacactgcgccatcagaccacagacaggagaacagcaggtacatagggaacgggaagggaagcaaagctcagaaaggttccctctgtctggtagaaccctggatggtgctggaatgtgaaactccccttggagaaatgactgcgccatcttgtgggcattcctgggagagcaggctctgatggtgagagtaatttgcaaggaattcagtcagttattcccacttcgtattaaggagcagcagttctcttatcccaatcttttaaaacaaccattcttaatattttgttgtttacttctagatttcttccacagacaagttttatatatgtaacatagctgtgataatatcgtgtatagagatcttaattttctgtgactttacatcctgcagtttctttaaagcttttcaaagtcaagaaatagagaagacttacagaacagcataatacataaatgtgtagacatatattgtcaacagacactggatgacctccaccaggtcatgaaacaccacatcccccaccctgcccccttcctgccacctcccttcctcctccctgccctacccactatgccccatctcatggtgttcacttgcatttcattatcgtgttactactttattactatgggtgtgggggtggcctgttttgaggtttatataaacaaaatcttacacattgctttaaactttactcagtctattttgtgtctgccttcccctgctctaattaagaatcatcctgtggactgggtgcggtggctcacgcctgtaatcctagcactttgggaggcaggggcgggcggatcacgaggtcaggagatctctcatcagcatgttgaattgctccgaatcatcataacacattgtatttctcagtgagctgctgatggacttgggggttgtgcccgtttggggctgctgtgaacatttgggtcaggggcctactgcacgtgcatgtatatttctgtgggttgcattttaggggtgtccttgggggatgcatatctttagtcatactaaatactgtcaaattatttttccaaagtgattgcatcaaattacactctctcattaggagtatcctttgctctctgttctcattcacatttggttgatactgtcagcctttttaattttagccattctgctaggtgtgtagcagtatctcactgtgattttagttttcattttcctgatgtctgaagaggctaaggaacttttgtttttgttttttgagaccaagtccccctctgtcacccaggctggagtgcagtggtgcgatctcagctcactgcaacctctgcctcctgggttcaagcaattctcctgcctcagcctcccaagtagctgggactataggcgcctgccaccacgctcagctgatttttgtatttttaatagagatggggtttcaccatgttggccaggctggtctcaaactcctgaggtcaagtaatccacctgccttggcctcccaaagtgctgggattacaggcatgagccactgcacctggcctaaggaactttttatgtgcttttcaacactctggatacccttgtcaaactaaaataatcaaaaaggtcagaatctagtttaaaaagagtttattcaggccgggcgcagtggctcaagcctgtaatctcagcactttgggaggccgaggcagcaggatcacctgaggttaggggttcgagaccagcctgaccaacatggagaaaccctgtctctactaaaaaccacaaaaattagccgggcatggtggcgcatgcatataatcgcagctagttgggaggctgaggcaggagaatcgcttgaacccaggaggtggaggttgcggcgagccgagattgcaccgttgcactccagcctgggcaacaagagtgaaactctgtctcaaaaaaaaaaaaagagtttattcagcacagaagtcgaggactgcagcctgggacacacttccaagttgccttggagagtgctccagagaacaaaagagaggctcaaattttttaaagaaaaaaaggaggaatcaggagagggagtgagtacaaatgttgtttatcaggaattctcattggtttatggaagtaacaccggttggtgattggctataccttgttgagctataaggtatgtggcattttatgactcctcagagtgagttagtctagagtccgcatagcaagtggctccaagaggtagctatttagctgagggggagtgagatattatgtcttaaatgccttttgggtttgggcctgataatttaaagggctcacattcctcagatttttttttttcactctcttgtgggacatgtctctcctagtctgtcatccatttgttttggggttgtctttctcttactgattcttgatagaattgcattgtgggtaaatgtgccacagatatttcctattttgtgtggcttgtcttttccctctttaatgatatatatatatatatattttgtttgagatggagtcttgctccgtcacccaggctggagtgcagtggcacaatcttggctcagtgcaacttccgcttcccgggttcaagcaattctcctgcctcagcctcccaagtagctgggactacaggcgcgagccacaacacccagctaatttttgtatttttagtagagatgggtttcgccatattggctagggtggtctcgaactcatgagctcaagtgatccacccacctcagcctcccaaagtgctgggattacaggcgtgagccatcgcgcctgggcataatgatatcttttgatgaacagaaattctcaattttaatgttgtcaagtgtatccatcttttctctaccccaaggtcatgaaaagaatcccttaaattaccttcttaaaaactttcacggccttgcttattacatgtaggtctctgagatgcctgtaactggcatttgtgttccattcatctgtttgtccgtccttctgacacagtatcttaatcactgtagctgtacagtaagcattactgaccagtctaccagttcctctcacgtggtcatcaagtcgataaactgagctcgctgagtgccacttgtgggcgggcaatgttctagatgcagcggacactgtactgaataatacagcaggatgtccgtcctcacagcaggacagcatgcagcagtcaataaattagtgagcgagtaagatcatttcagataaaaggaaatgagaaagagagttgagaggtttgacggtggggcacccttggcttggagattttgggtctgacatgtgaaccaagtctcaactgatgaggaagccatagagccctggaaggtccagcctcatatgttagtaatgtggaggaatcccctcagtcttgccatcgccattggtgcctgatgctttagctgcagtctttcttttattcttttcttttctttttttttttttgagacggagtcttgctgtgtcgcccaggctggagtgcagtggcacgatctcggctcactgcaagctccgcctcccgggttcatgccattctcctgcctcagcctcccgagtagctgggactacaggcacccgccaacacactcggctaatttttttgtgcttttagtagatacggggtttcaccgtgttagccaggatggtctcgatctcctgacctcgtgatccacctacctcggcctcccaaagtgctgggattacaggcttgagccaccgctcccggcctagctgcagtcttgataggattgttttcctcacctgtggattgctgtagaatttaaccctcacagtttcacctcccacctgtgagaccgtggcatagttcctttttttttttttgagaccgagtctcacactgtcacgggcagtggcatgatctcggctcactgcaacttccgtctcccgggttcgaattattctcctgcctcagcctcccaagcagctgggattacaggcacccgccaccacacccagctaattttttataattttagtagagacggggtttcactctgttggccaggctggtctcgaactcctgaccttgtgatccgcccagaccgtggagtatttctgcgtgtgtgtatgatgcagaccagcacgaggcagtcctctggtgtgaaaggtgctgtttgcatttagagatttctttcctctgggatttcaggtttgggggcagagagcctttgattccaggggaagcaggctccagcgtctgctgaaggcatgcatacaggatcatgcccctggctggaggggcttaggaaggacaccaagaccgagagagagcaggacagaaatagctgtggctgggcaagaggaatgagaggagactggaaattcaaaactcctgtgagtgttttaatacccactctgacctgacggtgagccttgggttaagaccacactgagacccagtttccttgtctatcaaggattggaccaagtgatttcctaggtctctgctgggtgtaatatccactttatggaatgaatgctggatagctttcctgtctaccagccacagttctaactttggtggcaagattccaacatactgtttctgcttaggagttctaagtgtgtgtgtgtgtgtgtgtgtgtgtgtgtgtgtgtgtgtgtgtgcgtctgagagagagagagagagagaatgaacattttctagcctttaaaatgtttataatctaaaatttgtatggagagatacataccctaaaatagttaaaacaattttgagaaagaaaaatcaagtgaggggaatcaataattgatattaattcatgcttattacataaagtaatcaagaccatgtagtactgggggagggaaaattacatagagtaatgggaaagaagagagaacacagaaatagacccacacaaatatacccaccaatttttaggtgcaaaagcaattcaatggatagtcttttcgagaaacaatgctggagcatttggacatccaaagcaaaaaaagaaaaacttcgacctaaatctcacagtttatttaaaaattaatgcaagaacttcctttagccattatttaagggtagatctgcaggcaataaattctctcattcttcctttctttgagaatgtctcaattttcccttcattactgaagaatattttcactggataaaagattctaagttaatagttattttcttgaaaagtgacacttgaaaagttttatgtcacttccttctggcctccaggtgtctgatgccttttaaaatgtttttctcttataaggaaggtgtctttttaccctctcactgctctcaatattttttatttgtccttagatttcagaagtttgcttatgtttcttcttcatgtggatttctttggatttatactatgtggactttgcacagcttcttaaatctatgggtttatatctttggccaaatttaggaaattctgagcattatttctttaaatactttttcaccccaacccactttgtcctctctcttttggactccagttatctagtgtttgatctttctttgcagtctcacaggtccatgatgctctatttgtttggttttctctctttctttctttctttctttctttctttctttctctttctttctttctttctttctttctttggtctgttttctctctgttgttcagattgtataattctgtctcttccatctacaagttcactgatcctcttatcctctccattctcctgtaagctgatcaactgaacgttttatttcagttactatatttttcaattctataatttccagttagatattctttatatattctatttctttgctaagattttccattttctgagctgttctatttttcatttgtttcatgagtatttgtattgctttttgaagcatttttatgatggctgctttaaaatctttgtttgataattcctgcacctctgtcttctcagtgctggtgtctgttgactctcttttttattcaagttgagattttccctgttcttgttatgattaatgagtttctattttattctggatattttggggagtggagtctttgtatcttatttaaatcttgttttggaaaaccacctctgactccactttggtgtgggaaggtgggcactacctcattatttccaggtttgggtgaaaccctacattcctttattggcctctattgacaccttatgcaaggatgggtgtttcatttactaataggcagggatgagagttaagattttacaacaagcttgcaccgatagcttggtgtaagagttaaagaaagaggaaagaaacacaaaaagtggctcaacagtcaaagacaggtttattttggaaaataaacctgagagggacttctggctgattttttttttttttttttttttttttttggtcaggagcactcttacagactaagagtatgtattggtgagagagcttattacaggcttggaatatttctgttggggggagaagtttatggtggggttggaatgtctctggttggaggggaggttatcttggggctgacatctctctggctgaaggagaggttatcttggggttggcatgtctctggttggggaggggtttggaatgtttctggtcagagacgttatttgtggtttatggtcatgttgatcttagccattaggttgatgccctttagatttaggcagtttttgatcaaggtggactttagaatggcagtgggtgcttgtccaagatggtgatactcctgctctgtcagtgggatcaggaggccttgtgaatgctagctggtggtgaaggtgctggctctctagcaggccttctcctgcattaccccagcaggtcaggggaggaatgcctcactgacaccaggaagaggatggaagactggcctcacacattgtcttcacagacagcatggtggagggcctcactaacactggcaggggaagaaagttcaagctttcccatcagccttctctcacaccacttggctcggggacatatgtgacccatgacaggtgaggttgggagttcttcactcaggctttgctggggtgtgagggagacaggggtgtgttgcatggtttttacctaatgtttggcttgagtagagcatttgtctaaaagttttctgtcttgctaggctggtcctttagctagagaatgcagatttctgttggagcttttctgtctggacctagtgacagctccagcaagactgttcagcatccatataggaagcatgtatgagtggtatatatgcggcaaaagaaaacctagggaactacctggtgttgttccttgtattttatgatccctagctggtctactttcttctcgccaccattcagatgtctttgttttcgtatctttgttttatacataatgtcttaggtttttagcggtgcttagtgaaacaaacaggaagtgtgtctatgccatcttgtccagaattggaagtttcctgttttgttttttcatagcatactgttcttgtttaatgatttcagtgtcttcctttttcttcttcaggttattaattttagttattttgaagttttcttctatcctttacattttctctttcctagtttttttccctatttgtttattttggtcattttagtgtgttgaaggtttttcctaaatgcctagcaatctttgggtgaatttcatatttatttcagagtaagacaccaaatatctgtttagatattatgtgggcatttgtggagctaattggctagtgtgctttcctatcaagtgactttaaaagagaagttgcttattttataagtcaatgtttagaggtctcttctctgaggtgggtcagtttctccagagcggtatcctccagtcatttattgagaagatacaggattataccgggaaagaatgaagcagggtgctgagtcgctccctgttcaccatgcaggttttcttgttatgctgttttcatcccaaacctctccactgctttcaccagttaagtccgtggtccccacaagctggagattcttgttcaattattcaggaccacaagtctctcgtgtttgatcttggctggcagtttgagggaaggagaaatggaaaggggagtatacacagtcacgtggctgactgtgctgggaccttaactgagggtcacacttacaaactttaaaccagaacctctgcctgcttccttccctgtgaactccaagtcatctgcatttctttagatagcttcctgtgctctgcagcaccatctacccctcctacatctactttaccctttccagattttcttgaactttctcatctaccatcgtctcatcatttcttaatgctgctcttttgggaatacaacgaaggacaaaagttcctttagtcaaactcagattatcccaccccaaagtctgctttctggccccctcccctggacacatgaggaccaccaggacagcctgagctaccttgcctctctctattctatctgtctgtctagtacagtaattctcagactagctttgcctcagaattccctggagggcattttagacacaaattgccaaccattccctcagggctcagaaatccatttttcacccattcccaggagtatggtctatctgttgctgcatagcccagaggatccagctgggtgcctctgggcaaggacttgctctgaggcaagtcgcttaagttctctgagtttctaagggagaagaaaccagctgtttctgatccacaaggtacttggggagaaataactagctgaaaatagtttttaaatgtagagcaatatttgggagctcaaataaacacattagatcagtggtttgcaaccttggacatacctggagagctagaaaaagtcttacttcccaggctgtaccccaaaaccattatgtaataattatccagccatccagtttctcttcctccatctctctctctttcactgtaaacatatgcatatgtatacatttttaattttagaatacctcagattaagcagagaatctataattaaatcctaatcttgtagaaaattcttatgcaaaatactgtaatctcccaagtacatctaatcacttccagaataaggaccccctacaatttctaccataaaaataaactctatcgaggagctttatttaaaataagaacttcattttccatgtacttacctacaaaataagcatcatattctgttcagcaagagatatttaagaggcaaaacccaagatccaatattaagtaagcatacccacttttctccaactgatatatcagtaagaaattatagcaaaaacagtctcctgtacaactggagtagagtgttgggtagaacagtcagccgtgtgagtctccagggctgctcttgccaacccttttttctaggagcaatgtatcagcaaaatcttgcctcatcagacccagcctccttagtcctccagtatagatactttttcatttttttttttgagaccgagtctcgctttgttgcccaggatggagtgctgtggcgcaatctcggctcactgcaagctctgcctcccggggttcccgccattctcctgcctcagcctcccgagtagctgggactacagggcccaccaccacacctggctaagttttttgtatttttagtagagacgaggtttcactgtgttagccaggatagtttcaatctcctgacctcgtgatctgcccgcctcggcctcccaacagcatagatacatttttaaggcagacttgaaatacttaaaagaaatttcaccttagtttttagcaaacagtacacacagagtgcttggggatgccattccacagaggttgctgctacaaagtaggtgttcatggggtgggcataggggatcgttagacttggacaacatgtgtgaagaaaagggtttcttctcccagtggcaaattccaaacaacagagatgctggtgatgccaacacaggcctaactattctgctagtgggggcatattttattttgaaatccttaaggtgcctggtgcgtaacggcaaccagggatggtggtggcaatgtgggtgaggtggagtcttgcctgcatttcagtgagcatcagagtcaagctagaagaggtactgggctctggaagagtgcttctgcttcagttttgttcataagggaatgttgtttaaacgggaacttttaccccagttgctggcctttaaaaagtatttctaatgagcatgccaagttcagtaattactttcaaggcctaattctttgatcaaaatagaaggctagattttttaaaaaatactcttgaaagtagacattttaacagagacaagatttgttttgttcctaatcttcacattttccaaaatgactgtgaacaaagtatttcactggactctgtactttgaaaattaaccaaaacatagtgttatacccaaaaggaactaggcagaggaaggacagcgtgttcccagttgatatgtcctttgacctctgacccctgacccgttctctctgctctccagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaaggtaagccactcccggccaggagtcctcagacttggtctggtatccccttctctctgcagctgcctgttgcttcctgagcttttgcctgactctcctgagatgtaacttgtcaccctgggcccccttggattacagcatgctgcctgggccacactcagtactgcagtcgagggcctgcaagagagacactttgagcagtgcattccccagagccacagaagccagggccccctcttccttctctgtagtatgtctctgcctgtggccagctccatgcaaggtagtagtgcagagaagactgccatttaatgagtgcctgctgtgtgcccgacatgattagacactgccctagcattggctctgccactcacagaggcacagaacatttcaataagacaatcttaaccaaattaactaaagtcattatgttgtccattcaattttgtctctaggacactttgacaacatgattttttgcatgaaaccgacagcctactaaaaagtaaattaatggtgtagacatcatgccatttacccaatctctgacaagagtttcttgttttttccctttataaatagcaatatttaatatcaagtgtttgtgaagtacacatctctgagtctcacctcatccttgaagactcactttttaaaactgaggtgaaattcacataatgtagaattaaccatgttaaagtgaagaattcattggcatttagtatattcattcactatattttgcgaccaccacctctgtccagctccaaggcattttcatcacccctaaaggaaaccctattccccatttcccctccccagaccctggaaatactcatctgcttcctgtctctatgggtcttcctattctggatttttcatataaatgtaattacatgatacgtgaccttttgtgactggcgtttttcacttagcgtcgtgttttatccatgtcatagcacatatcaatacttcatttctttgtatggctaagtaacatttcgttatgtgattatacagtacttgtctcactttgttcatccatacatccattcctgagtagctcttcatccatttctgagtagctgggattacaggtgcctgccaccatgcccacctaatttttgtatttttagtaaagatggagtttcaccatgttggccaggctggtctcgaactcctggcctcaagtgatccactggccttggcctcccaaagtgctgggattacaggcatgagccaccgcgcctggcctggaatcctttacatattctgaatgtaagaccattataagatatgtcatttgcaaatattttctcccatctgtagagtgcctttcacttttttgatagtacccattgatgcataagtacttaattttgatgaaatctactttatctatttttttttgttgcttgtgcatttgatgtcatacctaagaatctattgccaaatccaagtaatgaaatttacctctgtttttttctaagagttttatacctttcgcttttaaatttaggtctttgatccattttgatttaatttttgtatggtatgagatagaggtccaattttaatattttccatgcggatatgtagttacccaaacaccatgtgttgaagagactattctgtcccttactgaatggtcttggcatccttgtcaaaaaccaacttacccgccaggcgcaatggctcacatctgtaatcccagcacttggggaagccgaggcggtggatcacttaaggccagaagttcgacgtcagcctggacaacatggtgaaaccctgtttctactaaaaatacaaaaattagccagtgtggtagcacgcacctgtactcccagctactcgggaggttgaggtgggagaatcacttgaacctgggaggcagaggtcacagtgagccaagactgcaccactgcactccagcctgggtgacagagtgagaccctgtctcaaaaaaaaaaaaaaaagtcaaattaccttagatgtgtgggtgtatttttgactctcaattctatcctattaacttatatgtctgtctttatgtcagtaccacattgttttgattatcatagttttataataagttttgaaattggaatgtgagagtcttctttgttctttttcaaaattgttttggctttttgttggaccttgcaatttcatatgaatcttataatttccaattctgcaaaaaaataaaggcccttgggatttccataggattgcattcgatctgtagatcacttgggagagtagtgccatattaataatattaagtcttcaaatccatgaacactgggtgtctttccgtttttgggaggtgttcttgaattgctttcagcagtgttttgtagttttcactgtaaaaagtcttgcacatccttggttaaaatgtttcctaagtattttgttctttttgatgacatcataaatggaaatttttaaaagcttcattttgggattatccattgctagagcataaaaatacaattgatttttgtttattgatcctatatcctgaaacgttgctgaattcatttattagctataataatatttttgtggattctttggaaatttctatgtataagattacatcatttataaaaatagattactttacttcttccattccagtttagatgcctttgatttctcttttatcccttacttgctctgggtagaacttacataacaatgttgagcagaagtggtgaaatggggtgtcgttgtcttcttggttttaggattaaagctttcagtctttcactattgtgtatgatgttagctgtgtgtttttcacaaatgccgttttatcatgttaaggaagttcgtttctatttctagtgtttttatcatgaaagggtgctggattttttaagtgcatgatcaattttgatgacggtttttctgcatcaactgagataatcatgcatgttttctttgacctattaatgtggtatattacattgaatatgtattcatctgcagttttcttttcttgtgatgtttttctctggctttggtatcagagtgattctggtcttatagaatgagttaggaagtgctctctcctcttctattttttgaaagcatttgagaaagattcttctttaaatatcttgtatagttcaccagtgaagctttctggtcctgggcttttctttgttgtggggtttctgattactgattcaattcttttttcttttcttttagtgtcaggttggtgaaaaaacaattctttacttgtcatagacctgttaagagtttatatttcttcttgttttgttttgttttgagatggagtctcactctgttacccaggctagagtgcagcagcatgatcttgactcactgcaacctccacctcctgggttcaggtgattctcctgcttcagcctcctgagtacctgggactccaggcatgcactgccatgcatggttaatttttgtattttttgatagagacagggtttcaccatgttggccaggctggtctcgaactcttgacttcaagtgatctgcccgcctcagcctcccaaagtgctgggataacaggcatgagccactgtacccggccaaagtttgtatttcttattgagtcatttggcttgtgtttttcttaagaatttctccattttatctacattatctaatctgttgatatacaattgtccatagtgttttcttataatccttttaaatttctgtaacatcagtagtaatgcctccactctcatttctaattttagtaatttgtattttctctctttttttcctcagtgtagctaaatgcttatcaattttattagtcttttcatagaatctgtttttggttgtcttgattttctctattatttttcttatttttatcccatttttaattttttatctatttattcatttatttatttatttagagactgagttatgggactggtatttggtatttttggtagaaacagggtttcaccatgttgcccaggctggtctccaactcctgggctcaagtggtttgcccacctcagcctcccaaagtgctgggattacaggcatgagccactgcacctggcctctattgtttttctattactatatttaatgtgtctctactttcatctttattattttcttccatctattagctttggggttagtttgtgcttctttttcttgttaaattagactaaaaatgtaaaattggactattgatttgagaaattcttttttaatttaggcttttacaactagaaagttccctctcagcatagcgttcactgcatccataagcattgataggttgtgtttttgttttcattcatctcacagtattttctaattttgtgatttcttcttttctttcttgtgaaatcttatgatttcttctttgactcactggctgtttaatattgtattaatttccatatatttgtgaattttccattctcctattgacatctagtgtcattacattgcaatcagaaaagatacttcatatgaattcagtcttttaaaatttactggccaggcatggtggccatgcacgtaatcccagcactttgggaggctaaggcaggtagatcacttgaggtcaggagttcgagaccagcctgaccaacctggtgaaacccagtctctactaaaatacaaaatcagctgggcgtggtggtgcatgcctataatcccagctactggggaggctaaggcaggagaattgcttgaaaccgggaggcagaggttgcagtgagccaagatcatgccattgcattccagcctgggcaacgagagtgaaactccacctcaaaaaaaaaaatctactgaaacttgttttctgtaaaagacttatggtcttttctggagaatgttccatgtgtactggagaagaatgtgtattctgttgttgtttggtttagtgttctgtatatgtctgttagttttaattggtttatagtattattcaagacctctatttcctcactgaccttatgtccgtttattattggaagggtgttgaagtctccaactattattgcagaactatttctcacatgatttctgtcgatttttgttgctcagtttgtaggtacgtatgtttgtaattgttatatcttcttgatgaactgactttttaatcaatctataatgtatttctttgtctttatagcagttttcaacttaaaatctattttgtctggtgctggtctagacattccagctctcttttggttattagttgcatgggataatttttccattcatttttgaagtacagttttcccagatatataacttctgctgaaccttttttttctttccctctttttatatgtgtcatcccactgcctctggcctccttggtttctgaggagaaatcagctgttaatcttattcagaatcccttgtacatggtgaattacttctctattgctgatttcaagattcactttttgtctttggctttcagctattttgttccaatgtgtctcagtgtaagtctttatgtttatccatcattgagttcactgagcttcttggatgtgtagattcatgtactttaccaaatttaggaattttccacaattatttcttcagaagtctttctgatcattttctctctttctttcttttttttttcttttttctttttttttttttttttttgagatggagtttcactcttgttgcccaggctggagcacgatggtgcaatcttggctcaccgcaaccaccacctcctaagttcaagcaattctcctgcctcagcctcccaagtagctgggattacaggcatgcaccaccaggcctggctaattttttttctatttttagtagagatggggtttctccatgttggtcaggctggtcttgaacttctgacctcaggtgatcttcccccctcggcctcccaaagtgctgggattacaggtgtgagccactgtgtctgggctttctctctttcttttgagattccattataggtatgttggtgtgcttgatggtgccctaggttctgttaattttcttcatgcttctcaggttctgttaattttctccatgctgctttccttcatattggaaaatctcaattggccatcttcaaatccactgattcttttttctgcctactcagacatgttacattgaattttaattattgtacttttcaactccagaacttttacctgtttttttaatactttctctttattggtattccatttgatgagacatcattcttttggttcctttagtggtttttgtttcacttagctctttaagcatatttaaaacagttgattagagtctttgtctagtaagaagaccctgtgctttctcagggatggttcttgttcatttcttttctttccctgagtgggccatactttcttgtgtctttgtatcataattttttttttttttttgagacagaatgtcgctctgtcacccagacgggagtgcagtggtgcgatctcggctcactgcaagctctgcctcccgggttcacaccattctcctgcctcagcctcacaagttgctgggactacaggcactcgccaccatgcccggctaattttttgtatttttagtagagatggggtttcaccgtgttagccaggatggtctcgatctcctgacctcgtgatctggccgcctcggcctcccaaagtgctgggattacaggcataagccactgcacccggcctttgtatcataattttttgttgaaaactgggcatcttgaatattataatgtggcaacaaagtggctgcatgtatgttgctgacagtattccgtggcctggacctacaacaacttgtttaatcattcacctattcgaagacatctagattgtttccaggtttgggctattataaataatatgtttaataacatatgttttcatttctctagggtaaatgcccaagagtacaattgttgggtcatatgatagttgtctgtttagtttgataagaatcttccacattattttcgagagggctgtaccattttacattcccaccagtaatgtttgcatgatccagcttctcagcattcttatcagcatttgtttttttgctacttttaaatttttaccataatagtaatagtggtgtagtgataactcattttggaaatggttgggttctaaggcgccataatgtagaaaatattttcgtgtgcatatttgccattggtacaacagtttaggtgaaatgtcttttctgttcttttatccactttctaactggatagccttttcattctctcccctcaaacaattgagaggtaaggcaaggcatttttttaatgttggtctttgagagacagagtgtatatgtgtctgtgtattatatatattcatattccagatattagtcctttgttgaatttgtggtttacaaacattatcacctagtctgtagcttgttttttcatcttcttaccagggtcttcacagaacaaatttttaaatgttgttgaagtctacttaatcaatttttttcgtttatggatgtgcttttggcatcatgtctaaaaactcttcagtgacccctaagtctcaaagattttcttctgttttttctaaagtttcatcattgtacttttcacatttaagtttgtgattgatttccagttaattttttgactttcattttaggttcaggggtacatgggcaggtttgttatataggtaaattgcgtgttgcaagggtttggtgtacagattttgtcaccaaggtaataagtatagtactggatgggtagtttttcagtcctcaccctcctcctgccctccaccctcaagtaggcctcagaatctgttgttgtcttctttgtgtccatatgtactcaatgtttagctcccacttatgagtgagaacatgtggtatttggttgtctgttcctgtgtcagtttccctaggataatggcctccagttgcaaccatgttgctgcaaaaggaaatgatctcattctttcttatggctgcataagttgtgggatttaggtgaagtttcttttcttcttttctttttttctttttttgcctgtggatactgttggaccacttgttgaaaagagttattattcctcactgaatcacttttgcacctttgccagaaatcagttggatatacttatgcctgtttctaggctctctgtttggtactgtcgatccatgtgtctatgcttccaccagtgccacactgtcttgatcttcaaagctatgtactgagccttcatgttgattagatggagtccttccactatatttcttttttttcaacattgttttacacgttccatggctagttccttccaataataaatatgaaaataagtttgtcttgtctacaaatgctttgctgagaatctgatgagactgcagaaaacctataaattaatttatgggaaacagtcatcttcattatgttttgtctcccaacacaagaatacaggtatatcttttcatttatttaggttttctttaacttcttttgtcagaattttgtaattttctgcatacagatcctctgcatttttaaaatgtatacttttgtatttaattttcctaggaactattacaaatattgtgttttaaatttcattttccacaagttgatttttagtatatggaaatgcgattgatttttatgtgttgatattgtatcctgtgactctgctgaattcatttgttagttcaaatgtagttgttttttatagattactggaaactatctatgtaagcaaccatatcaccttaaaatggggggcagggggtatttcttcctttctagtgtgtattctttttatttcttttcttccagcctctgcctactgcccaattccaaagtcacttccaaatttgtaggtgtttgttatagctgtatcccacttccaggtactaagatttgtatagtaattatacaacaatacaggtgctacagtgatatcaacaaaatactgttaacagagaggaggaggtgggtaattctgtgtagatggaacataaggaaatattttgcataaaaggagacactttcctaagaatggataaagtttcagcagggaagcgtagttcaaatagaggggatagcaacatcactgcaacctctgcctcccaggttcgcgacattctcctgcctcagcctcccgaatagctgggactacaggtgcctgccaccatgcccgactaattttttgtatttttagtagagacgggatttcaccatgttagccaggatggtctcgatctcctgacctcggatggtagtatgaaaattcatggagtaggccgggcgcggtggctcacgcttgtaatcccagcactttgggaggccgaggcgggtggatcacgaggtcaggagatcgagaccacggtgaaaccccgtctctactaaaaataaaaaaaaaaattagccgggcgtggtggcgggcgcctgtagtcccagctactcggagaggctgaggcaggagaatggcatgaacccgggaggcagagcttgcagtgagccgagactgcgccactgcactctagcctgggtgacagagcgagactccgtctcaaaaaaaaaaaaaaaaagaaaaaaaaaaagaaaattcatggagtatcagggaagtagtgagcaggtgcctggtggtagagagatggatggcaagagttgttacagtagtcagaaaacagtattcgaggaactctgggttccatgccaatagatctttactttattctataagcaggaggcagccttttatgatttttaacataaaaatggcatgataaatttgctgtagaacaagaagggaagacttagagaatgtttaagtaacccatatgagaaatgacctgagaaaacgttttgtcaaacggatattcagttggcccttaaaccatgcaggggttaggggtaccaaccacccacacagccgaaaatccatttataattttttttttttttgagatggagtcttgctctgttccccaggctggagtgcagtggcgtgatctcagcccacttcaacctccacctcctgggttcaagcaattctgcctcagcctcccgagtagctaggattacgggtgcatgccaccacgcctggctaatttttgtatttttagtagagacaggattttaccatgttcgccaggctggtctcaaactcctgagctcaggtgatctgcctgcctcggcctccaaaagttctaggattacaggtgtgagccaccatactcagctccatgtataatttttgtctcctgaaaaatttaactattaatagcctactgttgaccagaagccttgttgataatataaacagtctaacacttattttgtatgttgtaagatattataagtagtatatatagtattgttgcaataaagtaagccagagaaagagaaaatgttaagaaaatcagagggaagagaaaatatatttactatttactcactggaagcgggttgtcataaaggtcttcatcctcatcatcttcacattccataggctaaggaggaggaaggagaggagcagttggtcttgtctcagaagtggcagaagtggaagaaaatccatgtataagtaaacccgtgcagttcaaacccatgttgttcaagagtcaactgtagtcacaagcttaagtgactatttaaaaaaataaaatgtaatgtggcctgcatgaatatgtgtacagggtccagtttccctttaagcaggattaaagtagattttgagaggattccaagcctaagattctttgattgtaaaaggtttggaggcctagagataattcctgataatttaatagaaaatagagattatatactagttgagtatatttgactagttgagtcaaatatggtttggtagttttttttttcttttttctttttttttttttttgagacggagtcttgctttgtcactcaggctggagtgcagtggtgtgataccagctcattgcaacctcctcctcccgggttcatgccattctcctgcctcagcctcctgagtagctgggactacaggaacccgccaccacgcccggctaattttttgtatttttagtagagacagggtttcaccgtgttagccaggatggtctcgatctcctgacctcgtgatccacccacctcagcctcccaaagtgctgggattacaggcatgagccaccacgcctggctggtttggtagtttctactagtttcaactactcagatatacataaatcatatttttgtgtaaacacaaaaagatcaactgcaggtataattctgaaaaaagtatgaaaagaagcaagtaataatatggtgtaacatacaagggttagaacagcaggaataataacgcatacgttgagtgaatcagagcactagatcactgttttcaaagcagtcactggaactatggtgcagtttttattttggaagtgtgttaatttctaaatagattaggatttcgtttttaagaaaaataatagaattacctttctattactgatttatagtttaattccattgtgatagagaaacatactttgtatgatttcatactttcaaacttttttaaaatttcattattatgattatcaccaaggatatagcctctcttggtgaatgttccatgtgcacttgaaaataatgggtattctgctattgttggatggctattctacaaatgtcaattagttccagttggttgatggtgttgctcactttgtctattaccttgtttttgtttattaccttgtttttgtctatttcttctattgattactgtgataaaagtgctgaagtttccaatcagaaatgaatcattgcaaattttccatttttcctttaaatttttgcttcatatattttgaatgtctgtggttagatgcatggacatctaggattatatgtctttttggtgaattcactcttatgatgttatgttcttctgtgtccttggtaattttccttgctctgaaattggttttgtctgatattaatatagccattcacattttctttttgattagtacttgtgtggcatcgtttttcacccttttactttctacctgcctttatcattattttgaaagtaggtttcttgtagataacatattgttagatgttctttccttaattattttaatatttgtttttctgattatgtgctttgagtattcaaacttaatgtatttattgatggtttggatttaggtttaccatgttatcattcattttctgttctctgatttgcattgctctgtttccttttggattatttgggtattttttagttctccattttaacttagttattgagcttttaaatatatttctttgtataggtttttttagtaactctaggaattaacatacattcttaacatttccgtctagttagaattagtattttcccacttcgagtggaaggaatgtagacatcttccatcccataggttcctttaacctcctcctttatgttgttgttgtcatgtatattaaatctgcatacattgaaaactgcattagataatattataattttgtgtttaactgtcaaatattttttaaaacttaagaggagaaaaatggtgtgttatatttacccagctatttattatttctgttgctcttccttcatttctgaagttcaaagtttccctctggtatcattttccttttgtataaagatcttcctttaacattgctttagaataggtatactggctatgacttctcttagtttttctccatgtgataatgttcttattttaccttcattcctgaacatacttttgctggatatagatttttgggttgacagtgatttagcactttacaaatattattccacttctttctggcctccatgaaaaatctgcagtcatgcaaatgaatgttcccctctgtgtgatctgttgtggtttctggctgctttaagatttttttcattgtctctaattttcagcagtttatgatgtctctaggcattgatttccttggatttttcagcttgcagtttgctgggctcttgtgtctgtaagttaatgttttgaatcatatttgggatgttttcagaaattattcttgatattgttctgcactgcactcccttctccttctggaactctgattgacagagtattagacctttgttgttgtcacacaggtccctaaagttctattgggattttttccccccaaccttttctctctgttcttcaattggataatttctgttgagctgtttacatgcttactgattctttcctttttcatctcattttataattgtactctgccactggattttattttagttattttatatttttcattactaacatctccactttattttttatctatttatctgctattatttttcatttatgtcaaaagtgttcacccttacttcttagagcatggtgatataagagctgctttaaagtctttttctgataattccaacaactgtgtcttcttggtgttgccattgttgactatcttttcccttaaaagttattgagatctcatagttctttgtgtgtcaggtaattttcgattgtattctgggcatcttaaatgttatgttatgagactctgggccttgtttagttcctatggataataatgattattaaattttttaagcagttgacccagttaagttcaggctgcaagctcttactggccttcaggggctgtttcttatgtcagtttgtcagttcaggttttaagatgtttgcagtgccacttggataatgtggatcacccagtggcccctgtgggacctgaaatatgttctaccccatggttcagttcccaaaagactcttatatgctgttcagggtcagatccactcatacagcttgggggtaagtgcgggaactcatacacaacattatgggatcttctgcttgagacccctcctcttggcattctcccaggcacttcctggtgtctaggagccctcctttcctagttttcttgatggaaagctggggctttcattttccctctgccatacacttcctgcaactgtgtctgcctctgaaaccaagtggcagggagacagagatagaaaaaagaaacaaggattctctcccatgcccttgggaccacagttcctctggtcagagaggattcctgtccctcagaattttagatgtctgcacgaccaccactgccattaccataatgaggttgcctaggggaatagggtgggagaaatcatcactcaaatacacatccctcattccctcatacccttaaggacccttttccctctcttcagatctgagagggcttcttttggagtcctttatgtccatgcccagtttcaagctggtattgagttcagaccagggcacaccacaggaacaacaaaacaagaaactcaccacaggatcagtgttacttcgaattctggtttccttccccagtctacctgctgctgtttccctctagagtcctcaaacggctgatctatacactctccccaaggtttttagttgtgttcaaatggatggggtgaagtgtgcaactccgtctttatcattgtttgtatattgatgtttctggaaatcactaaaagaattttctaagcactgtttgcttaatagtatgaggaataaaaaagcaaaaagtaagggaagaagcatttatttgaatacataccacaatttttaagttaatacaataacttcataaggtagaaaaaaatcaagaggggccaggtttatctctggacaatgggatgatacagaaaaggcttatatccctggtcatcccaaagccacagccaacagtggtccttactgtctgaagggcagtgtctgcttcataattaggagatgtcacggatttcgtgagttgtgttttaatgaagcattccaaaaagactatgccttagctaaaactaatagtcttgctttcggggagatatcaggctgtgtggctcaccagcttggggagagttgggagtctgaagaccttctccacagtcctgacttcatccatggaatgacagcctatccatgtggccagataggttgcccactgcagactccaggtgaagtttttcttgtgagttttgatgtgaaaggcatcccctggagctgtgcatattttggttgtgtgctctgttcacaatgaaaagtcctcagcaattagaaagactgcagggtggcaatgacagcctgtcatttcttttcttcatttgccctctgtctctttcctcctcttccagtgctggagaaagacgatcattacctctccagagtctttgaatctccctagaagaagccatccactctcccagagtgctccaacgggactgaaccacatgggctggccagagcacacaccaggcactggtgagttacgcgcctctctcttttgctatgtactctggatcctggcatgaaggacaagaagctagtgctgttggcagctgtatccacttgcctggtagaagtagcttgaaggtgagagagataaacaattgtcctcttccttcagttagggaggagtgcctactacccaaagaaagggaattattggctgggcacagtggctcatgcctgtaatcccagcactttgagaggctgaagcaggcggatcacttgaggtcaggagctcaagaccagcctgggcaacatggtgaaaccccatctctactaaaaatacaggccgggtgcggtggctcatgctataatcccagcactttgggaggccaaggtgggcggatcatatgaggtcgggagttcgagaccagcctgaccagcatggagaaaccccatctctactaaaaatacaaaattagctgggcatggtggcacatgcctgtaatctcagctactcgggaggctgaggcaggagaattgcttgaacctgggagtcagaggttgcggtgagccaagatcacgccattgcactccagcctgggcaataagagcaaaactccgtctcaaaaaaaaaaaaaattatctccatatggtggtgcatgcctgtaatctcagctactcagagggatgaggcaggagaatcacttgaatctgagaggcagaggttgtagtgagctgagattgtgccactgcattccaccctgggcgacagagtgatactccgtctcaagaaaaaataaaaaaaggaattcctagagtcccccagcttggctccattagttaattttgagcagaactactgactgtcccttcgtctcgtagtaggatgtataacttccaggagacagaatcatgtagggagctgtctctaatcagctgatggaacttgggtgttttccgttctgaggaataatggcctcttccttgagttttatggcagcctgtatgagtcctttctccaaactatagcaaatagcatcacatcacatatctgtccataaaaggcctggctttctgtgttagaagggaattgggccgcaggtgagagccaggatggggcctctttatgtagaacaaccaccttcctcacacccaacccagcagggctggacacgctaagtgaggctcaaggcagatctgtcttctggtggaaggacagatgtggggtctcaggtcttgagcaggtgcagattgtgttaggtggtgaccttacagtctaaaagctcatggctgctggagggaggggccaaatctggtgttgaagaaagatgaacaagggtaaagccctaagagttagaaaaacaaaacagccacacctgtcaaatgcgtgctttgtccaggcttgggaggagcgagctggcagtggaggctgttggtagtcaggtcctgtcggtgccgaagacccatagaaagccagtgtggtgaggcagaggatgacggtgcatgatggttggccctgaatgctggagtttggcatgtgccttgctaaggaatcagctctgatgcagactctgagttgagctctgaatctgactcagcacattcgaggtgctggtcctgagggagctggctgctcagattagctggtggatgtggtggttgtccatcagcagatggatgtatttaggctgcactgtgaagtggagttttattctttcccacataaagttgtgatcttaaactcacaagcaaagttatgaaaaggtgtttgacaagtgttgaagaaactttcccaatttcttgcatgagcccttcattaagtcatagagttatttagagtcttgtggaagggacagtaaccagggagaggaatctttccagagagaatcctcaaagctgattttggcctttcaagtcagtacctccttacaattcagagcttcataatcatattttcctattatttcagtgtcacttgaaataattggcagatgagttcattgcagaggaaattttaaaaccttcatgccaccagtgacatccagcatgtatgcataccaagggcaatgctctggaagtcagaggtcagggctctagccacacttcaccctagggtgagaaattgggcacatccctccatttccctatatgtcaggttccttttttctttttttctcagaaattctgcaagaaagtaatcagattcctttttcttcaaaaaaggagtgaaagctcctgttttcctattttgtaaggataatgggagagactagcctggactatcctggagtttagcttaggaaagctttcttttcttttcttaattactgcttccacttccaactgatctgttcctgactttgtagaatttctactttgtagagattatatttctagtttctatccctggaatctgtcatcattctcatttgaattctcattcaaatttgatccattttctgcccagttctgggagaatttctgtttcatcttctgctttgttttcctgttttgttttgtttttttctcacctgtgttcactgccttcactggcagtttgtgatgcagtgatcatgtttttaatctgcaacaatctttccaatgtccttttgaagccattaagaacagaaaattgggatttttgtaaaattttcttgttatttccaaatttcagttcatttccaaattcatctgctcttctttcgaggttttctgtttgtttgtttgttttttatttactttattttatttatttatttattttttgagacggagtctcgctctgtcacccaagctggagtgcagtggtgcgatctcggctcactgcaaactccacctcctgggttcacgccattctcctgcctcagcctcccaagtagctgggactacaggggcccgccaccacgcctggctaattttttctattttttagtagagacagggtttcactgtgatagccagggtggtctcgatctcctgacctcgtgatccgcctgtcttggcctcccaaagtgctgggattacaggcatgagccaccatgcccggcctgtttgtttttcgatggggtctcgctctgtcgcccaggctgcagtgcagtggtgcgatcgatctcggctcactgcagcctccacttcctgggttcaagcaattctcctgcctcagcccccaagtagctggggttacaggtccccaccaccatgcccagctaattgttgtatttttagtagagacagggttttgccatgttggccaggctggtctcgaactcctgacctcaggtgatctgtttgcctcagtttcccaaagtgctggaattacaggcgtgagccaccacacatggcctcttttgaggctttttattaataggtgaaatttctttatttgctcgtctgtgaggacagcagtcttcccccagcagtggtgtgttgttaagtagcactggaagtgacgttctttcagagattgttatgggttcctgttaacatccttcaaacacagctgaaggaggatgaggaaggcaaggctttcttgtgatgaatgccatgagtcagcgcctagaggcttgtggggagctgtcagtagtcctggcagggagctcctccccctcactagaatttcttctccacgtttggaagggtggccaagaatcagcctgatgtgggagcaggccacctctccctggcaaatcggtgtccaagataaacccccaccacacccgcccctctctcagtggagctggcagggccaggtacatctctgagagtccctgatgcctccagagttcgtgcctgtggctttggaagggttggctgggttttaccaggactacctggtagtatggttatttcacaagctgtaggtcacctctttcttcaaaccactttgttgtatcttgtggctaacacccttcatcagtctctagttactagtaaaggatgctttctattttttaaacagctttgttgagctatagtcatatacagttcggtggcaggatattcacagatacgtgcggtcatcaccagtccattttagaacattgtcagcacctcataagaagctctgtacctttagctattaccccccaccaccacccgaaggaaccacttatctacttcctgtctctgtaaattccctaccctggatttgcctatggatggaatcatgtaggaactggttttgtgactggcttctctcacttataataatgttttcaaggttcttccacatgtcacatgtacttcagtacttcatttctttctttggccaaataatattccattgtatggatacaccacagtttgcttatttattcatccactgatgagcaattggattacttctactaccttgcacttcagtgctagggagatggcttctgtccttaaatctcaggaaccaacctctgctaggtttagacttttcttttacagcttcctcacttctctcagccttcatacaattggaaaaagttaaggccttgctctggattaggccttagcttaaaggagtgttgtggctgatttgatcttctatctagaccactaaaactttcttcctattgcaatcaggctgtttcactttcttattcatgtgctaactggagtagcacttttcatttcctacaagaactgctccttcactttcagaacttggctgtttggcttgagaggcctagcttctgggccatcttggctttgacatgccttccttactaagctgaatcatttctagcttttgatttaaagttagagatatgtgactcttcctttcacttgaaaacttaaaggccattactgggttattaattggcctaatttccatattgtgtctcatgaatagggaagcccaaggagagggagagagacagaggaatggatggtcggtggagcagttggaacacacaacatttattgattaaatttgccatcttctatgggcacagttcatggcatgtcttcacttcttgttttccctgtctcatctttttattgttctattccttctttactgttttctttttcactgagtgaatattttctaatgtagtattttaattttattaatgattctttcactgtattttttgagatttgtttttaatggtagctttagcgtttcatgtatatatatataacttaccagcatcaacttcagatttatactagcttaattccagtaatatatagaactattactcctttatagctctattcccttccccctttttgtgtggtatgattgttatgcatattatacttatcaatgttataaagccagcagcacattagtaaaatgattactctaccatgtgtcaccattttcttagcctattacagcttttctctcatctacctcctttatgctgttattgacatatattacatttctatattatatgctcaataatacattatatacattattttatacagttgcatgttaagagaagaaaggagaaaataagaatagtgttttttataattacatcattaccttttctagtactctttttgtattcatgtggatttacattatcatctggggtcacttgctttcagtctaaagaatgccctttagtatttcttataagttaggtctactagcaacaaattttctcagttttgtttatctgggaaaatccttatttagtcttcatttttgaaaggttagctttctgcataaaggattcttagttgccaagatttcttttttaaaaaaaatctttttagcaggcctttgacagaattcaacagcccttcatgctaaaaactctcaataaactaggtattgatggaacgtatcacaaaataataagagctatttatgacaaacccacagccaatatcatactgaatgggcaaaaactggaagcattccctttgacaactggcacaagatagggatgccctatctcgccactcctattcaacatagtgttggaagttctggccagggcaatcaggcaagagaaagcaataaaggatattcagttaagaaaagagaaagtcaaattgtccctgtttgcaaatgacatgattgtatatttagaaaaccccatcgtttcagcccaaaatctccttaagctgataagcaacttcagcaaagtctcagggtacaaaatcaatgtgcaaaaatcacaagcattcctatacactaataacagacagccaaatcatgagtgaactcccattcacaattgttacaaagagaataaaatacctaggaatccaacttacaagggatgtgaaggacctcttcaaggagaactacaaaccactgctcaatgaaataaaagaggatacaaacaaatggaagaacattccatgctcatggataggaagaatcaatatcatgaaaatggccatactgcccaagataatttatagattcaatgccatccccatcaagctaccaatgactttcttcacagaattggaaaaaattactttaaagttcatatggaatcaaaaaaaaagcccgcattgccaagacaatcctaagcaaaaagaacaaaactggaggcatcatgctacctgacttcaaagtatactacaagtctacagtaaccaaaacagcatggtactggtaccaaaacagagatatagaccaatggaacagaacagaggcctcagaaataacaccacacatctacaaccatctgatctttgacaaacctgacaaaaacaagaaatggggaaaggattccctatttaataaatggtgttgggaaaactggctagccatatgtagaaagctgaaactggatcctttccttgcaccttatacaataattaattcaaggtggattaaaacttaaatgttagacctaaaatcgtaaaagccctagaagaaaacctaagcaataccattcaggacataggcatgggcgaggacttcatgactaaaacaccaaaagtaatggcaacaaaagccaaaatagacaaatgggatctaattaaactaaagagcttctgcacagcaaaagaaactaccattagagtgaacagacaacctacagaatgggagaaaatttttgcaatctacccatctgacaaagggctaacatccagaatctgcaaagaacttaaacaaatttacaagaaaaaaacaaccctgtcaaaaagtgggcaaaggatatgaacagacacttctcaaaagaagacatttatgcagccaacagacacatgaaaaaatgttcatcatcactggtcatcagagaaatgcaaatcaaaaccacaatgagataccatctcacaccagttagaatggcaatcattaaaaagtcaggaaacaacaggtgttggagagaatgtggagaaataggaatgctcttacactgttggtgggagtgtaaactagttcaaccattgtggaagacagtgtgacgattcctcaaggatctagaactagaaataccatttgacccagccatcccattactgggtatgtacccaaaggattataaatcatgctgctataaagacacgtgcacatgtatgtttattgcagcactgttcacaatagcaaagacttggaaccgacccaaatgtctgtcagtaatagactggattaagaaaatgtggcatatatacaccgtggaatactatggagccataaaaaaggatgagttcctgtcctttgcagggtcatggatgaagctggaaaccatcattctgagcaaactatcacaagaacagaaaaccaaacactgcatgttctcactcataggtgggaagtgaacaatgagaacacttggacacagggcggggaacatcacacagggaggcttgccatggggtggcagggggagggatagcattaggagaaatacctaatgtaaatgatgagttaatgggtgcagcacaccaatgtggcacatgtatacatatgtaacaaacctgcacgttgtgcacatgtaccttagaacttaaagtataattaaaaaaataataacaaatattaaaaaatccttttagcacatttaacacactatcccactgtcttctggcttctggagtttctgctaagaaatcaattgttaatcatattgaagaaggcttgatgagttatatgttgtttgctgctattctcttttaggatattcccccttgtcttttactttcagcatttttactatgatgtgtctgtctgtggatctctggaattattttacttggaaataactgagtttcctgggtgtgtaggttattgtttttcaataaatttggaaagttttcagccattatttctttgaatattttccccttcccctttttctctctctttctgatattcccattacacatatgttggtgcacttaatagtgtcctacacttctctgaggctttgttcatttttttttcatggttttccctttgttctttggcttatgtaatttctattgatctatcttcaagtttgctaattatttcttccatctattcaaaccagctgttgagcccttctagtgaactttttatttcagttattgtacttttcaactccagaatttccttttttaaaagatttgaatgcgttcattgatattctctgtttggtgagacactgtcatcacatcttttgtcttttaatcatgtttcctttagttctgtgaacatgtttataattactaccttggacttgataaatctgatatgtagtcattctcacaggcagtttctattgccagcttttttccccattgtatgggtcaaactttcctgttcctttgcatatgtcataatttttggttggaaactgggcattttagataatattatagccactctgagaaccgctcccccactagatttgctattattatttgcttatttattaactacatgaactgttttattttagtgaagtctatttcccttcccgtggggttaagcttctgatgttgctcctaaaggagatacagcactgggtatgcccacagtcacccatggatggcagtggctttactagggctctcttctatatttctctgaccacaccacactgttaagctccactcattggttgctgattgctctgttattttcaatattgtcctggggcataaattgctttacaagctatcaaatgctggcacacctcagaaaggatcactttctgaggtcagtgtttggtatttcttctgatcctagaagggctcctcccagctaccttattctctgttctctcatgcaaactagtggggttacagtccaggctatatgtccattagagccacagatttcctcttaattccttcactgcaacctccactgttcttgaaagcacctttaggttgcagcttctccatgctctgttacaaactgagcccagttcctttaggaagagatcaggagctatctgttttacaacctgcttcccccaggcaaaatctttgagccagagctcaagctctgtggagcccttggggagggagagcagtagcctaatgtcctctcagcttgcctctcctggcatggaaccaccaccttagaagcaggggtagtttcttttgctatcagtctgcccctactggggggtacctcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaatagtcaggaaacaacaggtgctggagaggatgtggagaaataggaacacttttacactgttggtgggactgtaaactagttcaaccattgtggaagtcagtgtggcgactcctcagggatctagaactagaaataccatttgacccagccatcccattactgggtatacacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacgtggatgaaattggaaatcatcattctcagtaaactatcacaaggacaaaaaaccaaacaccacgttctcactcatagatggaaattgaacaatgagaacacatggacacaggaaggggaacatcacactcaggggactgtcgtggggtggggggaggggggagggatagcattaggagatagacctaatgccaaatcacgagtctgcagcacaccagcatggcacatgtatacatatggaactaacctgcacattgtgcacatgtaccctaaaacttaaagtataattttaaaaaaagccaataaataaataaatatataaatacataaaaaataaagtgttgtaccctaagaaaaaagttaaaccaaaaatagataagccttttcagggattacaggctcttctcaattcctttacataccataaaacttacccttttaaagtgtgcaatttaatagttttttgttttttacattttaaaggattgttaacaaataaaataaaataaaaagactaattcttcacaaactcttccaaaaagtagaagaggagggaacacttcccaactcattcttttttttttttgtatgtcattacaatggaattcagttcagcaattaaaggaataaacttctgatacatgctgcgacatagatgaacttcaaaacattattctaagtgaaagaagccaggctcaaaagatcatatattatatgattacatttatatgaaattcttgaaagacaaatttatagagacaataatcagaacagttgttgcataaagtgagaatcgggattaactataaataggcatgaaggaacattttgggtgggggtgttgagaatgttctaaaattggattgtaatgattgttgataactgcaaatatactaaaattgttaaattgtacactcgtgggctggatgtttgtgttcctccaaaaattcatgtgtcgaaatcctataccccgatatgatggtattgggaggtaaggcctttgggaggtaattagatcatgaaggtggatccttcatgaatgggattagttcccttataaaagaaccccagaaaactctctagccctctttcccaccgtgtgaggatacaatgtgaaatcggtagtctgcaacctggaagagggccctcactggaacttggccaggctggcaccctgatatcagacgtccagcttccctaactgtgagaaataaattcctattttttttataagccactcagtctgtagtatccaattatagcagcctgaactaaggcattttacaatgggtagattttaatggtatgtaatttatattcaataaagtttttaaaaggaacaaaaaaaaaaaagaaagaagcaggggtaaaggctccccaaggctcagtatgctcagcttgccaaagaaggaagtcaccccggctcaccactctcatcagtaacagacggcttcctgactaagcctcagcaacaggtggctgggggcaggatgagaaataccactgtcctcctcttccagggaagaaagatccctggctgagaggtgtagggagaaggagccctgtgtttttggctgtagtctgaagtggagtctctgcctcagtgagctgtaaagggggagaggggaatgatcttggttaaaaccctacagattctcacctttcttactgaattgtcattgattttcttgaatggatgtttctttttttttgagatggagtctttttttttttgctggggaggcggtgggaggcaacgcagtcttgctctgttgcccaggctggagtgtagtggcacaatctcagctcactgcaacctccgcccccccgatccgagcgattctcccacctcaacctcccaagtagctgggattacaggtgtgtgccaccatgcctggctaatttttgtacttttagtagagacggggtttcaccatgttggccaggctggtcttgaattcctgacctcaagtgatctgcccaactcagcctcccaaagtgctgggattacaggcatgaggcaccactcccggccttgaatagatgtttctttatttgctgtttactcttcaggaccattccagaggttttaaatggttgtttttaaaacagtgttcaccagtttcactgaggatcaggtcaatggagttcctctcactgtcctgcaaaagtcaatctcattttctctagtattggtcatttcagtgagagtcttagagcagatgttgaatggctgtgctcatggcatatctagatacatttcttttctttctttttttttttttgagatgaggtcttactctgttgcccaggctggagtgcagtggcatgatcttggctcactgcaacctctgcctcctgagttcaagtgattctcctgcctcagcctcccgagtagctgggactacaggcgcaccccaccacaccaggctaatttttgtatttttagtagagatggggtttctccatgttggccaggctggtctcgaactcctgacctcaggtgatctgcctgcctcggcctcccaaagtgctaggattacaggcatgagccaccacgcccagcctagatacatttcttaaacttccttcttttattgccagcagctagcatgatgttctgcacatagaaggtttacagtgtcatttgccaaggacattgatggtattccaacacaaagtgtctggggaatcctctgaatggggagaaagggaattaacggttgcacagtggttcaaagcatgagtggcgagcactggaaccaattccaccacttctgagcgtataatcttggattattctgagcctcagttaatttcagtggtaaaatggggctaaaatagtagctatcagataaagttgtagatattaaatagtatatgcaaagtacctcacatctggtatatgcttaataaataccagctaatatttcagacattgctaggtgtgactgcatatctacacatcattcacttaatcctcacaataatcctgcaaaagtagttgtcagtattcctatttgtggataaggagagaatgacacaggaagattaagtaatttgcccaaggtcacaactaggaagagacagaactgaacccaggattgaacccacatcactctggcctttggcttctttccatccagcactgttgtggaaactgaagtgcagggttaattaggagagacagagcagaagcctgtctctagacttagacaagctttgatcccattctgtttctgtttttttgtgtacagtagaatttcattgaccaccttcacatcatcaagccagtctcaaaaaacactgaaccttctgtgctggcctttctgataaagacactgcattattaattcatacatacataatcacgttgcatgcatatacacacaatatatatacagtcatgtgccatataatggcattttggtcagttacagattgcatatacaatggtggtcccctaagattataatggagctaaaaaaaaatcatcaggtgatgagtgaatgtgaaggcctaggatattactgtacactatgtagactttataaacattacagaacaaattccagtcctgcaagctgtattcatgttaagtcccttatacaagtgtaccattacgatgttaatattttatactatatttttactgtgcctttcctatgttttgatttgtttagatataagaatacttaccattgtgttatcaccctacagtattcagtacagtaacatgctgtacaggtttgcagcctaggagcagtaggctctaccatatagcctaggtgtgcagtaggctatacatttaggtttgtataagttatgctctatgatgttcacacaagaaaatcacctaacaacacatttctcaggacatatccttgttcagcaactcatgactgtatatgagcaatatatgtaaatgtacctaaatgattatttatgattataaacctaccatatgatggtaaagggatcacccatctcttttaatagtatcagaagtgggcctgtaagctttatggggacggaatcttcccctggtgaaggcagctaagtctccctgcaccagtctttgtccccagagatccccagcacctttgatggtaagtgttaatttcagctgtcctcacccccagggtcttaggaaacatagatccccttttcacactggagctcaaatggggacactctacccttacccacaagacagctaggagcaggagacctgattcaaaattactgaggtctccggaagattaaaaagggaaatggactcagtaaaagcatggggctcggctgtctggctgacacagtggctcacacaggctccttctgctcaggccacagccatctttaggcactggcatggcaccctccacttagcaacacacctcaggcccctgaaagtcctgaccccagacagcgagaatcctccctctccttcccagctgaccattgggtccagccccctcattcctccacgggctgcttgcccagcatggagcctgcagcaggtgcgctgtactccctggacacagtgatgggtaatgcccctttgccctcatggcacacctggtctgcagggagcagacgggagaagcagcaagccactgacagatggaataagtgctgagaaggaatcagtgaagcctcactgaggggggacattcactgagatctgaagaccaagaaggagccaagccatgaaaagccaagagaagagcatcccaggtgaaagggacagtaagtgccaggccctgaggcaagaaggaacagcagcaaggtggcggctgtggcagaagtgcagggagcatgggacagagagggacaggaggaggaagagaaatcaggcagaacatgcagcatcccccaggtcttacgaagtgtgaagggaagcctctgaagataatgatgcaggaaacgagcaagatgtgatttatgtgtattttagagctcccttgggctgctcagtgggtgacactgacgctgtcgccaagcacggtatggcggtggtagcaatggagtaagagagaaacggacaacttggacatttattttgaaggtagaccccacaagacttgctgatggcctgggaggggtagtgggctctggcagtggccatcccttccccagcacttctccccacccaccagggctaagcttgcagccttcagaggacagctgtaggacacagatggtgaccccatgcagaagagcctgcatgagggctgaggagtgggagaactgctcttcccaaggacaagaaagactggaagcaggccgggcgcggtggctcatgcctgtaatcccagcactttgggaggccgaggcgggcggatcacgaggtcaggagatcaagaccatcctggccaacatggtaaaaccctgtctctactaaaaatacaaaaattagctgggcatggtggcgcgtgcctgtaatcccagctacgtgggaggctgaggcaggagaatcgcttaaaccagcgagtcgtaggttgcagtgagctgagatcgcgccactgcactccagcctggcgacagagcaagtttccgtttcaaaaaaaaaaaaaaaaaggaagcagaggctggaaggttgcgtgctggctacagagtgaccaggaaaggcactctttcctggaggaactgaggagggggctttgatgtgatgatctggctgagtcatcccccaattctcatcaaattaaatacccagcaacaccagttattaccttaagcatgtatggagcttccagtctacctaagcctgtggtggcccactgccccagccccctgggttgttaggtcaaataatcatatactcatgatagacaagatactagaggtctcacaaggagaggagaaagcgtctatgaagctgcagggcctcttatggtacagagcttggagcacatatagcttccggatggagatgggccacaggaaatggaccccagtggagggcagggcaccaaatgcccagttttctagcacccaccctatactagctggtgtgctggagcaaggcatgcacctctcatttcatcctctccctctcaatacttctgctgcttacactagaagcagcccccaagggctttgggggaatgataatgctgtgtacatggggtcggggcggggaggggggcagtaaggggaaggccatcagcagccctgattagccgctatcacgactgcccctcaacctccaaagggagaccaagtctcccacagtttttcacctcctggaatttgcatttgcatttcatatcctgacttgtcaccttgtgtggagcttctgggtggactctaagaacctagaagaacctgtgtgtgtctgggaggggcagatgaaatagtaatgcccttccttatccaccccctacctcgcacacacactccgaaaaaaataaaactcctggctccttgcagtgggcctcgtggccccaatcttcgtgtgtgaactcttgcactgtaaaacccggtcactgaactcttccacacgctttctaaaatcgtttggcatggactttcctcggccccttaatcaccacagggtgtgtcctgcccgggctgtcaggagggtcgcaggcgcccggtggtccacgctcaccgtgcgcctggctgagcgcagatgagggtcgtgtcccgtctgagcgcgctccccccgccggcgcgcacgcctgcccgccgggtctctgccctgggccgagcggggccacctgcttgcgtcctcgccctggatggcgtgggaggcgccgccaaccgtctgagctggaatccttgcggtgaaaaagtgggcgcccaccagccctcctcaccaccgcggctgcgacgagcctgggcgtcgcctcctaaggatggccctgtcctaacacacgcgtgcggacacaggtggcggcggcgcggccctgcggcaccgaggacgacccggagccccgcgcccgcgcccgccgccgcagccgctccaggcctgcgtgcgcgcgtgcgtgagcgcgtgccgaccgggcccgcgacccgcactggggtcgccgttgaggctcagcgcccgccgggcggccggtagtgggcagcgagctgacgcgctgcgctctgccgggagggcgcctggcctcgctccgagccgcgcgcgccccgcgcctgccaagggtcccagctgccgcggccacagagcccgagcggggggtcggctgagagcctccttaacggagccccatgatgtcagccggcccgcacgcccctcgccctccgactgcgaccccggcccgggctcgcgcgccccgtcccccggcagccccgcggccgccgcaccgccgcccccggcccagccttccccgagcctgtggctggagctcgggcccgcctgcgtgcgggcgcagcaatgccccagcgagtcaagcgggcagacgagtggcgatctcggcactagcagcagcagcagcgccgggctgtccccgggctccgactcggacagcagcggcgtggtgtgtggcggccgcggaggcaacgggggcatgcgcggcgccgtgtcccgctcctggagcctggagagcctgcgctcggccaccgccggtaaggacgccgccatccccgcgccgcacgcgccctccgcgcccgggtctgtgctcttgggaccccccgcccccctcctgcctttccttctcctccctcactttctgcctgtcgtttccatctcctggtcccttccttcccattgcttcgccctgctattccttttctttttctggtttccttctgattcccactgcctgtctctctgatccacgtctaccggtgggccacctgttacagccgggaccttgttggcccccataccagagcgcgctgtcaactgggaaactgattaaggtgagactagaatttggtgcccgatgcgctgtgttcctttccccaaactgttcttgaccagttgcacctgtctggctttacctaccgcagctgcttagcctctgtaaagccaggaggatggaagggggccgctggccgagggtggaacggattgcgccacctggctgtgagtgcgcttggtcctgaccgcaggactgcagctcccagcggaggcagctggtcctggacccctctgaacaagactgcgctttaccgacctggcattgctctggtgtttcctgggaccgtgtgatccctgtagtgctcccgaatctacctggagggcctaatttgggttactggttgagaggaagattttgtccctaaatattaatggagcaaggaagtcaagagtggttttatgaatggtgatcaccttacccttggttatttgctgacagaattatttatatttcacttcttgcaaacattctcaaatattgtagcttctgcagtggggtttgtcaagggcaacagttgctgcctggaaatgagagagttatacacccactatgcttctgcatggggctggaggtgcagcctgtgaaagctgcagggcctcacgtaggtgtggaatgagactcagagcatcaaagccagaggagcagagggccatagggatggcagaatgtggagcacaggccttgttgggcagatatagagcaaggtcggctctggctgggttgagagcacctggaatgacagattcagagtttggactttgcagtcagcgagtttgggagagagaagtgaaggacatgcagacctctgcattgagcactccatgactcatctgcccgttcccaaaacacacgcatgaaattcagaaaagttgaataatccagctgttgatgtttccttcaacggagagttttccattgttctgcagctctgattccatcacatccctgttcccttgaaactgtcctttccctcctctctggagcttaaatagaacccattttgggaaccccaagctagatcataccctaagtggggcctgaagcaaactggcagaggactcctgcccctttccttattcagacggctttccttcctttccagaggcctcagtcctcctggggacacctcctcctttctttcttccttctgtcccagggtaagtgcgccagtgagacagatggaaatggcagagaccctagtttattaggcagcccagagatccagggactccctggtttattaggcagcccagggacacagaggcagcctggataattttccgagataacagcgatgcttgcatgaagatctggagagagagagagttgggagcagggggtggggaaggaggacagggtaaaagctgaggcctaggaagttgctctttgaggggcccagggctgcccggcaatggcagggcagggtttaaaacaacatgatgtagtcagagttgatgtgagacccagaaacgaatgttgtgcccctcacagacactgcaccactaagggtaggctctgggtatctctaggtccacaggcagcacactacccggggagtgctggtcagtaaccagccacagaggcactgaggaagacatttaaagtcacctcttcatcctctctgcccccacttcctgccttgtttggtaggacctgcatcagcagtgaccaatgctcgatgtgtaaaaagacactcccgtgtatgccttagagccagttgaatctgtgaagccgtctgtccttctcaactggtcagaattaactgtgcctaagactcgcctctcttcttctacaacggaactagctatttcctgtccctgggaggaattgcggaaacaggcactcaaataatcctgtttgaatatggttggaaaaggctggtaagggaggagaacttgaagggaggagagaagggaggttaccttttgagcactctctacatgccaggcacaatattccctgctaatctggatttgaaacaggctcagaggtgtggtaacttatccaaggttacctggtgaggctgcgtctgagcagagcttcaggcccggctggatgtaacgtgatgaggctctttgctgggttttcagccagtctgtgccagcgaggacgggcagcatgccggtccggtggtgcgttggaatagtcctgactgctcacacactcgctgatgttactgttttcattcaacaatcatggctttttcctggatgccagctttcctatttgcaaagcaaagaaattaaaagcaaaggtctgacctctttgctaatcacctctaaaatgccatgactctagtcaggggtattgatctggggggtgcgccccactgagtcgccattgattgcacattgtgtttctgtttgactagtctaacggctgagacaaaggacacatgtgtttaactgaactgcatttctctcttaaggaagattaagagttcccagtaagggatcgtcagcacagcttgattgtggtgtgatttttgtggtggggcctgtcgctaaacatttttggagttcccagcaagcatctgaaaagtgagtgcttgtgactggatagcagcttcctcacagggcgcacagcagtagacaaggaatccaggcagggcctctagactcgccttgctttcaaaagactccttgaattttaaatgctctgtgttggcatttccactgaaatgtcgttcatctggctgtggagaggacttccctttgaggcataatccgaacacgaaatatagctgacagggtggaatttccatggcccttctttctgccccgctgttctcatctcccctcgggcccctggagcctccagcccatcagctgtgctgccacactgctggtactcagctgaagctttcacaatttctgttctggatgtgtcatctgacaagccgaattctctcttcgggcttctggggctgacagttttcatgttcacctccttttccatggtcagtgtcatgggatctcttcttggtggagaagccatgctgcttccacattcccccgcaggcttctgcagcatgcatccgcaggcaaggcctctcctgcagccacacatttatttaacacctgttgtgttccaggcacagtgctaggctctagaggtggtagatgaatcatacacatttcttgcccttaaagaaatcacagcacagggagacagacagtgatgccccattatgtgtgctaagcacgctgacagaagctcaaaaacatggttataccagaggttctgagttattccagtgttagggtacagactgaagtcaacaaaggcaaagagcacttagagcagaggccaggagataccaggcaccagcttccaggtgtcccctcctgtggaatcacatggacgatgcttcagtcactctgcctcaatatgtgacacctgtgaaatattgccaaccagataagttccccaagccttggtgttcagggtggaggtcagttatttaggcaggcagcacccacaagactgaccttagttgctcagtctctagcccctccaaaggtcagactaatacagtgtagttcaagcccccaccccccaaccataaatcacattgttgggggaaattatctggcatggcccaaggccctagatacacaaagtgactctgatcagtcaggatattcctagggcttaaaggtgatcttgtaggagccggtcaagggccagttctccctttggaatttgtagtgtttaaacatccccaagccttaactgcacagatgaggaagcttaaagtaggacccaacctataatgtggggcaggccaggaaggaaatggttcagagaaaccattcagaaggaggctctccctgaggcctaagacctgcaagttagccttggtaaggaacagtttggtaagagcttttgggagagaggactaacataaacaaatgcagaaggatgtaggaaggaagggaacctgtgtgccctgagcccctgttctgggtactgcattggatgctttcagtctgcagcaattgcaaatagtatgaaatgaagagcactgcaagaaatgaggctagagacaggccggctgcagctccctgctaagaaatatgaactattggccaggcacagtgactcatgcctgtaatccaagcactttgggaggccaaggcgggcagatcacaaggccagaagtttgagaccagcccggccaaaatagtgaaaccccgtctctactaaaaatacaaaaattagccgggtgtggtggcacgcgcctgtagtcccagctacttgggagactgaggcaggagaattgtttgaacccaggaggcagaggttgcagtgagccgagactgcgccactgcactccagcctgggcaacagagcaagtctcagtctcaaaaaataaaattaaattaaaaataaagaaatatgaactatccattatacttggagctgtggagaggttttaagcagaaagtttttgtggctactttgcttgcttgcctgctctcccctcttagagatgatcataagtagaaaatgcatttagtacgcctaacctactgaacatcatagcttagcccagcctaccttaaatgtgctcagaacacttacattagcctgaagctgggaaaatcatctgacataaagctgattttataataaagtgttgaatatcacatgtaatattgtactaaaagtggaaaaacagaatggttgtgtgggtacttgaagtacagtttttactgatatgtaccacttttgcaccgtcgtaaagtcaaaaaatcatatgtcagccgggtgcgttgggtcacacctgtaaccccagcactttgggaggccgaggcaggtggatcacaagatcaggagagcgagaccatcctggctaacatggtgaaaccccgtctctactaaaaatacaaaaaaaattagccgggcatggtggtgggtgcctgtagtcccagctactcgggaggctgaggcaggagaatggcatgaatccgggaggtggagcttgcagtgagccgagatcgcgccactgcactccagcctgggtgacagagtgagactccgtctcaaaaaaaaaaaaatcatatgtcaaactatcgttatgtcagaggccatctgtatttatttttaaagttatatacagtaaaaggcacactttttggtgtacaattcttagagtttgacagacacatgcaggtaactacccaccataataaaaatatagaagagttttattgccccagaacatgagtgaggccctttgtggtccattcattccccaactccagtgcctcgctgatctagactccatccctagggatttgtctcttccatgatgccgtagaaatggagtcatatcatgttgccttttgactggcttctttaacctcatgtgttgcgtttgagattcatcctcatgttgttgcatttatccttaggttttttcctcttagttgctaaatagtatttcagcaaatggatgtatcacagtttgtcaaccattcactagctgaaggatactcagattgttcctacttttagggtgttacaaataaagctgctgtgaacattagtatgtgagtctttgtatgtacgtaagttttcatttctcttgggtaaatacctaggagtgcattgctgggttatatggtaagtgcgtgtttcactgtataagaaactgtcaactctttcaaagtagctttaccattttacagttcctcttgatatatattctcaccaacacttagtattgccaggttttttaaaagccattctaggttgggcatggtggctcatgcctgtaatcccagcattttgggaggctgaggcaggtggatcacctgaggtcaggcgttcgagaccagcctgaccaacatggtaaaatcccatctctactaaaaatacaaaaattagccgggcatggtggtgcacacctgtaatcccagccactcggcaggctgaggcaggagaatcgcttgaacccgggaggcggaggttgcagtgagccaagatcacatcattgcacttctgcctgggcaacaagagtgaaactccatcaaaaaaaaaaaaaaaaaaaaagaaaagccatctattaggtatgtagtatctcatttggttttcatttgcattttcctagcaactcctaatgctgagcatcttttcatgtgggtgtttggcatatgcatatcttctttgttgaagcatccagacccacataatttttattggattgtttgttttcttattgttgtatttggagagttctttatatattctgagtgcaagtactttgttagatatgtgatttgcaaatatttattctagtctgtggcttgtgttttacttgctaatagtgtcttttgctgaacaaaagtttgtaattttgacggaatccaatttttcatctctctgtcttataaaacatacttttggtgtacatctcagaaatctttatgtaacctgaggtcacagagagtttcttttatgtttgtttccttctagaaggttttacagttttatattttgtacttagatctatgatctattttgagttaattttttaaggttcaagataagagtgaaggttcatttttttgcatatgcatgtccaatttttatagcaccatttgttaaaaagactttttttctccattaatttcctttgtacctttgtcaaaaaacaacagtctatatttgtgttggtctatttctagctctgttctgttccatgctgtagttttaagtcagttatgtgagtcctccaattttgttcttctttttcaacattgttttaattcttcttcttttttgccttttcatatacattttagaaccaacttgtcaatatcagttaggtgcagtggctcacgcctgtaatcccagcctttgggaggctcaggcgggcagatcacgaggtcaggagtttgagaccagcctgaccaacatggtgaaaccccgtctctactaaaaatacaaaaattagccaggcgtggtggcgggcgcctgtaatcccagctactcaggaggctgaggcaggagaattggttgaacttgtgaggtggaggttgcagtgaaccgagattgtgccattgcactccagcctgggcaacagtgggagactgtctcaaaaaaaaaaaaaaaaaaaaagaatcaacttgtcagtatctacagaatatcctcttgagttttgatatggattgtgttgaatctgtagatcagttttgggaggattgaaatcttaacagtatggagtcagtttagaaacatcatacatctgaggcgaggcggccacgccaagagctctccaccagacctcactgcagtgcctatacattttggtgaattcttctcttctcgacgtttccaatatattttcaagttcctgggtctgccagacagtgactttcctaagtaaaatctatagtgctgggggccccataagccaggtactaggccagtttttccaacaggcctttataagcattggctccataaagtcaaccttagctttttaaaagtgtctggttatgtttaattaaatgaacatcattctcaaataagtcattccaggcaaggcctcgggttgtataactaatgtttctaataaatgtcctgttaacaaggaagacagattcttactgaacctatgaaataattatattgccgcgaaaataagaatactcagtaagaatttccaaattctgagggcttgggcaggagaaaaatatatcacttacaaatgtttcatttcagtttataagagcatagtctactaaaggcctactaatgagttaaagataccttgaaagaaaagaaaaaggagatccttatattccagaaaatagaacattaaaatatcagcaatgctcctaataataagagccacagtcaccttcttgagttcatttgggtttatgtgattaatccttgctccactctctcttgggtttgcagtttcttgaacctgcattcagaactagagttctggaaatcctgactcagtcctctgttgtggtctcaaagttgttgacataacatcatcagaagcctgcacccaagagttcttggcagggccctttccaaagaagagacagacttctttgttgaagaagcactcaggctagtagctgaaacttcagaacaaaacaaaaacctatctgtaaactatcagcgaaagacttaaagtggttgtggttaatgtgttactgataattttcaaaagtgaaagatctgctgagagctcatactaaggatagtgcaactgacaaggaaatgtgattgtttccgcaatatacaaaacaagataaaatcaataaacaaatatgagacaacaaaattatataatgattaagcttactttcaaagaagatagttaacattacacctaactatagaaatggatgaacataatctttaatatcttcagatacaacatattataatcctgacaaaattatatcatgaaaatactaagcatacagttggaatatacaaagattataccaagaatatctataaagagattcagtaagtctagagcaagctctaaacatctgtatattaataaacctccacaggtaagtgatgtgaacccccaattaaaactgctggcctacaggaaggatgcaaataaaagaagtaaagttgcaatcaagttaacatttaaaaaataaatgaggccgaatgaggtggctcatgcctgtaatcccatcactttgggaggctgaggcaggcagatcacgtaaggccaggaactcaagaccagcctggccaacacagtgaaaggctgtctctactgaaaatacaaaaattagctgggcatggtggtgcaagcctgtaatcccagctacttgggaagctgaagcaggaggattacttgaacctgggaggtggaggctacagtgagccaagatcatcccactgcactccagcctgagtggcagagcaagactgtgtctccaaatagtaaataaataaataaaataaatgaaattatgactgctggccccatactagcacttcttgcaagttactctttgataccaggcagaggagcaccagggctctgataagtggatacccatcatggacagtgaagctccaggagcttcccatacagcataacatttccaaaatatttaccattttacccatgcatatctgacctagagaaggctcagcatctcttccaattcgacagctcttcccattcagctaatcagcagtaacatatccaacattacatatcaaaacttaaatattcctagcacttgttttgtctgcaaggtgagagaatagatgatttatactttccaggggcctactgggaaatctcaaagataattttaggtacaaaagttatcatttagtgtttgattttggaaaggcaaaatatcaaagttgtctgttgtctgttatcagaagtcatctgatttaaacactgattaagatagaatcttgctgggtgcagtggctcatgcctgtaatcccagcactttgggaggctgagtaggacagatcccttgagttcaggagttcaagaccagcctgggcaacatggcaaaaccttgtctctactaaaaaaaaaaaaaaattagccaggcatgatggcacacacctgtcgtcccagccacttgggaggctgaggtgggaggattgcttgaccctgggagattgaggctacagtgagccgagatcacaccactgcactccagatggggcaacagagtgagatcttgtctggaaaaaaaaaaaaaagatagaaacatgggctatcaagaacaatacttggctaactatttgaccaaagtgacaataattttttttccttatcaaccttgccctacaggttttattttattaaaaataaaatatatttaaatgaacataactgtaaagaatcctagctctttttgtttgttgtttttattttttgagacagtgtctggctctgtctgccaggctggagtgcaatagcatgatcttggctcactgcagcctccacactttctaggctcaagcgatcctcccacctcagcctcctgagtagctaggactacagtaggcacacgccaccacacccagctatttttttttttttttttgtattttttgtagagacagggtttcgctatgttgctcaggctggtcccaagctcctgagctcaagcaatccacccgccttggcctcccaaaatgctgggattacaagtgtgagctactgcacccggcaacttttttgagtaagaaatttttgttttctgaaatactcaagggcatgacaaacttaacataaaacacaagaattgattctgataatacacagaatctctgccatctgagtagattccacagaaagcaacagataaccttctacagcctcttgacctataatccaagaattgtttaacagagactcaattttttgcatcagtatattatttgatactaaagttctttttccttttcctttaaaaaaaaataagttagtctcaggtgtaaagctcttttttaagagcagcgtctgtgacccccaggggttgccttgggtacatggacggatggacgtgctgtctgagggccgcagtccaggacaaatagatttggatgagggaaatgctgaattaagttctggacacgtggacaacttggacttagcagtgaggatcgcatcctctccttccaagtgtctaaggagctaattgtgtgaatcatttttaaattttctgtatttcctgatgctttgacatcttggggccttccagaccctggagactgcccctcggagggctagctaattcctagagacagcagacacccacctgagagcatgctcttcagatgcaaaccaccaggccacagcccttactctcaaaacctcctctgctgggctctaacctgctgagccactgggcccctaccttagtcatcccaggcccaggtaccaaaaaactcgggacagccctcactccagagcctctggaaattattcagacccagcccatcttatgcctgcctgccccactttgccttgcctttcccatggaagtgactcttgtccccattgccctgctccctgcctccagtcccacctgtgccgcccagaaggctgcacgtggcatgccctgcaccccacttctacagaactgtaagtaaaactggaagaactgtaatggcttccttgacagccatttccatgtctgtgtatcttaccacacatgactaaaacaaatccctggcacattttaaaacatgaactgctctgagagtcattgcttggcatccaggcctggcactgaggcgtcactgtcccatcacagtgctctgggcggtcagaggcggaggactgctgagggaggtgggcaaggagaaaggacgggcgctcaggagggttccactccattctcactgcagttgtttcttaggtaagaaagatgggggctcccggaggctaaataactgtcccatgggggtccgtcacaggctggctgctggagtagcccagggtcgacctcaggtctatccgaatcccgtgtttactctgctcggactgcctccagtctctgtgaaacaagtgagggaatggacacatggagaggttgtgcaaggtgatgagtgtgaagaagaagctcagccatgtcctggaacatcccagggtgtgtggcccagggcattggtcttgagggataagagggaaaagggatccatgagtcagatatgttggagagtgtggttaaacatcgcagagcctaggacgttcctgtttgcatctagagctctcaaaactcattcggccccagaatcgtgtgtgtgtgtgtgtctgtgtgtgtgtgtgtgtgtgtacacatctgtacaactagtttcctgaggatcatacttggaaagtgctttagtttcctgcttgcacctgcacgcagacgctgcacacctttcctgagctctgagcatgggaagagaatagttaggcagtcgggaggcctttcaagcagccttctgaatttcggtcactaaagtcagccaataactgtgccagccagtgattcacagggaggagacagggaaataggaaggcaggtgtgaaaagcctcactccacgaaatttcagaaataaatacgagtcctaaaatctcaaccaaaaactcgacgtgtaggatgtggtggagaaggaaaaggtggggtctcagactgggggcaagagctggcagatggcaggtgctggctcccgcagaagagggcccatcagaaagccaagcacagcctcgcctgcagagagcccagagggaggcagtgatgtgtgtgtgcattgtgtatgtttggcgtgtttgtggtgtgtgtctggtgtatgtgagcatggtgtgtgtgtggtatgcattagtgtgtggtgtgtatggtgtgttagtatgtgtggtgtgtgtgatgtatgtgtggtgtgttagtgtgcatggtgtgtttgtagtgtatattactgtgtctggcatgtgtttgcagtgtgtgttaagtgtgaatggtgtgtgtgttggtgtgtggtgtgttttgtatgtgtgttactgtgtggtgtgtgtggtgtgttagtgtgtgtggtgtatgtgatgtgtttgtgtgatgtctgtgtatgttagtgtgtagcgtgttgtgcttctgtgtattgtgtgttgtgtttgtggtgtgatatgggtggtttttgtgcggtgtgcgtgtgatgtgtgtggtgtatgctgtgcatgtgtagtgtgtggtatgtgctagtgtggtgtgtcagtgttagtatgcatagtgtgtgtttgtgtttgtagttggtgcgttaagtatgtggtgtgtgtagagtatggtgcctatattgtgttgcgtatgttgtgtgtgttgtgtgatgtgttttttgtgtatggggtgtgtttgtgttttctatgtggtgtatgttgcgtgtgtgtgtagtgtttatgttgtgtgtgctttgtgtgtatagtggttttatgatgtgtatgtatgttgtgcatgtgtggtatacattgtgtgtatgttctgggttttgtgtgttgggcatgttacatgtatgttgtgtatgtgtggtgcatatgcgttgcatatgtatggtgtgtgctgtgtgtgttttgtgttttgcatgtgtcgtgtatgtatggtgtgtgtgtgtgcgctgtgtgcattgtgcaaacgtgttttttttgcatcttgtgcgtgtgtggtgtttcatgtgtatgtgtgtatgttgtgtgagttgtgcatgcatggtgagttgtgtatgtgtcaccaggggtttggtctaggttctgctgcccaccacacagaaagccaatcactgagacaacaagtattgccaaggaagaaggctttaatcaggtgcagcagccaaggaggtgggagctcaggctcaaatccatctccctgaccaactaaaactagggctttatgtaggagggaagaaatgtaacagtgtgtgagaaaatagggcctagggaggggcaaggaggcatctgatgtggtgatctggtgagtttcactcctttgacacttcctgagatcccttttctgaggaaggaactcatatcaaacaaatacaagtttcaagctttaacagcagaaggatccatttctatgtttatccaaaagcaactgtctatgggaccctcgggctggtttcagtcccccctttctatttatcagttccacaatcatgaggaatctcgtcattgatctttctggctgcttcatgctgaggaggggtgtcgtgggcagctccataccatggctgaccatgtagccacccaggaatcgaaggttaatctaatatagagttttcttctgacatacaatatttctccctggtccacacttctgccaaagacaaatcacagcaggaccaacctagctgcataataagtgtcagtcccatattcttggcctgattactcacacaaagtgcaacaagaatcactgtccatatagattcccaagttggctttgctggaacatctcacaagactatttcagtcaaagccctgagaaaataaccagtcccttcaattgtgtcgcattacaaaagaaaacatggtctttgtgcaaagaattacacattgccatgaatgaagaatattcacgaatagtttacaaattctggagaaattaggcagagaaatatgactcaaattctgtttacaaaagtatactcaatacacttaaagtatatttcaaggctataaatagctccaaaaaaaaaaaaattctccagactctgaaaaacaaaacaaaaagaatcagcaatatttcaaacaacaaaagccataaaaaaaattatttctgtcctgcagtagttcagtccatgcagtcacctcctgctctgcttcatattgggttagcaatcttcaggaacacatcagcctttcaatttgtgcagtggaagttctccctctaatccaatggcacaatctccaaagttatcagaaacctgcactcacgagtccttttcaagaactcctccaaagaagtaagccttggactgtagctaattctaagccagttttttttgagaaggatcaaagtaaaacatcaattgtggatgacaaaagtcttaagacagccatagttaatgacaccgttgacaggaaaatttggttatttctgtggcatacaacaatttaacgtgacaatcataactattactgacaacatatattaaggcatatcagaattttaggaatctcatataatcctagaacccatgttagcaacacatctatataaatataacttgaaggaagctaaacaccacctcagatttgacaatgcttcctgcatagttctaatataacaagcctaataatcccaaccatgtctctcttgaacttcagggaacctaatatccaaaaagtttagtttgaggacaaaaagactgaatttaaaacttgaaattggccaggcgtgatggctcatgcctgtaatcccagcactttgggaggccgaggtgggcagatcacctgaggtcaggaattcaagagcagcctggtcaacatggtgaaaccccatgtctactaaaactacaaaaattagatgggcttggtagcgggagcctgtaatcccagctactcgggaggctgagtcaggagaatggcttgaacccaggaggtggaggttgcagtgagccaagattgtgccgctgcattccagcctcggtgacaaagcaagactccatctaaaaaaaaaaaaaaaaaaaaaacctgaaattttgctgttagaaaatctgtcagatttcaaaggtttcagacagacacccaatatcacaaaataggatcacaagtttctataaaatagtcattcaggtagcgaaaattataatataaaatgtttacgctttgatagagaggaaactttctcaaacaataagacctaatacttaactatcattctctctaacatgttacaaattaaaacaatgtaattggtgtttagaagttactgccagcaacacttcaaaccactgtattaaagtagttaggttactcatcacatatgtctaattgctagtattctagtaacataactgtaaacaaaaacataaaaaacgttgtaagtctggatgggcatggtggctcatgcttgtatccccagcaatttgggatgccgaggcaggtggatcacttgagctcaggagtttgagaccagcttggccaacatggtgaaaccccatctctactaaaaatacaaaaattagctgagcatggtggtgggtgcctgtggtcccagctacttgggaggctgaggcaggagaatcacttgagcccagtggcagaggttgcagtgagccaagatcatgccatccaccctgtgtgacagagtatgaccatgtctcaaaaaaaaaaaaaaattataagtcctatgccagacttagcaaaataagactaactaacattttttctttatcattaaaaaatgataaatgcaaatatcagttttggaaatttagtatgagaagtaatctttcacttaaatactatacaacgaaacagggagaaagtaagaataagcacacagcaatttcttttcagctattttgaaaacacatcaacacacatttctaagattggtttctagatacagtactgacgactggttaggcaaccttcaccactcaaatctgtaaaccagtgcagcatgtgcacataatttgttttcaggtacatacatgaaggcccatcagtgataaacagcttgagatcacaaatcaccaggaagtctcaccttttttaaaattactaattaatccaagtgaatgtcactttaaattagtttgagagaaattctactcaatataatttccttaaggataaggccaatctttcctgaatattaaaaccatgtacccatatcacagtttttcttcaccacctaaaggaaaagatctgaaaccaactcaaattgttgattgaattgagttaccttgaatataaacaccattgaaacatttctgttctcacctacttttgccaaattacaaaatttgtaatatgctatttctgttcagaacttaagtcttttattatttcatttttttgtggctgggaaccttaaaactctcatagctctgtagatcattagaggcaagcaaatccaaccaaatttcaaatggctgttgtgctccatccattcctgaagaccaaacaaagatagcctgggaattctagataaatagaacaaataatgacttgctagaaatgcataggaaacaaaataattattcacagaaccaaataaatgccttctactaaaaactaaaaaacatcagttttatatctacgcatacacaagaaaaacccaaaggagaacaaacagcaacaaataaaaactagaagtgaaaataggcctgtaatcccagcactttgggaggccaaggcaggcggatcccaaggtcgggggatcgagaccagcttggccaatatggtgaaaccccgtttctacaaaaaatacaaaagttagccaggtgtggtggcaggcgcctgtagtcccagctactcaggaggctgaggcaggaaaatagctggaacctgggaggtggaggttgcagtgagcaagattgcaccactgcactccagcctgggtgacaaagcgagactccatctcaaaaaaaaaaaaaaagaaaaaaaagaagtaaaaacaaacaggaaacagaccccccattcttttccccactcagttaccctggaggctgcagtgttacccagagtcaagaaaaccccacataatgaatattttattcctgatcacacaagtcagtatccttaagtccaccaatattaccatacatcctgtgcaatcaagaaattcattctaggcacatggccagtaagtactctagtgccagcactatccatgcaaaacaacaaacatagtgtgaagcaatacaaacatgtacactaaatctggcttcatgcttaactacagtaaaaaagaattgccaaactgccaatacatttttttttgagatggagtcctactctgtcaccgaggctggagtgcagtggcattgtgttggctcactgcaacctccatctcctgggttcaagcaattcccctgcctcagcctccctagtcgctgggattacaggcacccaccaccacgccctgctagttttcatattttcagtagagacagggtttcaccatgttggccaggctaatctcgaactcctgacctcaggtgcctcagcctcccaaagtgctgggataacaggcatgagccaccatgcccggcctgcgtttttttataatatttattttattttaatcaggactgagagctttaactatgaaaatgttaattagccaaatttctccaattgtctatcaggttttaaagaatgctttactatctaaactttttcaactttctattttgtctgtatgtgcatgaagatagacacacagagaaacagaaaaaaattacatgtgacttacacagattatccatgacatgcctgggctttctgttcagtcccagattttttcttccttcttttttcgcctcctcctcctcccccttctcctccccctcctcctcctttccctcctcctcctcctttcttcttttctttcttaccattttactgtaggccaaaagaatttaccatacaagattctttctcatacaaaattagcttttctttataaccttccttaccaaaaatacatcttcatatatataacttttttcacatctctctcccttacttactgattcctactgccttgtttcataaataatctttttaaaggtgtaatttgaactaacttttagataacttctgaattagacaaaattactgtttttctaatacatcttttggcacatttatatacagaattactattaactataattcttatccttagtaaccttaaattttagtgaaaccctaaaaagcaagaaatcctgaactatcagatatgaacattttatatagttaagaacagttccacaattttcagaaacatattttcctatatcacaaagcttttttaattggaagcaacctgcatatctaatgagcatcaaaaataatttccagattttaaattacacaaaaagtttacctaaaacatcccatttacatgtactcaattctttcatttttagcagtttatctagattacttctgaaaactgagagattaaacaccatcatttaaagttagtaatttccttcttaacaattttataatctgtgaatatcagatgttcactgaaataagaaccttaaagttaactacatgggcattgtcactaataactcagaagattcagctgttttcattaaaccaataacagtctgacttatcaaaaaatttgcatgaagatcattttgttttggccagctttatagttttataaccttccatgccaaaccctgacatctcaaaatatctcccagagacaaatataaaaaccagacaaaaatatatgctgacaattctgaagacattcctgttttcattttaccaaccattttaaagcaagctagtaaagatttacttaagtcacatgaacttgaaaatagcttggacttaatttacttaatgtatgagtgctcttttatttatttttattttattttatttatttaattttttttttgagatggagtcttgctctgttgcccaggctggagtacagtggcgccatctcagctcactgcaagctccgcctcccgggttcatgccattctcctgcctcagccgcctgaatagctgggactacaggcgtccgccaccacacccggctaattttttgtatttttagtagagacggggtttcaccatgttagccaggatggtcttgatctcctgaccttgtgatctgcccgcttcggcctcccaaagtgctgggattacaggcatgagccacaatgcccggcctgagtgctcttttatttataagccaatttggtagacacaacatataacaataagtgtacatacaaataaacacatatagatatgcgtacacacacaaagatccaatagcttttaccttagagctctagcaatgagatagcaatacaaacatactggttttacatggttacacttcttttgccccagtaggtaatctggtgaaggctgtgaaccaaaattttgggtagtttccatagcagtttgattttcaaaggcccaacctccccagactccaaagaacattgtggccaaacagcaccaaaggagagcaccacatactaagcaggctcaaccctgcttagaacagcagcacagaaacctggatacatgcaactccaacccactttcccatttaacagcaaactccacattccaaacgatattgtggccaaacggtattgcaaaagaatatcaagtttatggccaggcgcagtggctcacacctgtaatcccagcactttgggaggccaaggtgggtggatcacctgaggtcaggagttcaagaccagcctggcaaacatggtgaaaccctgtctctactaaaaatacaaaaattgccgggtgtagtggctgcgcctgtaatcccagctactcgggaggctgaggcaggagaatcgcttgaacccgggaggcagaggttgcagtgagacaagattgtgccactgcactccagcctagttgacagagcaaggctctgtcttaaaaaaaaaaaaaaaaatcaagtttaccaaattctaatttcccatgactatatcagacacacacacacaatcgccagaacacaatccagttgctgctgcaacaaacaagccccaagtgtccaaactgaaacagttggggtgcttcctttctccatcggttaggcttttggtttttgcaaacaaaaattccttaggaatttcccaaattgagaggagctgatcctgctgtctggtacctacaaaagacatgcacttgcccgcacaccacacaattacaaacaagcccccaagagtatccatactgaaacaacagtcagggtgctcccccatcaagctctttgcagggcttgttcaacctgcaaatggaaattcctttaaaattttcccaaactgagaggagcagatcctgctatatgggcccaaaaaggacatgcacctctttggatgtagaggtgcttctaggaaggggcttcttccaaggcaatcaggaatgcagtcggggccagctaaggcaaagccaaagagagatggaaactcgcttccagccaaaagtgggcaggcagcttaggagggcttctgagaccccaggtccaaggcagcggaaccacaaacaacacattcctggtcagggaaccaaaatctgttaccaaaacaccaggggtttggtgtaggttctgctgctcaccacacagaaaaccaatcactgagacaagtattgctacagaaaaaggctataatcgggtgctgcagccgaggaaatgggagctcagtctcaaatccatctccctgactgactaaaactaggggtttatacagcagggaagaaaagtaacagtgtgtgggaaaacaggaactagggaggggcaaggaggcatctgggggggtgatgtgatgagtttcagttctttgatacttcctgaaagtcctttcctgaggaaggaacttgcatcaagcaaatacaagtttcagacttcaacagcagaaggatccatttctatgtttatgcaaaaacaactgtctgtggcactattgggtaggtttcaagtgtcttgtgtgtgtggtgtgtgttgtgtgtgttttgcatgcatgatatgtgttttgtgttgtgtgtgcatgttttttgttgtgtatatgttgtgtgtgttgtacgtgcatggtgtgttttgtatatgttgtgtgtgcgtggtgtgtattgtatatgttgtgtgcattgtgagtgatgtgcgtgcgtagggtgtgttgcatgtgtgtgttgagtgttgtgtgtgtgtggtgtgcactgaatgcatatgttgtgtgtggtatgtgttgaacatgtatgatgtgtgttgtgcgtgcatgttttgtgtgttatgtatagtatatgttatgtgtgtagtgtgcatgacgtgttttgtgtgtgttgtgtctattgtgtgtgcatgtagtgcatggtgcatgtgtatattgtttgtgtgcatggtgtgtgttgcatgtgtatgttgtgttgcacgtgcatgtgtgtgcatagggtgtgttgcatgtgtgcatcgtgtgtggtttcactgcctttctctgcatcagcgtccctctttgtgggctctggctggaatgggcagcccagggccccaggttgcatgtggcagtgtgttcacatggagaggcctagtgtctgcactaagggaggattctggctgccctggcctggaggcacaggctgagtccccactgagccagacagacgttctgggaggcctccttgtggagctgctagtctggttaaaaagatgccatttatacaagtgcagcagaggactcagattgctagaaagcagctcagagggcgctggggccttcagcagggaagaggccctgtgctggccaggtggaaagggatctgcgccgcctggtgtgagagtgcagctgttctgtacacaggaggccatgaggggcagccagggtgaccaccggacggtcttgggaccctccaccagcagcaacttgggcccagcgggaagaatgaagagtcgccctaagcaagcaggattttgaaggagctagatgtgagacaacagaaataataatttgggggaaattagtcacttcataattgtctgcaagtccctgctctcccaatagttccctttctctggctgccttctttctcctgcttttggcaggacattagcaggctctgaagctgcctaggcccgcaggagagccttgggtcacacaatcctaggtggtttgcaccaggaggtgaaggcggaggaccacaatctcgccctgaaaatctgcagggaattgagaatccttacacagcaagccaacgctggctcttctgtgcatccccccgtggtcctgcagcagcctcttgagtgctgggaagcacagctgtgctggacccccacagtggggaggagccactgcaggcagaggcctggcctgctgcagggccagggagcagagctgtgggcagcactgcactgcctggtaccacacaccatctgggcaggtcgtggggagctggctctggaaggaggaaggctgccctgccttcccagattccagaaggactccccaagtgctagagacagtggtggactttgttcagctttctccctggggtcctggtgtgtctggagttggttcccgcccggtgggtttgtggtcttgctgacttcaagaatgaagccacagacttttgcggtgagtgttacagcacttaaagatggcacgggtgagcggtagcaaaagagcgaaaggacaatgcttccacagcatggaacaggacccaagggggttgcagcttctggttgctggtggccagcttttattcccttattgtccccgcccatgttctgtttctgtcctatcggagtgcccttttttcaatcctccccattattggctacttttagaatcctgctgattggtgcgttttacagagcactgattagtgcattttacaatcctcttgtaagacaggaaagttccccaagtccgcactcgacccaggaagtccagctggcatcacctctcactggctgagagcctgcagacccccagcagtgagcactgtgagctaggccaaggccagggtggctgtgggattgtcatggaaaaataatgtgaatgtagtgagagatatggattaatgctctaagcatcagaaatgatctttgaatttattttaagagacgtcttgggagctgttggagtactgtaagggaagctgggcttgggagccacacagacgctgggcttggaccccagctgtaccactcactgtgacagactgacaggtgacctaattctctgcggcagacttctcatccgtaaaatcaggaagataacatgattccaagggcgttcatgaggattaaaggaagtcatgctcctaatttactgcctggcacacagacagtaaaatgctcaatacatttatggaaggaatgaaggactctggcagaaaaacaggtcagatgtgtctgctgtggacaggtggctctgtcggtgcccggtgagtgccctgggagtctggcagtcacctcctccgcagccgtgtccccaggctcacaggagccacctcaggtgggaagctctctgccagccttggaagaccagactcacagctccaagccacgtgtgagcaggagtgctgcatcccagaaagtgtctgcctcagcaggctggagattgggatcccctatgaaatggtggtgtgtgggcactaagaaaggagattggctctgtttcagagacttttaaaattcactgttactggtttttattattaccaaagtaatgtatgctgattatagaaattttaccaaaaaaatcattccaaatctccaacccagaaacaattgctatgaacattttggtgtgtattggctagctttggttctgtgtatatgctttttttatgaatgaagtagagctcacagtgtacgctttatttcatgacctgttttcccccacttaataatatattgtgggattcactggatgtcactaaatatttctcaacaatattattttcatggctacatgttagtccatcatacagatatgtcatactatttgtaatcaatatactattgttgaccatctaggttgtttttaattttctagtattttaagccacattgtaatgagtattcttctccacatatatttgtgtgtgtgtgtgtgtgtgtgtgtatatatatatatatatatatatatatatagagagagagagagagagagagagagagagagagaaagattccaaaaatataattattttcttttttctttttttttgagatggagtttcgctcttgttgcccaggctggagtgcaatggcacgatcttggctcactgcaacctccacctcctgggttcaagtgattctcctgccttagcctcctgagtagctgggactacaggcatgcaccaccatgcacggctaattttgtatttttggtagagatggggttactccatgttggtcaggctggtctcgaactcctaacctcaggtgatctgcccacctctgcctcccaaagtgctgtgattacaggcgtgagccaccgcacccagcctccataattattttctgaagacaaacttccagaaatgggtttggtgtatcaaagtgtatataaatttgaaggtttctgatataaatttgaatgagattttgactgtagtttttttaaccatgtgctttgaatccctaaaacaggattatcttctattttcaatcacttattagagctgttgtgtttatgttaggaaaatatacaatatcataaataacataccttacaaaacaatagaagcatttcatatttttagcattgcacatgactatgactttgaaaagaaaaaagaacaagtgtcaaaacggaataggaaaagattacccatcacctctcttcccagttagatcaatttgtaacattttagcatactgtatttccttccagatttttgttttctgtgcatttagtcatagctgggatcaccctgtagcctcccttccatatttctgctggtatgatttgtgagtggggtgaagtgctaggcttgtctctgtcaactttatgacggcggggcctgtgtttgaccctccttatgtctgacatcggattagcactggcctgagcaggttatctaatctggagcctgagttttctcacctctaaaatgggactaatgatactctgtgaatggagatattgaatggacagcttctagtccagtatttggcacatagtgaatacttaatccatgtttaatctttctccagcttccgctaaggaccatcactgatggttatgatgtaaggctgaggtcaccattccaaatatcaagaactggtcaggaactgtgagggtggaaaaggtacaggaaattagcccacttaagtaatgatccctggatagtaactgaagtttttgaacaaattcttaatagcacttttattatttttacttttttaatgaaaatggacagtgtacaaaatttaagcttctttctgctgaactcaattccatttctctttttaaatctctgtagctgaggggaaaatatgtcttacaaacagtttgaagagatgtgttaaagcatttgtgcatagaagtgttttgggcattggtaaaaaagaaaaaagaattgaaaagttcaccagtctgacacttaacacagcaagattccattatttgtctgttaaaatagatttattattattattattagcttcttggtgagttttagaaccctagaaggtgcaatccagctagcattttgtgcactgggaaagaacttcccagttctgcaggatggtgagctgacttgaaaaactcttgctataaaaccctagttatgctgaataaaaaacaacaaaagttaccttaaatgtacagctaaactcgtaggaatcaaagtgggaggccctgaagaggagagttgaggatcccacagtgattctgcaaccggtagggaggagatggagattcagcctgggaaacacagcagctggagtcattatccacttgggaacagattgggacccatgcaaggcttagcgatggagctaaagaccttactcaaacctgagaccctccgagaactcagtggaagagtgggttgttttttcccttaattcttactatctttgaattattggtaaaggaaaaattctccccttgagaatttgaaatcttagacatgtacctcacacagatatagggttcagatttacatcaactcacacagtctgcaaattgggaaatttacaaattgagaaataatctaaaatttggttcctatttagtgatacagggcatttgagaaagttatatatccagcaggtgttcaaaaaggagaaaatagactaagacaatatttgaaaaatgaatggatacagattttccaaaatgaaggagagatgtgaatcttcaacaataacagtgtgccactcatgatggtgtggaacaccaaagaccaagtagacaatatttaaagcaatgagagagatgtatgggtgggggcagatgacccaccaaaggatactagaccgaaaacctgcttattagcagtattgagaggtgacagagtgctggcagtcctcacagccctcgctcgctcttggcgcctcctctgcgtgggctcccattttggcggcacttgaggaggccttcagcccaccactgcggtgtgggagcccctttctgggctggccaaggccggagcccactccctcagcttgcagggaggtgtggagggagaggcgcgagcgggaaccagggctgtgtgcggcgcttgcgggccagctggagttcggtgggcgtgggcttggcgggcccggcactcggagcagccggccggccctgccggccccgggcaatgagggaattagcacccgggccagcggctgcagagggtgtactgggttccccagcagtgccagcccacccgcgctgcactagatttctcactgggccttagctgccttcccgcggggcaggcctcgggactgcagcccgccatgcctgagccttcccccgcctccatggattcctgtgcagcccgagcctcccagatgagcgccaccccgtgctccacagcgcccagtcccatcgaccacccaagggctgaggagtgcgagcacatggcgcgggactggcaggcagctccacctgcagccccggtgcgggatccactgggtgaagccagctgggctcccgagtctggtggggacgtggagaatctttatgtctagctcagggattgtaaatacaccaatcagcactctgtatctagctcaaggtttgtaaacacaccagtcagcaccctgtgtctagctcagggtttgtgagtgcaccaatcgacactctgtatctagctgctctggtggggccttggagaacctttgtgtccatactctgcatctaactaatctgatggggacgaggcgaacctttgtatctagctcagggattgtaaacgcaccaatcagcgccctgtcaaaacaggccactgggctctaccaatcagcaggatgtgggtggggccagataagagaataaaagcaggctgcctgcgctagcactggcaacctgcttgggtccccttccacactgtggaagctttattctttcgctctttgcaataaatcttgctactgctcactctttgggtccatgctgcttttaagagctgtaacgctcaccgcgaaggtctgtagcttcactcctgaagccagcgagaccacgagcccaccgggaggaacaaacaactccagatgcgctgccttaagagctgtaacactcacggggaaggtctgcagcttcactcctgagccagcgagaccacgaaccgggcgggaacaccagaaggaagaaactccgaacctatccgaccatcagaaggaacaaactccagacgcgccaccttaagagctgtaacactcaccgcgagggtctgcggcttcattcttaaagtcagtgagaccaagaacccaccaattctggacacagtatcagtgcaagccaggagagaatgcaacaactttaaagtattaaggattatttagctgaataaagtattattcaagagtgaggttaaagtacagacatcggccaggttcagtacatcacacctgtaatcccagcactttgggaggctgaggtgggtagataacatgaggccagggattcgagaccagcctggccagcatggcaaaacgccgtctctactaaaaatgcaaaaataaggcaggcgtgattgtgcacatctgtaatcccaactattcgggaggctgaggcaggggaatcgtttgaatcctggaggcggaggttgcagtgagctgagatagcgtcagtgcactccagtctgggcaacagagcaagactgttcaaaaacaaaacaaaacaaaaatagacatcaaggctgctctcttttccagtacaagcctaaggctatatattttcctccaagcagttcaagttgcattctaacagttttttaatcattttaattatcattcagtttgaatattttctaattttaattgaaatttctttttgacccatgagttattgagaagtgtattaattttcaaatatacacagatattctaatcaactttttaaaaaatttctggcatatttgtattaggatatagaaaaattttgtatgatttcaaccctttgaaaccttttgaaactgcattgactttcacaataattttagtgtttcatatgtacttaaaaagaatgtgtattttcttcttgttgggtgcagaatttcatttaggtcaaatctctctgtctttgtctgcttgttttatcagttgctaaggaaagtatgcctaaatctttcagtaggatttttatttttttctatttgctttatgtatttagaggctatcttaatagaagcatacaaatttagattttgttatcttatgtattagcctttatcattattaaatgtttttctttttctctggtaatgcattttgtcttaaagtctactttgacataaattcagctattctagctttgttttggctagagtctgtaggacatatcttttttggttcttttattttttaattttttgttggtttgtttttgagatggagtcttgctgttacccaggctggagtgcaatggtgtgatcttggctgtcactgcagcctctgcctcccaggttcaagcaattctcctgcctcatccccctgagtagatgggactataggcaccaccgcacctggctaatttttgtatttttagtagagatggggtttcaccatgttggccaggctggtgttgaactcgtgacctcaggtgatccacctgcctctggctcccaaagtgctgggatacaggcatgagccaccacgcttggcctgttcttttatatttaacctttctgtggctttagatatgtctcataaacagcaagtgagtgaattttttaatccaagataataacctttgtcttttaattggaatatttagttcatttatgtgcaacacaactagtaatatatttgggtttaaatcttccatcttaataatctttacatttgtcccccatattttgaattgcttttttattcctttttcacttttcctggcttggccattttatatttttccatttttaagtcttttgttagcttgaaatgtatacactcttattattattttagtgtttatcttagaaattaaatcatgtgggcagacctatcttataaaagccaaatataaatcaatataaatcaggacttttaacatcttcccagaccatgcatttaccccttcctgacttataggccattgttttcatagatttaattctctacatttttttcaccatatattttttggtccaataagacgttgttttgtaaagttcatgttcatttatgttttcccatatacttgcatcttcatcgctcttcattgcttcctgaatctccaccttcctgtcggggatccttctcttttctgccaggataaagaaacctagtgttttccttaaggagattgattctttctggagtgttttccttctggagatggattctttcagtgtttgtttttgttttcttcttatctgaaaatgcctttttaaatcttaattccttgcattttgtgtatagaagtggactctttatagatgccattacattgtgttctgatttccattgcttctgttgaaacatcagctgttctaacttctgcacttcagagtcagcctgactcctcctcggactccacacagcattttatctgtgtctggtgtttcagcagtcttaaagatgtgcccagatgtggttatttgaaattttactcagcttacagtccatagggattcttggattcatggcttgatgtctgtcacttattttggaaaattctcagccattcttttcaaacattgcttccagcattccctctgtctcatcttttgggactgtaattacatggaaacttccctgtgaatgaatgtgcagcatctctcgccttctcctctgtgcttgctgtccttttgtctctgtctgtttttctctgaatctttctgtctgacctctcttctttattcagctgtacctaatatgttgttaaacatattcattgagtttgtttccagttattgaatactttgactcaagagcttccgtttgtttctttcctggagtttttacttctccattgagatagtcaaccttgccttctacctccgtgagcccgcgagtatattagtgctaacgtttgtgtttagcgacgccatcatctggacctcttgtggatctgcagctattgaagttacctcctgttgtgcatgttgcctctcctccacatgtgcctggttatattttatttggttatgaataaagtatctgcagaatactttatgacaataatttttggcttatgatgatattatctttctccagagaggatttatatttgcttctgccaaggaactctgagaactagcaattaaggttacttcggtccaatttctaattatttagagctgagccacgtcctgcaggggcctctccatgtagaactcgcccatgcttctagcttacagccatgcgtagtcccaccacaaagtgagatctccactgtcaccccttggggcactcttgcatccagttgctctcaccccagccccttgaagttattaaaagtattattcaccttttttttttttttttttgagacagagtcttgctgtgttcgcccaggctggagtgcagtggcgcgatctcggcttactgcaacctccgcctcccaggttcaagcaattctcctgcctcagcctcctgagtagctgggattacaggcgcccgccaccatgcccagctaatttttgtatttttagtagagacggggtttcaccatgttggttaggctggtctcgaacccctgacctcatgatccacctgcctcggcctcccaaagtgctgggattacaggcatgagccaccacgcccagcctattcagcctttcaaccatacttctgtttcatcaggaatgggcaccctggctccccaggcaaggcagccctgcacactcggcttacctgcctgtgcccgttccctctgtgtcctaacctggctgttcttcgcattttagtagccgtctcgtgtcttgaagtgcatgtgttttatattttgtctagtttttctaactgttctccactagtgaattttttgaattatagactgccattaccaaaagcagaagtcacttatcgttatatttttaagacctctgttgctgtgtatattttcagtcctttgattctctctgtagtccatgatgtgcatctcccacattttatcaattattccagtgataaatacctggattgccttcaactgtctactggcacaatcagtatcacaaaaaatctagtgttgtaaatgtcccattgtaaactgtgtcagaattttggtggatgcctatccaggaagagactgctgggccttagagaatacctgcatttgttttaattaaatgctacccagtgactttttcagagtgtgcgcaccagtatactctccaccaacagcatgagacgtcctgcatcccccataccaccaccaaaacccagaatcttccaactttgtaattttcttcaagtctattggatgtaaagtgacaagtcatcattttaatttgcatttctccaattacaatctttctgtttgggtttctgtctttttcttgttgatttgcaagagctccttttatattttgaatatattattctttgttggatataaatattgcaaatatattctcacagtctgtcagctaactgccatcttatcttttactgcataaaaatcgagcaatcactattgctggtttatggcttctgccttgtgctattactaaagaagtcactgcccttatttatcttatattatgaacttttaattttatacatttctattcatgtacaaggctttaggtcaagtggagcccccttttgtgtgtgttgatggggatccagcttccctttccccacaaggcttttattgttcagctcgttttgctattatgaatacaaccttctagcaggttgttattgctggtgtaatttaaaaaatactttaaagcatctatctgaactctcttactagttctcatagtttgatgcttttgttatgtattttttttcttggtagatgattaggtcatttctaaattgtgacttctttttctcctataatccagtgccttttgtttcttgtgcttcacttacagcataagcaagatctctggcttcctggtaaacagcagcaggcatcacgtgcattcttctctggttttctgtcttgaagcaaacccatcttaactttctccattacatagagtgtgcgccgcggattttggcaataacctttgtgaagttaagatagtttctatgttgagcagttctaatcctaattctgcaaggttgaagctggtaatgagtgcatagactgtattttctgccttcgtatatggcctgttctgctttaatgcttgttttgaaaactcaaatttgttccaaaatgattgatgtgttagggaaccgtttgagtataatgcaaatttcatgttagcttatgtgcaatttcatccactagaaacaccaggtgaatgcagaatactgcccccacttaatgcagaatattgccccccatgtgccccaagagtggagctgcataggaacacacagacgcacacctcccccaggagcagagcttcgtaggaacacacagacgcacacctgggatagtgtccagctatacatggattcactctgtgtgtcatgagccacaccaccacttctggagtcacagcttgcctctgacctcagagaccccttctttcaccacttcccactaactcataagctcttgatgcccacttctacatgcaaatcacaagtctttttcacatagtgccatacttattgtagtatttatatatttcctaaccttttagcatgtgtaaaattgtgctatcattgttaacatgaatggactttattttttcaagcagttttaggtttatagaaaaatgaagcagagagtacagagtgttcctataaacccctcaccctgtcaccagttattaacatcttggttagtctggtgtgttggttagggttcactttgtgtgtttatatcctatgagatttgacaaatgtgtaatgacaggtgtctaccatccagtaccatacagagaaatttcagtgccctaatgatcccctgcactccacctattctccccgcacctttggccactgataattttttcccttcttcgtggttttgcctcttctgtaatgtcatgtagttgaaatcccacagtgcacagcgttttcagatgggcttctttcacttaccagtatgcatttgggtttcctctgtgtcttttatggcttcatagctccatagctcctttttctctcttgctgaataatttgtcgttgtgtatatgtatcacagtttgtttatccattcacctactgtaggacatcttggttgctttcaagtttgtcagtaatgaataaagctgctataaacatttgtgtacacgttttgtgtgaacatgttttcgactcgtttgggtaaataccaaggagtgtgattgctggatcatatggtaagactagatttagtttcataagaaactgacaaactgtgttccaaagtggctgcaccattttgcattcccgcaagccatggatgagagctcctgttgttccacatcctcatcagcaattggggttgtctgtgttttggatgtaaccattctaatagatgtgtagtggtggctctttattattttaacttccaattccctaatgacatacctgtatatcttctttggtgagatgtttgttcagacctttggctcattttttaattgagttgttttcttataattgagggtttttttgttttttcttttttttttttttttgagacggagtctcgctctgttgccctggctggagtgcagtggcgcgatcttggctcactgcaattctcctgggttcacgcccattctcctgactcagccttccaactagctgggactacaggcgcccgccaccacgcctggctaattttttttgtatttttagtagagacggggttttaccatgttagccaggatggtctcgatctcctgaccttgtgatccgcccgccttggcctcccaaagtgctgggattacaggcatgagccactgtgcccggccataatcgagttttaagagtcgtgtatttttgataccaggtctttatcatacatgttttgtaaatcttctctttcagtctgtggcttttcttttcattctcttaatgtgctaacattttgaataaactcctatctttttgtagatgtgttactaaccaagtttttgagtgttgtttccctaacccatttttcctaaatcttgcattttttgttgcatgattttacatggcatggtgcttttttgttttgttttgttttgttttttgagatggagttttgctcttgtcgcccaggctggagtgcagtggcacgatcttggctcactgcaacctctgccttttgggttcaagcgattcccctgcctcagcctcctgagtagctgggaccacaggtgcacaccaccacacctaccacacctggctaatgtttgtatttttagtagaggcagggtttcaccatgttggccaggctggtcttgaactcttgacctcaggtgatccacctgcctcggcctcccaaaatgggattacaggcgtaagccaccactcccagccagcatagtgctttttaagatcatatttattctgttacagcagaactacctgtatttaggaatttccataataaaatgttttcagtgttttaaataaaaagataaaaaagaagaaagttcttttttgctagaaggtgtttcttgtaatgaaggattaaactttttaaagtgctttttcagccttcattataatgtcttataatttatttcctcttttgtctattattgtggtgaacttcactgatctcatggggaccaaccttgtatttctggataaacccctatttaagtatgatacattattttcaatgcactgttgtatttgattagctaatattttgttcgggattttgtatctattttcataagtgagatgggaatctgactttttttgttgtgtttcttttgtcttattttggaatcaagattgcactagcctcaagttgggcattgttttgttctttttctattttctgaagcaacttgtaaagatgtgaatgaatgattctttcaaagattgatggccttctgtacaaaaccatctgagccaagagatttaggaagggaagggtttttctttttttaactaccattttaatttcttaagtctttgttcactcagattttctcttatgccaattttaccattatgtgtacatttttaggagttgacgtattttatctaggttttcagatttagaattgaatgagaaactgaagcaagccacagtcataattcaagggaaatgtataaaccttaaaatatataagctttaaaataagtagagaaaggcaaagccaaaaaaaagcctattataaaggaaaagattaataaatttgataacattaaaatgtaaacctgtgcttcaaaaaattttccaaacagtgtgccttctcacagactggggagtagtggcggacttagtagactaagtcacagactaggaaatatatttaaaatatcttacgagtgacaaaggattgatgtaaagaacatattaagaactgaagatggggccaggcacagtggctcacacctgtgatcccagcactttgggaggctgaggcggtggctcacttggggtcaggagtatgagaccagccttgccaacatgacgaaaccccatctctacaaaaatacaaactttagccgggcgtggcagtgcatgcctgtaatcccagctactcgggaggctgaggcaagagaatatcttgaacctaggaggcggaagttgcagtgagctgagattgcaccactgcactccagcctgggcgacagagtgagactgtgtctcaaaaaaaaaaaaaaaaaaaaaaaaaacagaaagagctgaagatggataacgggaagacggataacataacactgggcatgtgatgcaaatgggcagttcttagaagaggaacctgaataatcaatgaatatgtgaacaaatgttcaacctaactgccaatcgagaagcaacaagagaaaccattccatacccttcacattggcagatgcgttgtgtgaatgccaagtattggtgaggatgtacagggtccagaattcttataaatggtgagtaaatgtaaatttatacagatacttcagaggttagtttggcagtatctagtaaagtcgaacatgattctctatgtatcctagataaactcttccatgtatgcatagcaggcagctgtgtgctgaggcttcgaggttatacccaagaaacatggaaacggcagacttcagaaggatacatgtaggacgatcatatttgtgtaaatctacaagacacaaataatagtacataacagtacaccttaggatatgtgcatatttagtaagattatagaaaatgcatgagaatagtacagaacaatttaagcacagagatttgcctctggagaggaagctagggaggtaacatgaggggcaaggcttcagctccactggtaatattttgggagataagcaataaatatgccaaaatgctggcatttgtttaatctctgggatggctacgtcggaatactttcttttctattttctgtacttttttgtatgtttagtttacgtttattgaacaaatacttactgagaatctactggctgcagggctctgttctggatgcttggagtacagtggtaaacaaggtgcacgcaatgccctgtcttcatggagcttgccgactttaaaatgtttaaaaatttaaaagctttaatgctcaaaataatttttgaaaagattaatatgtagctaatctctttactcctggaattagacacttaaaaagctgtgaggggccgggcgcggtggctcatgcctgtaatcccagcactttgggaggccgaggcaggcagatcacgaggtcaggagatcgagaccatcctggctaacacggtgaaaccccatctactaaaaatacaaaaaaattagctgggcgtagtggctcacgcctgtaattccagcactttgggaggccgaggcgggcggatcacgaggtcaggagatcgagaccgtcctggctaacacagtgaaaccccatctctactaaaaatacaaaaaattagctgggcgtgttggcaggcacctgtagtcctagctacttcagaggctgaagcaggagaatgtcgtgaacccgggaggcggagcttgcagtgagccgagatcgcaccactgcactccagcctgggcgacagagcgagactccgtctcaaaaaaaaaaaaaaaaaaaaaaaaaaaaaaaagggttgtgggggctgggggtgaaggagagctcactgctctttgtaaaatcagcctccgctgctggaacggacagtctgaatgaactgttggtcggcttcctatattagtttttcaacattgttggtttacacttctgagttcatagaatgagcaccctagccctatggttttgtaagtagtcacctaaagggaactgttttaatgaataaacagggatggcttttaattactacatttgctgaatagatatttttgcaccccaactttgtgcaagacactaggatagggactgttcggacaagagggcaacaagcaaagatccctgctctgggaggtcccgcagtgcctctggtatgaacagcgttagtaacagtgaccttgacgatggggcattcgctgttctacctcaggcatcaactctctaaagcactgagccatgacgaggccaggggaatggaggaccatcccgcacgcactctgtacccagaggtccaggtcatgccgtaagacacaccccctctgcacctcagttcctgatttataaaacaatggccattcctgttccacactgtttctgtatgaagtgaaatgatctacatgaatgctcctggcacatgatgaccactcagtggattccagtttcttccttcttgatcgtgacacgcatctctcgtcatttctgcagtattccctgaagcttctttaagcagagttctggccaaggcagagacccttagtaagcaccagttgatgggaaggcacaattcactgggtccctagatgcaccaggctgagttgcctgtggacaggtgggtgaaaatctggaagcttctctgtccatacttgcctgtcaatgaggaagaagatggccccgcagtacgtgaggtcagcctgagtgacactcctgttaagatagggataatcctttctgatctctcatttagtctgccttgctttggatagtatgtgatggcagttgctagaccgagcctgaaatgcagaaatgccagggcaaagatgacatctgacaacatagcctagatatgtcagtcagctaatgacttcagatcagtcttctgggaagtaggcttttctgaaatcgatgggcttaattagaaagaacttaactagggtaactgggtaataacgacctggaaatatttatacagggacccttcacaagttttcaccgaaacaggacttttaaaaaaatcctaagccttcagcagccaaaggagcatctttggttgggagagatggggataggaggatcttcactccctacatagagcccctgcacaccctggggacaccagacccacctctgggaaagataagaaagggaggaagctgggccagtgtggtgcaggccttccatatgcctatggaatcaaggaatctctgttagttggtgtgttttgttttgttttggggtttttttgagacggagtctcactctgtcgctcgggctggagtgcaatggcacgatctcgactcactgcaagctccacctccagggttcatgccattctcctgcctcagcttcccgagtagctgggactacaggcccccgccaccatgcttgtctaattttttgtatttttagtagagacggggtttaaccgtgttagccaggatggtctcaatcacctgacttcatgatccccctgccttggcctcccaaagtgctgggattacaggcgtgagccaccgcacccagccctctctgttttttaaaccacattcggaagtatttcactccctaattgtcttttcctcaaagtaaggagacagccactgggaggtgaatgggtggccaagcccacttggtggcagagtgcggccctccttgtcacacagcccggcctcgatggtccttccaggcctgacccggccgtgagcgcctgccatcctcagccctctttctagggtgtggtgtctctgtcccaccccggcctcacagaactcaggtccagatctctgtgaatgatggagaggatgaagaatagtctgccctggggacacaacacactttggctgaacccttctggcaaccacatctctgctgttttatttactccagtgtctggtgtgggcaaatagcttgcaggtggctttgtggctgccccatggcaggtacaggagcaaccccattccctcctccaaagtttggtttggatgtggagaaggataacaccacacacacaccaggagggtggggaaagcttgtggttggtgccctggggctttctgtgagagcagggcagactgcagcccagctggaacagctgcagcaaagggggccctgggtggctgagtatggctgagggctgtatggtggtgaggagggagccagggtgagagtcctgccacccctcgcctggggtttgcattgattttgcagttatggggcaagagaggaagaggatggggctggaagccatccgcagtcagcagtgggctgatatctgtcacgctctgggggcagagctgacttgactgtgtcctgtgagggacacagcagcagcctgaagagggctcggcctcattcctcacatccaggtagaaatcgggaagtgcagccagggtaagccctccccggtgagctaccgatgacatggggtgtcccacacagggctgccctccagcagcagggccctcccacaacagccactccctgccgtcctcaggctcccatggggctccaagtcccagctttctcctgacatgggagactgcccagtcctgttctgtgttgaagtgcgcctctgggggtcatttacttgcatctgagatctgtgagtgagatttctatatgttaagaaaagctgggaccctggagatgcttcccaggctgccctagtcttcccagtcccaggggcttggccacgtaccccgcagcgtgcagaagatgcaggggagctggcctgtgtcctcaggtgggaggggaggggcgggagtgcccagcgccccaggggccaggctgtgtgggcactggggggagatgcgccgtggaccacagggacccgtggtgctgggcagcttcccggcaaaaggtctggaaggtgtgtctgtagtagacagaattctcaggatgctcccaaaacctctgcccactggttagccagacacaaatctaggaacttcctgcaagggactttgcagataggactgaggttgctaatgagctgaccttaacatagggagatagttctggattatctgggtaggtccagcataatcatatgagcccttaaaagcagccgaagaagccaggagaggagctaagagagattgaaagagaaggaactcaacccaccattgtggggaggagacctgttccccgccattggtcatccttggaagatggtaatagcccctgggcatcacaaggcaattcagccacccagggacctcagtccgacagcactctggaactacatctgcctgtaatctgaatgagactgcgagttgattcagccgcagagcctccagaaagggacacagccgcgatgacaccttaatttaggctctctgtgactccaagcagagaacccactgagccacactgtgcccagccctttgacctacagaaacagataacaaatgtatgtgctgttaagcctctaaatgcagggtaatttgtttcagcagcaataggaaaataatacatgcatccctgcccgtgggagtcacatggcccagggccttagcagcggcccaggagctggctggctgtcagtcactgagaagatgatgagggactgtcagccattagggaatgccatccaggagccgtttgtctactattcactagttagggaatggggagctaatttgcattttaatgctagattctcaccattttcccaaacaggaaatccttccagagtagaatcttagcacttacctaggcatcttttatgcttttggggttctgtgccctatccctctggtcttgcctggactggggagtgggactgttaagcaaagagcagattaggtgaggccacccaccaaagtaccaacacctaggtgcggggagttggtctgaagagaggctgaaagaccaagtccaagtcatgaagggaagcaaaaggccaagtcattggctaagtccgaaggataaaatggggccaaaagtaggccaggtggtcctgctgaacacagttgggtacttgtaagggattgggaggtggactgtaggtaaaattggtcaccctgtggcttaagattgaggcaaggctgtcacaatgacatacatcttccaccaaaatacaaggcatagggtgtaggaaattacagtgaaattgcagaagaaattctaattgaagggatccagcaaagagtaaaggcgtttgtcatggagactgctgtgacattaatttatggacctactatgttctcagtcctctatgtggaagatgtcttcactctagatggtgggcaccattatgatccctgactgtccccagcctctgtgtctattccaaggagcctccagcttctctatccttgtgactggagtcagccagtgcttaaggggaaagtggcccaaatgctgaatttatgtccctgtcctctcctctcctccatcatagccctgcagtttcctctttctttaatatctttctggtaccttcaaatagatagttattactttttcactcaagtttttaagctctccttactttttataggctagggtattttcctcttttttattcattcttcacagatattattttaaaatataaacgtgtttgttgctttttctgattgtgaagctaatatattcatcttggcaaatccaacataacagaaaataattagagttaaattcacctgaaatcctaccatccaaaaatagatactgttaactatttcgtatgcaaccttttgtatatctatgccttttcattgtttgtctttttattattttttcataaataagatcacactctatatactggtttgtaagctactttttaatttaataatatgcttttagtgactttagttttgataaatataaagctaaattattcttttcttttcttttttttttttttttttttttttttttggagacagagtctcgccctatcccccgggctggagtgcaatggcacgatctcagctcactgcaacctccgcttcccaggttcaagtgattctcattgcctcagcctcccaagtagctgtgattacaggcacccaccaccccgcccagctaatttttgtatttttagtagagacagggtttcgccatgttggccaggctagtctcgaactcctgacctcaggtaatccaccagcctcaggctcccaaagtgtcaagattacacgcatgagccaccacacctggcccctaaattattcttttgaattggctacatggtgtttcattatataaatgtaccttaatttattttagtagtcccctaataatgttcaatttgtttgtctgtaatatttttctattagaatcaatgctggaatcaatatacttgtaaatacatacttgtgtgcttttctgagtacttgttttcttaggataaaaccctaaaaatagaacaattggatcaacatatttgttctttgtaaaacttttcttgaagtataatacacatgcataaaagtgcaccaataataaatgtatgttttgatgaattttcacaaagtagatattctcatgcaaccaacatccagatcaagaaatagaacattaccatcacaacagtctctttcttttaaatggagtatttagtccattaacttttaatgtgattattgatatagttgggcttacattggtcattttcctctttttttgtcacatgttctttgtgttactccttttctccttttctgttttgttttggattaattggatcttttttaaaaaaatcctatctttattattggcttatcactattcctttatgttattttataatggttgctctgaagattattttatatatacatgtgtatatatatatcttttcatagtctactaaaagtaatatttaccactttatataaaatgtaagaatcttgcatatgtataatttcatttatccctttcctgttttatggatagagctgtcatttatatgctcatctacatgtactataagccccacaatataatgttatgatttttgctttaaattgctatgtatttttaaagaaattaattttaaaatagtgtgttgtacatacccacagtttaacacttctggtgcttatcattttatcttgaagatcagaatttccatttgtcatcattctcacttttgcctgagcaacttcacttaatgtttcttgtagtaatcatttgctggtcaatgattctcttagctttcatttttctttttttggacagcagacattgtggtggtgtcctgtgggtcaccaccagggacacgcacctccttctttcatttttctgaagatgtatttatttcacttttattattgcaaaatatttttgttgttgtagaattctgagttgacagtttttttctttcagcaattcaaagatgttgttacagtatctctgtctttcattacagtcaactgtcattcaacaaaggtctgtcttgttatgtttctctgtattctgcttgggattcagtgatctccttgaatctgtacatttattctttcaccagatttgtgaaactgttggtcattatgtcttcagaattgtttctgcttcattcactctctcctcatgtatgttagaccatagtattttcccaagtcactaagttgctgttcattattttccaacatttttttctctttttcaaattggatcatttctattcgtctgtcttcaagctgctatttctttcagtatttccaatcttcagttcagcctattcagtaaatatttttattttgatactgtattctccagttctggaatttctatttgattctttgttataatgtccatttctttgccatttcctatttcttcatgctttagaagtatgtgcttctgtatatttttgagcattattataatagtttatctgttgcttcagacacctgcatcgcctaagtgctggtttacactgacttttctcttgggaaccaatcacattttccttttcttcatatgtctagtaaatttcgattgtatgttggctattgaatagtttacagtctttggattctgttgtttctctgaagaggtttttgttttgttttgttttgttttttccgaccttttagcaggaagttaatgtggttgaattaaaacttcacattctacgttcaggttttgtagcctctactaggctgcttggagtattccccataccttcagaattcaggggtcagccagagatttgggcagagctccacacagagctctgtagctcgcctctgcagctctttgttctgagattgtcctccttattgatgcttctaagatcaccttaaaatctttgttctaactgttcaatcagtgacactgtgactgcaggtttctctctgtgttttagccaccccttggtgcctgcctgcaagcagaaagctgtaagggcaggaaactcagccaggggtattcctgtggtttctgcctgctttaggtcattctccagtgccatcagatagccgttttgttgtgcttttttcccagtaggtataattatctgcacagagtttgtctgatagtagccattccactattattagaaacccttaagagaaaataaatattttattcattgagtgattgagagggatatttttttacattctctgacgtgaaattaggttttggatgacgctaatggcctctgtcgaagagcaagcatgtgcttctgtatcagccactttggacagcattgcatgctactaatgtccacattggtggttcctggtagcttccctcaaaactggttaacttagattggtcaggagcccaccagagctgagggggtggggtagagagaagaaacgaagttaggtgggcagcaagctttgatgctgtgggtgaggcagagcaagtgtctctgttgtggctggggttactttgttgtgcacttgggacataatggagggaagctaaagccacatcctgacagagttctacatcttagcgttgcagaggcatttccactttagaaatcaaactcgtgtttatgtgtttaaagcagatccagaatggatggtattttcaagttaatgtctttagaaaaaaagaggtaggcaattattagagcagaggtgtgtgtgttggaaactacacaggtttgaagccacaggacttagggttgtgtctgaattctgctgccattttctctctgagctggtaaagcctttccacactgcagaatttctcttatgtgaagtgaagtcaaataacacagttccacaacagaggagtaaacaaaaatgtttgttgaacctgaatccaaaaggtttagattacattttcttgatagtaaaacaaaatagtccaggcattttagcacacctgaccttttcagcctcatttatcccaaccttagccccttcacccacccttagattatccgaagtttcaccagtgttcaagcccatgcctaggaattttatgggaaatatttgacaaagggataaaagtagcctttagcaaatttgttttatctgtcttaaagtatgcattcatttgaatagacagtgtcagggttggtaggaaaaaggatggtagcagaagagaaaaaaaatgcaatttctgggaagtctgcatgtttccagcaatatttaggacttaagctcccgtgaatatcaggacctcaagcatgtgcttccatatcagccactttggacagcatttcatgctattaatccccccattggtcgttcctggtagcttctctcaaaactggttaactgagattggtcaagagcccatcggagctgatgggggtggggtagagagaggaaatgaggccagatgggcagcaagctttggatgctgtggtaaggagttttgactgtcactctgaagcagctctcaggcagaggaatgatgtgatttattgtagtttaccaaggaccgctcagggtattgtgcagagggaagaccagctggaggttcttgtgtcactccgtgaagtgtgggggcggcggaggggcagagatgggacctgcactggaggtacgtggtggacagatgaaaaatggttggattctggataataaagtaaaggtagggctagctgatggacttgatgataaatatggatgtgaactgaaagaaagacaggcgtcaggataaccaaaattatccttgccaagatttttgttctgagctactgaaagaatgcagttgtctgctactgagatcaggacgcctgtggctgagcagttttgggtgggtggtcaggagttctccttggagggagggtaggggcagcaagggggtcctcctcgtgtaggcagaacagctagagacccagggcaggagaggtgtggagagggttgggcattgagagacagggagcagttttcccctccaaggagaaccttgagatgcatatcaggcatctcagcagaggggcctaggaggcacttagagtggcacggggcaggtgtcacttctttgcctagagcttcctttgaccacccataagaagcctttacaatgactacagtgcagaaatgtgcaaatacccaaaagtgaacgcaagcctggctgtgtcagacaaaagatactgaagttgcaaagccacaggcctcagagtggggatgcctttcactgtgaaatcccatatttctagagcaagaaccaaggcatttttgccaggacttttgtgtgtgtgtgtgttggggggtgggggaggggtgtgatacagagccttgctcttctgcccaggctgaagtgcagtggtgtaaacttggctcactgcaacctccgcctcctgggtcccagtgattctcatgcctcagcctcctgagcagccgggattacaggcacatgccagcaaccccagccagtttttgtatttttagtagaaatggggttctgccatgttcgccaggctggtcttgaactcctgacctcaggtgatccgcccaccttggcctcccaaaatgctgggattagaggcgtgagccaccgcgcctggctatgtgccaggacattcagcagttgactgtggagagcacagtggaaaggaagtctaccaatattttctttacacgtacaaaatgagagatttatgtaaaaaccacaccttcaagatccaggaaaaactattctggttcaagaaaccctaatcactgtgaaaagattcacctcggcagttacctaggactaatgacaactgtgacatcttcagatattacgtgccgagaccaaagaactgccagcttcagaggaggaagcacagggcacgccgcagtgtggatagaggcctggttgtcaggagcagattcaacctaaggtgcccagctctcaccagcctggcaatagatttatttgtatttgtacttaaaaggtgtaattatctattaggcatttctttaaaataatatgctgaagaaagtctgcatgaattttaatccaaactgaagagaagtacaggtctaccaacaaagtggtcagctagagtgtgcactggatatcgagaccagccagcataaaaggccgaatggtgtgctgaaggcctgatgatgcttggatggttacttcaacctaaaactaatatccacatgcccaacccctgtaagctcaaacgttagagtttctcatgcatgattgtcctgatccatttcccttaagtggcttgcacagcagaagggggaaattgtaccattttagaagtctaatttgtttgtttgattgattgattgattgattgattttgagacggagtcttgctctgttgcccagactggagtgcagtggtgcgatcttggctcactgcaacctccacctcctagattaaagcaattctcccacctcagccttccaagcagctgggattacaggcgcatgccgccacacccggctaatttttgtatttttagtagatacgggatttcaccatgttggccagactggtctcaaactcctgagatcaagtgacccacccgcctctgcctcccaaagtgctgagattacaggcgtgagccaccacacccggcctaatttgttttaaataactagctcagctataatctaccatgaacaatgatggtgttttatttggtatttaaataatttttgtaatgaaaattgttaatcatgacatgatttattttattgcagagcattagggtgaaaataatgaaaattttcattaaaggaatatgtgacataacttcattatattatatacagtgttgtattgatttgccaaaacttgtaatttggtaacgatattgcattccttgggtttgtactccaaaagtctgtgatctaaaatgttgagttacaggctggttctgttcagtgaaaaatgaaaatgattacctgaattttgcagcaacctaaacttagaggaacagctgttcacatccctggcatttcacatttgcctaacataacactaccatgtgtcagaaaccatgcttcacttactgctaaatcatgacacagccatgttttatgtaattactttttaaagtaattgtgaccacaaagtcttgtttgtacatgaagacctgacctttgactgatttcccaggttagaaaaagtcctgctggaattttgataggaattgcattaaacctatgcatccatttggaagcaactgaaatctttatccagttgagccctccaatccatgaacacagaatgtctctccatatttagatcctctttgatttctttcagtgctccattattttaaagcaagtcccagacatcatgtaatttgatctgtaaatagcatagtatatgtcttaaaacataaggtctctttctctctgtgccacactttcttctctggcattttaaaagcagtggtctccctgaggtggggattgaaacagatttcttgtaggagtcactgcttttcttggctaaaggctcctcttaccttcagtgagatggcacgacagcaccaaatagccaggggtccttggagggagagtaggggcagcaagggggtcctccttgtgtaggcagaacggctagagacccagggcaggagaggtgtggagagcgatgggcactgagagacggggagcagttttcccctgccctggctgcgggttgcctgagggacctcagcatgtctcacctgtgtgtgagctgcggggcctagatctgtgcggcgcacctaatgatacctgcctcacaggtaggctggagtcacacacacagcagaaggagggttgtatgttctcagaaaaagttattttccccccaccaggaagagaactgggagacgaaggagcctgagagaagttcagtttctcccaggagggcccagacgcaggtctctgcagcagagcgcattcccacttgggactgtagatggctcagggtttctgttgccaaaggaacaaagctctccaaatctgaggttttcagtgagccgtttgtacaacctaaaaattaaaaatctggagctgagatgactaaatgtagtattggatcctgaaacagaaaaaggccatttgggagaacctgaggaaatctgaacaaaatctggacatcagtgactatcagagtcagtgttactccgttcgcatgacaaatgtgccatgctagtgtgagaccttatggtcggggagccctggtgtgggtgcctgggaactctgtgctggttgaccggttgttctgtacatctaaaactgttctttaaaagtctatcaaaaataatctttttaaaaaacaaaagctagtctgggtgcaagtggctcacgcttggaatcccagcactttgggaagccaagggcggatcacctgaggtcaggagttcaagaccagcctagcgaacatggcaaaaccccatctctactaaaaatagaaacaaactcagtccagtgcagagagcccagtgacctggctggccggcaagctttggccccttgtgagcgtgtgaagaaacttcacctctctgggccccagcttcctcatctgtagaatggacacatcatttcgccttccttgttcatgtcgcaaggatgaagtgagaggcccctgtagggccacacccggacacgtatcccagtcccgcagcgcagagccactggggagcctgcacctgccgttttgcccgggcagggaccacatgcatgccagggctccccgggagcctcacctctcaccctccttcttgcttctcactctactccagccactctgcagttcttccatgaccagcagcaaccccaccctcttgcttctgggactagatgctgtccctgttgcctggaacactcttcaccccccttgctaccctgacacctcccaacgtgccccaccaggatctcccaggcctggttgggcctcctgtgcctgtggtttcccagcatcatcacgcaacattatttgtttaactcccttatttcctgccagacccccatcaccttcacattgcatcctcagaaccctgcgtgtgtctgtggcgcatacccaatgggctctggataaatacatttgagtgaattcagaaagcagtgaaccaatgcgcagacgtgaactggaagcacctggctgtttggtgctggatgaacagccaggccgcctgcaccctgcccagtgccccccatgcccagattcctgtttctactccaagactgtatgccagactctttagagaagtttctcaaagggccccaaggccatgtcaaagactgcattgcctgcatttgctggagcagagctcagtaagtcagtactcactttgttaatggcttttgatggacagcagtggatctcaaatttgagcatgcaccagagtcatccagagggctatgcagacacaacctgggggccccaccccagagtttctgattcagtgggtctggggacgggtctcaaggatttgcatctctaccaagttccctaagtgctgctgctggtctggggaccacactttgagaaccactgacttgcagggcagtaggtcagcatgggaaagagatgcataaggaggacattcctccacctctctccctgggtgggcagagctacctgccttcccttgtaaggggaagcagaaaattgtttggctgctgttcaccagaggcaaaggcaccctcactgagcatttatctagaatctagagctcttagctgctgtgctgtctaaacactgttggaatttcagaatgaatcagagactgctgacttgtcttcctataaaaaatttaaaatccaaaatcaagactggcctttgtgttgctgggccatgttgtttttgttcatttattcacctgcatacaccgtggggcacatggtcccatcctttaacgctttcctatgaattagctgtgtgagacccacagtagctttgtaagagagtttgagcccagtctaagcagacaagtgactggctctcccactggctgtttgcacagagcctggatctcctggcttcagtcccggagtccttcccccaccttcaccttcactccctctcccacgaatgcctgctcaaccttccgttcatgcagttgtgaaaccctcaggaaacacctcctcaatcccacaccctgtgctgggagctggaatgtaaaatgatgagtaaaagtactgggagactcatgttgaaactcgcttttcttttctcccaggctgcaaatttgctagatgaacaatcattttgtgaactgctgagaccccagctgggactactgaaaagccaagaaaagtagtgactcctacaagaaatctgttttattcccctcgagagaccattgcttttaaaataccccagaaaagaaagtgtagcagcaagacagagagggagagcaagggaaagagatgccttgccttttaagacatatactatgctattcacggatcaaattatgtgatgtctgggacttgtttaaaatagcagagaactgaaagaaatcaaagaggatctaaatatggagagagattctgtgttcatggatgggagggctcaacagagtaaagatttcagttgtctccgagttgatacataggtttaatgtaattcctatcaaaatctcagcaggatttttttctagctatagacaagattattctaaaatttatatggaaaggcaaaggaacaggaatagctaaaacaggaggccaggggaggaaacaaaaaagaatagctaaaacatttctgaaaagaggaattaagtaagatgaaccactctaccaaatttcaagaattattttatacccacagaaaacaagactatttggtatgagaggtggatgaacacattgatcaatgggacagaatagaaaatccagaaatagtgccaaacaagtacagccaaccagttgtttaaacaattgtggtataatccacatgccattgttattttcatattttgttattcttgttgtttttgtaatgaccatactaaggatgaactggcataccgctgtgatttttatttgcatttccctaatgattagtgatgtcgtatgtccttatttatatgctattgaccattcgtatgtcttctttgaagaaatgtctattcaaatcctttgcctatttttgagttgggctagtttttgagttttttgtttgttttgttttttgagttgtgggagtttttcaaaaatgtattctggatgttattcccttatcagatatatgatttgcagatattttcttccattctatgggttgccttttctctcttgatactgtcctttaatgcacaaaagatttaaattttgatacagttcaatttacctatttttttcctgttgcctgtgcttttggtcttatatccaagaaattatttacagattcactgctgtaaagctttcccctgttttcttctaagagtattatagttttaacttttatatttaggactttgtccattttgagttaatttttatgtgtgttaggtaagggtttaacttcattattttgcatttggatatccagcttcccaacactgttcgctgtaaagactgtcttttccctcacagtgttagcacctttgtcgaaaatcaattgaccacatatgggagggtttatttctggatcctctattcagttctattggtctatatatctatccttatgccatttccacattatttgattattgtgactttgtagtaagttttgaaatcaggaaatgcgggtcctccaactttgtttttttcaaaataattttggctagtcaggaccccttgagattccatgtgaattttaatgatgaatttttctatgtgtgtaaaaaaatgccactggggctgggcgcagtggctcatgcctgtaatctcagcattttgggaggctgaggtgggtggatcacctgaggttgggagttcgagaccagcctgaccaacatggagaaaccctgtctatactaaaaatacaagattatctcggtgtggtgtcacatgcctgtaatcccagctacctgggaggctgaggcatgagaatcgcttgaacccgggaggcggaggttgccgtgagctgagatcgtgccattgcactgcagcctgggcaacaagagtgaaactctgtctcaaaaaaaaaaagtcattggatttttataggaatgcattgaatacacagattgctttaggtggtattgtcatcttaaatatattaagactttcaatttatgaacatgggacgtctttctttgcttttttttttttccagcaatgttttgtagcttttattctacacatctttggcctccttggttaagtttattcctaagtattttattctttggtttttgtttttgtttttgtttttttgagatggagtctcgctctgtcgcccaggctggagtgcagtggcgcgatctcggctcactgcaagctccgcctcccgggttcatgccattctcctgcctcagcctcctgaatagctgggactacaggcgcctgccaccacggccggctaatttttttgtatttttagtaaagacggggtttcactgtgttagccaggatggtctcgatttcctgacctcgtgatccgcccgcctcggcctcccaaagtgctgggattacaggcgtgagccaccatgcctggccagtattttattctttttaatgctattgtaatgaaattttcaaaagtttccttttcagattactcattgcaaatatacagaaataaaactgatttttgtgtgttaatttatattctgtagccttgctgaattttagtagctttaataattttattgtggattctttaaggtatgctacatgtaagaagatgtcatctgcaaacagataattttatttttccttttcaatgtggatgtcctttattctttttctttattttattttatttattatactttaagttttagggtacatgtgcacaatgtgcaggtttgttacatatgtatacatgtgccatgttggtgtgctgcacccattaactcttcatttaacattaggtatatctcctaatgctatccctcccccctccccccaccccacaacaggccccagtgtgtgatgttccccttcctgtgtccatgtgttctcattgttcaattcccacctatgagtgagaatatgcggtgttcggttttttgtccttgcgatagtttgctgagaatgatggtttccagcttcatccatgtccctttacaaaggacatgaactcatccttttttatggatgcatagtatttcatggtgtatatgtgccacattttcttaatccagtctgtcgttgttggacatttgggttggttccaagtctttgctattgtgaatagtgctgcaataaacttacctgtgcatgtgtctttatagcagcatgttttataatcctttgagtatatacccagtaatgggatggctgggtcaaatggtatttctagttctagatccctgaggaatcgccacactgacttccacaatggttaaactagtttacagtcccaccaacagtgtaaaagtgttcctatttctccacatcctctccagcacctgttgtttcctgactttttaatgatcgccattctaactggtgtgagatggtatctcattgttttgatttgcatttctctgatggccagtgatgatgagcattttttcatgtgtcttttggctgcataaatgtcttcgtttgagaagtgtctgttcatatcctctgcccactttttgatggggttgttttttttcttgtaaatttgtttgagttcattgtagattctggatattagccctttgtcagataagtaggttgcaaaaatgttctcccattctgtaggttgcctgttcactctgatggtagtttcttttgctgtgcagaatcctaagccaaaagaacaaagcaggaggcatcatgctacctgacttcaaactatactacaaggctacagtaaccaaaacagcatggtattggtaccaaaacagagatatagaccaatggaacagaacagagccctcagaaataatgccccatatctacaactatctgatctttgacaaacctgacaaaaacaagaaatggggaaaggattccccatttaataaatggtgctgggaaaactggctagccatatgtagaaagctgaaactggatcccttccttacaccttatacaaaaattaattcaagatggattaaagacttaaatgttagacttaaaaccataaaaaccctagaagaaaacctaggcattaccattcaggacataggcatgggcaaggacttcatgactaaaacaccaaaagcaatggcaacaaaagccaaaattgacaaatgggatctaattaaactaaagagcttctttatttctttttcttgactggtctcaccaggacttacagtactatgttgaatagaagtggagaaagcaggcatccttgtctcgttcctcatcttagtgatacagctttccgtcttccatcgctgagtatgatgttggctgtgagattttcatatgtggcctttatcacattgaggacttttccttctatttctagtttattgaatgttttatcgtaaaaacttggtcaatgctttttctgcatagattgagataatcatgtatttttccttcattctgttaatttagtgtattatattgatttgctctcctatgttgacccctccttgtattccagaaataaattccatttggtcctgatatataatcctttcaatatgctgctgaattccatttcctagtattttgttgaggatttttgcatctatattcataagggatattagtctgtagtcttcttgtagtttctttgtctgggtttattatcaaagcaatagtgatgttatagaatgagttgggaagtattccttcctcttcaatatttttggaagaatttgagaagaattggtgttgattatactttaaatatttggtagaattcactaccagatggtagaagccatctggccctgggcttttctttattggaagttttttttattactcttcaatttccctaccaattatagatctattctgatttcctatttcttcttgagtcagttttggtagattatgtgtttctagaaattttccatttcatctagtttatttaatttgctattgtacaacagttcatggtattctcataatcatttttatttctgtaaaataggtagtcatgtcttactttgctcatcaaaacttttgattttttacaaaggtacaaaagcaattcggtggagaaatgatattcttttcacaaatgatgccagaaataataccattagaccatccataggtgatgaaaatgaaccttgacttaagcttcacacattatacaaaaaaaaaaaaaacaaaaaccccacacacaaaatgaattgtagatttccatgtaaaacttttagaagaaaacattaagagaaaatccttgagaactagggtttggcaaagagttcttagacatgacaccaaaagcatgactcataaaaggaaaatttgagaaattgaacattataacaattttaaactttggcactatgaaaaccctttttaaggcaatgaaaagataagctacagactgagagaaaatactcgcaaacctcttatctgacaaataactcaaatatataaagaactctctgagccagctgtggtagcacaagcctgtgatcccagctacttgggaactgaggtgggaggatcacttgagcccaggagttcaagaccagcctgggcaacatggtgaaaccctgtctcaaaaaaaaaaaaaaaaaaaaagaactttcaaagttcaacattaaaacaccaattattaaataggcaaaagagggcaaggcatgatggtttacacttgtaatctcagcactttgggaggctgaggcaggaggatcacttgaggccaggagctcatgactagcctgggcaacatagcgagacaccatctctacgaaagtttttccagaaaattaggcaagtgtggtggtgtgagcctgtaataccagctactcaggaggttgaggtgagaggatcccttgagctcaggagtttgaggctgcagtgagccatgatcatgcccctgcactccagcctaggcaacaaagcaagacctcatcttaaaaaaaataggcaaaagacataaagagatatatcaccaaagaggatatatggcaagtaagcacatgaaaagatgttcaacatcgtcagcctttcaggaaatgaaaattgacaccatgatgagatatcactatacacctatcagaatacctaaaatataaaatagtgacaataccaaatgctgctgaagattcagagaaagtgatctctgagacattgagagtaataggaacgtaaaatagcacaaccactctggaaaatagtttggcagtttcttaaaagctaagtagtcaactaccatctgacccagtaattacactcctgggcatttatctcagagaaatgaaaacttatgttcacacaaacccctgctggtgaattatcatagcagctgtattcataataggaatagttggaaacaatccacatatccttaaacaggtgaatggttaaaccaacagtggcatggaatgccatggaattccatggaatgacatggaatatgactcaacagtaaaaaggaatggagtattaatacacatagcagctgggatagagtgcaggacatttggctgagtgaaaaagccaacctcaaaagcctacatacaggttgctctggtggctgtgcagatctgcactggtgatacagtgccatacgcctatacacacacattgtactaaagtcaggttcttggctatgagatcatactggacttatgaaagctagaccattgacggaaactggatggagggtgcacagtgccgtctgtactatagtggtatgccctgtgactctacagtcatttcacaataaaacatcttttgttttgttttgttttgttttttgggcggggggtgttttgagacagaatcttgctccatcgcccaggttggagtgcagtggagcgatctcagctcactgcaacctccgcctgctgggttcaagcagttctcctgcctcagcctcctgagtagctaggactacaggtgtgtgccaccatgcccgcctaattttctgtatttttagtagagacaggatttcaccatgctggccaggctggtcttgatctcctgaccttatgatctgcctgcctcagcctcccaaagtgctgggattgcaggcgtgagccaccgcacctgccaataaaaacatattttaagaccctaggggagaaggtatggcaatttgacaacttttggtggattgcagtttgttttagatgtgtatcgtggttatgttttttaaagaaagagagatgggatccttacgtttcagaaacatatgctctggtgtttacagatgaaattatattgtatcttagatttgccctaaaaaccatccagtcgggaggggaattagatgatgaaacaaaagtggccacatgttgagaactgttgaagctggacaatgaatatacaacgttccttatactattttctctccttttgtgtacttttgaaactttccataatagaagtttttaaacataaatgaaataaaaatcatgagtgttcctagggacttgtagctgtgtacaaggttagcagaaggcccttggctcctgcttgcaagctgggttctggccactgcctccaggtcggagacagagtgtattagtccattctcacagtcctataaaaaaatacctgagactgggtaatttatgaaggaaagaggtttaattggctcacagttccacaggcttcacaggacgcatgacagggaggcctcaggaaacttagatcacagcggaaggtgaaggggaagcaagtaccttcaccacatggcagcaggagagagagtgagcaaagggggaagtgctgcatacttttaaacgatcagatctcatgagaactcattcactatcacgagaacagcaagggggaaatccgcccccatgatccaatcaccttccaccaggccacacctttaattcaacatgagatttgggcagggtcacaaatccaaaccatatccctgagggtttcccaggtcagttctggggacacatgtggagctttaactgttcctgatgttggctctgccaggcctttgggctccacttttaaggaacttgccatttgccaccccagtcatcctcccagcttccatctgttcaagtgttcatccttccattggtttcttcatctgtttcatcaccatttatgtgtttcttccatccatctgtttactcatttatttacttaacatttcctaaacgtcgacattacgacattaacaaataagtcatggctcctgccttcaaggagctcagagtctatctggttggggggagtcagaccaacatagtgtacagggatgcgtttccttctgtgagagttgcctgttcaagctccctgagagtaagataagagtcatggatgggactctcacagacgagaaaatgtctgaaaagagtcttcaaagttcatattttcacctatgttgggcccatgtggataatccaagataatcttcctattttgaggtcagctgattagcagccctggtttcatctgcaaccttaattcctctttaattcctcacgtaacataacatattcacaggctctggagatgccatcttttcatcttttggagaccattattgtgcctcctgcaagaagagagtccagatgcagacccagctatctagaatctcaactcaaggacagagcagacattgtaggtccatgggaaaggactgcccattccatgaatggtgccaagaccatttattatccttacagaagaaagaaattggtttccaacctcactctataccacaaaaatcatttccaggtggattaacagcatacatatcaaaagaaaagttataaaacattaaaggataacagagaagaatatcattatgactgaggttggaaagaatttcctagacacagaaaacatacaccaaataggactagattgacagatttgtctatattaaaattaaggacttccgttcttcaaaaggcaccttaaaaatagtaacaagccacaaactgggaggagatagttgtggcacatctgagtgacggaggtatctagaagtgaggaaaggaatgtgtgtgtatacatacatacatgaatacatacatatttttatgtcaatgatatgttaaagataagcaattcaatagacaaatgggtaaaactcataaacacttcacattaaaggaaaatataaatggcccatagataaaaggtcaactcattagtaatctaaaatgtcaattaaaatcacagtaagataccatttcatacccattagactcaagaatttaaatgtctcgtaatgccaatcacaagagctggctgggatgtggagggatggaacattcttgcgccgctttcaggttctgggaaactatttggtgtgcctaggacccagcagggccacacacacctaggcgtctacactcagcagtgtgaattcacaccaggggtggtgattttccccaactggacaaatatcttagctattatgatggtttatggctctccagaatgccacattgcgtaagcaatacacaatacatttgtggtattgatttcataggggcaggaaaggattaggaaaacaacgtgctccttagtggggccgtcatgaaagcagggttgagaaacaatgtcctagagaaaccctccaacgcatgcccaggaggcatgcagacactgtccagcagcaccaccacagcagcacagggaatgacccaccctgctccagcagtacagccaacacacaaaatgtgaaagactcgtacaacacaagactgtgtggcagtgaaaatgaaacaatcacagctacacacacagttgagtgaaaagagccagccagagaagagtggatttgctggatccctttagacaaggtcaaaacttagcataactgacagaactaaatgctaagacaaaggcatgagaatgatttattacaagttctaactcttgaatatctctacaggagggagatgggaatgggactggaatggagtatacaagatatggaaggtcaagtttctggtgtttttcttaagtagagtgatgggtatcaggactgttcattgtattaaatttcaaaccatatttgcatgtatgtaactatgttttctttgaatacacacatatatattgcataacaaaatgttaacatttttcctaagggcctatactatagccaacacaatggaaaatggtttgtcactgaatacaacctaaggggctctcgagctgtgtgatggtgaatacttatgtttccttgtcagccaagttgctgtagactgggtgatgggtgactaatggtggtggtgtgagtgagttggtgcattctttcacccaggccacatgtttgtggcaaggatggtttgagaacctagccctgcaacctgcacgctccccctgcagaagaagcatttgtcctgaacccactgggctccttctccacgtgttctcccctcagcccttcccagcccagccccctttgcccagctgctgtctctccttccagccatgcctgatggagctctggacacagctgtctgcgctgacgaagtggggagcgaggaggacctgtatgatgacctgcacagctccagccaccactacagccaccctggagggggtggggagcagctggctatcaatgaggtagggtcagggctgcacgggcagagggagggacaggctggggctacaggctagattccagcacgctaatgcaggccagatgcccacagtccacgttccatgtggctgctggtggtgctggccatacacagcgcagtttcagcctgcagtcctcatttgggatgtggtgtcaagagcacggtttgtccaacacaggactccctgtgccctcctgaggcccacagagcagatgcaatgccagcgtgctggtccaccttatggggctgtcctagtgagcagctgtcaagagccatcccagctggaggagtcctacttagtagaagggaggctagggcttctccagtcactccagcccctgaccccccaaccagccatctgggcaggctgggaacaagttgagggaaaaaccattttctctcctgacaacaggagttcagaagtattgctgttgctatgacaactgcgtgcaagttgctgtgtttttgctattcctactgaagcagaagaaatccatgagaatcctcatccaggcaaaactggttcccatctgagttctccctttgcattcccaataagagaggaatcgtgatgctttaacgcccctctctttctcactcaccctcctactttctcagcctcttttacttaactggagggtgttgttgaacgtcatggaagtgtaaccagttgaccagcacaagcacatgcccatagcaaatgccatgttctctagtcaggaggtactggtgtgtttctgcttcattaaaactggactctgacaacccaggatcttatagcacacaggtttttccttaagaagagatcaattttggaagagttagacttttctgtgaatgaatgagttggggggcttctcagaagccagtgaggagggtggcgtcctccttacccactggacagaggagtggaatcaaaggcccatgaactcctcctagaggcccagctctagatgatgatttaaaacagtcattaagggcgggcatggtggctcacgcctataatctcagcactttgggaggctgagacgggtgtatcacctgagatcaggagttcaagaccagcctggccaacactgaaaccccatctctactaaaaatacaaaaattagccaggcatggtggcgggcacctgtaatcccagctactcgagaggctgaggcaggagaatagcttaaacctgggaggcagaggttgcagtgagccaagatcgtgccactgcactacagcctgggcaacagagtgaaactccatctcaaaaataaaaataaaacagtcgttaaataatgcgctactcaaaatccatggtgcataaaaaataaacatgtaaataagctttcccaacaaaacctttctttttaagtgcctcttcgtaagctacttgggatggaaggtgttctgaaatgatgccacctgaagcagaattcacaaggaatggttgtgcttttccttttttttttttttttgagatggagtctcactcttgtcgcccaggctggagtgcattggcacagtggtctcggctaactgccacctccgcctcccaggttcaagtgattctcctgcctcagcctcccaagtagctgggattacaggcgcccgccaccacacctggctaatttttgtacttttagtagagacagggtttcaccatgttcgccaggctagtctcaaactcttgaactcaggtgatctgcccgcctcagcctcccaaagtgctgggattacaagcgtaagccaccacactcggccagttgtactttctctggaagactcaggctgcctcctccatcttggggctcggtccagcagggggaccccgagggggcctgtcagatgtggggcatggagcactgagcagtgaccgtttgagctggttcacatggctgtgacaccagatggtgtgaggctgtgcagggctgatggtaactgactgcacacacccagcagggtgagctctcagtacatctccaaccacgagggtgatcatcccaaccaaagccctcaggactccggagaggtgggggttccatggctggccttatggctgcgttgatcttgtgtctgcatttcatagttgtgtgtctcctacctgaggataaaattatggattgtcacatcttgctgctggcgaagaggtgtttttttgggctctgagttccttgacaagttgttcattctaagatgctttggccgagaaaggccaagagccaggacttctctgaaaaaataacccaaaaaatgaggctctgtcatctttctgagggaaaggcaggcaatttagatttggattgtgtaagcgcctgtttggtcctgtttggttcagaggtctctcctggcattggaggttgctgagcagacggagtgttgctgctttgccttaacgtttagggcgcgtgtccccagggagaaggacacacacatcacagaggagagcaggaagtcaggcagagggagcccgtctcctgcgatgctgcaggctggtgctggggaggctggctcctgtcccagatggcatccacgcgcctcatgaaggctaccagtgcttccagatcctcatgtagaaaggctgtcctgagagaggcagtaagaagggcaggcctgggcttggaggcctctctgggtccagcacagcgctgcagcaaggccatctctgtgttttgtgggtggatgtgacaccggagccctcactgtgcctagcttgcactgcagactcaggaaaggtggtgcctgcctgttaggagccgccagaagcattaagtggactcactcatcagaaactgaaaagataagaagtgattgtcctgcgacaggccagttcccgggccttcagggcagcactcccacgggctcagccagaagctttgctgggggttagcgtgactttaatatctagagatgagcaaagcaacaggtgtcagaaaaaagtccttactaaataatatttggcttgccctaaaatcacacattcacttctattttctaagaatatgtaggggctaaattgtggccctttcttatctttttgagctctcagttccttgacaagttgttcattctaagatgctttggccaaggaatatctaagatgtttgacatcaacatgaacaagaaagggtcacaatttagccagatgcctccctcagaaggggaaaccaccttgcaatttcctaagcagaacgaatgcaaaccctctggcctggagagcggcccactcggggcagagccgcgaggcagtttgcattccaggtacatgaggagtgatttttatgcttgcacacagatgtgtgtgcacgtgctgtacataaagggtgtgggtgtgtgttgcatacatgtaacgtgtgtagtgagtacttgcgtcagggacgcaccaggtcctaggatgcagctgtgcagaagccatagtcctgcctgcagggagctgcccacaggccgtgtctgtgtgggcccctgcattgtcccatatgggcctgaggaacgtgcaaacaggcacaatgtctcgttccttctgcattccttgagttccctgtgccctgcccctcgtgagtgtccagtccctgccaggcaaattaaggaatgcagacgctgagtgttttcagtgcccaggagtgtactctcttcttccagcactggcccctctagggcctacccccaaggccatggcccaggcctgggcctgtctgcccagttcctcgccctcccccttgactctcttgggctgcactgtgcccctgcagtcaggcctgaggccaccctaagccccctggactttttctgaagctaaagccagaagcgcctgtcagtgagagtgaccacccagctccctccccaccaccaccaccgtgtgggcagtgctgccagtgcgagccatgatgtgaccaggggagaggacggcctggctcctgctggggaggtctagggtctcccattgcccactggcacctgtgaacagcagcctgtcccctgcctcatgtcttgcagcatcctgtgagctgcttctgccccacctcatggagtgcctaagcccagctcgtcttccagcctggtgaggatgagcacgaggtgtctggcgcactgataggcatcaggctcctctgtggggccgaggagggggaacaagagccaggtccggcctggggacagatgtccccagggcagggtcactgcccttgctctcctggcattctccatgagacaacccgaggatgctataggacatgaggccagctcttggtcacccctcatggagtcactctgactcgctccaggtgtttttgtcttccctgagttcccgtgccgctggacatccctccccagtcctgacctggctcttattccccctcctcagccccagggaggagcctgatggctgtcagtgctgcagataccttgtactcatcctcattaggctggacagcaagctgggcttaggtgctccatgaggcggggcaggagcagctcacagtcccttggggccactgctgccacttttgcgcagggctgcaaggtcacctggtggccagcccctccaaagtggctttcctcttccctttgtcctcccaaagccacagcactgggggctcacccctcatctgccccagacacctatgtctcccttctgcttgcacctcagtcctgccaccagcctagttgggccactcccctccctggtgggagctgtctgtccaacccctcaagggcctaggcctttgccttcaagctttcttttcttttcttttcttttttcttttttttttttttttttttttgagacggggtctcactctgtcacccaggctggagtacagaagcataatcttggctcattgcaacctccacctcccaggctcaagtgatcctcccacctcagtctttctcgtagctgggactacaggcacatgccgccactcctggctaatatgtgtatcttttgtagagatggagtttcactatgttgcccaggctggtctcgaactcctgagctcaagcgatctgcccgccttggcttcgcaaagtgctgggattacaggttgtgagccaccacaccctgtctgccttcaagcttttctgttaggtttttggtcatgaaactcacataggaaagctgttaccactgccgttcctgccataaacccagctctctgggatatagaggctgggggcccctaggcagggagaaggaccctgctcagtcctcagtcaggggtgcttcagccaccttcagtcctccccaggctgccctgctgtgcatggggcagaggatgtgcgcagcactcagctggggctgaagaaccaacccctgcctgcccaggcctggcccagtggccgagcaggctgctgtagaccctccagcactcagtgcctttgccggccatccagctcaccgacccactgtacccagggcccagaggacatgtacccttctgggtggccagctgttcagaggccacaggtgcacaatgaagcatccacacgtcaggggttcgaagccacaccccatgagaggacacatcaccatcttactagaggactgctgggatttgggggtaccagcgagactttagatgtcttctgatccccccaattctcctgacagcttgggggagcaaacctgcagaccagcgttttctaaagaactgggcatgagcagtacaccaggcggatgggcccaggctgaaccttcagatgtgagggaggcacacagcctctctggacacatccctgacacttctctgcacacacacacgggcacccacatgttgtacataggcacatgcatggaaaccccacccacatacacacaggtacccatatgtatatacacacagaggtatccccttacacagaggtgcctatgcccatgcacacacaggtaccccttgtgtacacacatgcacacacatgtggcatccactctgctttacagtcaacaggatggtgacattcagggtacactcacctatctttgcaaggggtggccaagagctggccacacacagagagatcagagcatacaaagtcactcccatgggaacacccagtctgcacacattccctctgtgcgcccctccctgccctccaggaactcttcttgctccaggattcaaagcactgagcttgttgcccagaaatctctgcccatgcctgagcggagtgtttagccctctcccctgcagtcttcttatctctcagaaggacacactgactgtacctgggctgtcattcttaaggatagaatgagagctcttgcacaagagctttgaaacctacagggttaaggttgcaggctgtgtcgagtggaggcagaggaagccctggacgcctggcttttccaaaggaacacaatgctgctcggacgctgcggtcagtgaagaggggcccctcagggtggatcgctcccaccggagtttaaatcctgcctccgccatccctgcattcctgcgcgattttatgactgagcagaatccctaacctttcagagccacgtttactcatctgtgaagtgggggcctgcggccagtccttgtaaggaatcagagtccctggcccatccctccccaaagcgccggtgccaggcgttttggcctctgtatctctgaaacgaggaggtcccggggcatccccgagcgcccccgtggccatctgtgccactggccagcccagggccaggactgctgtgccggcgtggagattcccgaccctttccaaggaggtgccaagggcgcagcgcagcgcacgcccgagccgccgcggtccctctgagcctctccagcccgccgccgccgccgcccccgcccgcacagccggcttggttgccagggttgccagggcttggggcctgggaggcgccgcgcgcacggcgccggcttcgcgggaggagccccaggcccgcgagcgcaggcgccccgcctctccccgggcgctgcgggccaccggctcggccctgtgcggcgggatctcggggccgcacggagcgggaggccgggcgccatggcgagggccccgcagccccggcgcggccccgcggcgcccgggaacgccctgcgcgccctgctgcgctgcaacctgccccccggcgcccagcgcgtggtggtctccgccgtgctggcgctcctggttctcatcaacgtcgtactgatcttcctgctggccttccgctgagcggccgcgcagggcgccgcgccggggtgagtggcgcgggcgacggcactccagccgttgccacccgcggcctccgcactggtcgcggagggaaggcctccttccaccccatgtgctcactaccagggcctggtccgggggtgtcgccgagcgggtgcctgaggggcgtggtggcacgtgtgtcacagggtccttctgtcctctgtgccctgtggggagtgggggctgcgggggcgaggggggaggccaaaatggcgcgtctctgcgagtaaccgaggatgcggattcagctggggctccccggctgcttgtctggaaacggagtgcatgtgaccgctgggtgagcgacccgcgcttgcatctgtgtaggttgagtcaggtgtgtggaagacccccgggcaccgctgcgcatgttacctgcagttgtttttcccgttttaggccttaaaatacgtggtgtcagtcttcccacgggcagagcccctctgccccccttgcacgtgggccctctgaagcccccacccctgctgcacaaactgcgggtgttcacagctgcccccaccctgcacgtctggtaggtgggcagggtggggagggcagtggcggtcacagggagtagctggaggcagagcctggcagcgttgcccttctggaggctgtcagaacctcagaggcacaggaggggatcccgctccctgccctgggctatttgagtctcaaatgtgcacctccattgggaccttctcccacaatagaacagccagtttcacagccctgctgtgtctcaagagtcagtctccgctccctgcaggcagagaggcagcctggactccttgccccttgggcctgcctggcttgtgtcttggctcaggtgcagctgtgcctacgagcaccaaaaagggcctctgcccagaaacgcacccagcgcaatagcatcggaggtggagcatgactctgatgtcctacgaaactgtctctgacctcacagagccacattttgtcttggtgacaacacaaacagttcacatttctcctaactctaaattagagtacctcccgagtgggaggctgtgcagaaggggctgacatccttacattggtgggagacacaggaggagagcttgctcacggcacgtgtccctctgccagggtgcgacaaaggcaattaacacctcctcccctcctccccaaggtcttccagctgactgggcaggacaagtgtggggcttgtccctaatggtgcctggaagctggcctctctgtgaagccctcctcttgcccgacacctggtgaccttccctggcagctatgtggggggccacctatgccggacccagtcccacctgcagggacaggcagcataaaggaaaggggaatgggggcaccaggcttctgctcagggctcatttaagggaacctagagacagagggtgacacctcacctggttaatatcaggcaggaacctcctgagaagggaagcagtgggaaaatgagccatgttgagtgtgtcgggtcacctcctgacagcctgtgtcacagaccccaggtcagggccatgtcacctacagctcacgctctcactggtgtccccagaccgccatgtctgcttccttctttccctggagcctcattcttcagggcctcagcggggtgagccagctccccactgtggctggtgggctcctaccatatggtcgcctgagccctcctgtctcatctcatctgagtggcagcagcagctcatgatctggaggccacctgcagaaggtctttgtggctgggaatgagagcagtggccccctgtggaagcctgctgcccccaggaataacccagggctctgtgcctgggaccccgtggaggcctctggaggtctgcagcccccgcgtggctgccgcgctgtgagggttcctgggctcacaggctcatgtgtcactctgaggagagcgtccatcaggactggagcaggttttacccccaggaaagagaaggtttgtccttccctgaacttgcttgctcaggacccctggaggaaagcaccatcccaagcaggctctggagcttcagtgctccagtggccagccccagccctcaccctgcccattcaggcagaggcctcttagctggaacacaggactggccccactcttggtttccatgttgaggtgaggattcacacagtgcttagggagtacccagtgaagtgaaaggagggctcctgggatgggagctcagaggagggcctgtttgtgacattcccatccttgaccgcccccacagctgtgacagccagtgccaacacctggtcctagcagggagggtcgtggacctcacctcctgtgcagccccagcccactcctcctctcctgccctaaggccctagaactgctcatcattcagggagcagaaacagatcccatgttaggagaaagcaggggtcagccccatggcgtacaagggctgcctgggagaggcaggggagcgtccagtgtcttagtccacaccactctggagcaaggcactctgctggttatttgagcagagagaagcatgtgaagaatggtcggctaggtataatgtggttgactgggtaacactgcataagagcagtcctgaagtgcctgtcacagaggtagcagctgcaaaacgtttctgcttctcctagaacttgggaaatgaagagaagaggttggactaactcaaacttaggatcacagggcttgggacctagagctctaagaaggggcattgctcagctggtgctggcatctctggggcttgggatgggagcaggggtgccatgaggttggttctgcaagtgttgaaaaacacacagtaaacaagctccaatcactccaatggcagggcactgtctacctggatgaaggggcattgtggttggtggctgaccttacaggcaatgctcatccacaagaagcccacaggagggcaccagcccccagcccctccctcctgcagccttgcagcccagcctctccctcctgcagccttgcagccctcagcctctccttcctgcagccttgcagcgcccagcccctccctcctgcagccttgcagcccccaggccctccctcctgcagccttgcagcccagcctctccctcctgcagccttgcagccctcagcctctccctcctgcagccttgcagcgcccagcctctccctcctgcagccttgcagcccagcctctccctcctgcagccttgcagccctcagcccctccctcctgcagccttgcagtgcccagcccctccctcctgcagccttgcagcccccaggaattctggattgggaatgctaacagggagcagttggcagtcccagtgacaggatcagattctgtggtcagttcacttccggctccatcactgagccttgataatctagacatgcccagaacatagcccctgccccaggaaagccctgctcctgtcagaggcagccttgtcagctcctctgtaaagaagtcaggatcccctcttcccagggctgctgagggagtggagacagagagcagggaggcccaggcagcctcccccactgacccgcctgcccgtggctctctcggcagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcgggtatggttccaagccccagcttctcccaagttgggcccataaaaagctacctggttctgcagagaaatccaagcccaaaacagctctggcatcctaggtgcagagcactgggtggtgggtgtcggggcgcagtgtcacagccttcctcctcctggagagccactactcctgctcccattcctcttctggtgagccctcgggggccagagaggagagcagtcgagaaatgagtgtgtgcagacactaggcacccctctgcgatacccccgcaactccaggcgctagacatttcccaagccctgaagagcactgataggggactgctcacctcacacacagccccgggagtgggaaccatgacttacacctgaagaagttgaggcacggtcaagttattagccctggagatagcagagaggggacctggattccatctaagggggtctccagtcttcaaggaaggaatccaggtgcagtctccaaaaggcctggctcagggcgtccaagctgagggccgtccggcggggaggtcccaggccctggtgttcagatgctcctcctgccccagatcccctgggaaactgtccactccgcaccctaagcctttccccaagttgcatgttagccagcgggcgcgccacccatccccctgcttctgcccgctggggctggcaggagcaggcactggttcaggaactgcagcaagcgctccagcctctgtgccgggcacaagcagggtctaggaaggaggccaaatcggtattcggatcacactgacggcggctgcgggcgtcggagtcgtcattcctcggtccaggacttgcgtgggtggcgtggtggggggagctggccggccagtcctcagccctgcgccccgtacaccctgcggggcctccgaggcccggttcccgccgctgcggcgcagggcgcggggcgttgctccgagggatgcggggcactgaccggccacgcatggcctgcagctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgaggtgaggcccggccggcgggcggtgactggggacccggtcgggggaggcctaaccacgtccgcccgcagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatgtgagcgcgcggcccccggcccctacctgggcgctgcgttcacagaggctgccgcgggcgccagcgcggacagcgggtggctggtcccaaaaccttccacaacgcctgggccccagctccagccctctatctgccccgctgcccgcacccttcaggacagttttaggatggtctctgcttctgtgtggcgaaaccaagtcagggaacgctcctgggagcagagggctggggcgtcccccaggaaggacttgctttgacagataggagggcagaggcctgccgagcgccgcaggggctgttcagagtgagctctggggtttctcacacagggagaatttacagcctgcttaggcggcagatgccggctggcatttaccaaggttcactgggccgctctaagtggacacctcctagcctcacctggtagagaagggccttgttttggccctcttgggcagtcgagcgagggtgagcagaggatgcctgtcccacccaaccccctaccaccgccgcttttggcattgttatcccgtccttgttatcatggatttcacccagaaggctagcgtgcagccgggacacctgctcatattctcaccattcccacccctgtgtgtgactccatgtagcttatgccccagggaaataggtacacacagcctgggtctcccctagcccccagcccagctcctgaaggaaatgtagaggctcttgcccttcccacacatgcagctggattgcctgtgggagcagcagagagctctgctaacctccagctgtgccccttagcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacaggtaggagggcactgaggcagggaggcagcccacgcctctgcatgcctccagtcagccagtttgagcattagcagtgtgctgggcactgctgcagccctggggcaacacacagaaaactagccctgtcctgatgagctccttgcaatgggggaagaggatgccaacaggatattaagctctgctctgtgcttgccatttatggagaagagaggggctgtgcatctgatagtgaggatgtggtcaaagggcacagccccagaggaaagcagctccacacgtgggggctgcaggggatcctcaccctttctctgtctccagcctgcagcagccttccatctctgttctgccccagggacttcaaggatgttgaagccgccttgcatgccatgaagaacgtggcccagctcatcaacgagcggaagcggagacttgagaacatcgacaagattgctcagtggcagagctccatagaggactgggaggtgagggcctgggggcacagaaaattccaggaggtcttggcccctcgctttaaaatcatgcttgcccctgaaaaatctagaagggagctgaagcagggagctgcgctcctgggagctagcaacagatgctcatggtgtgaaagcctgtccccagcgtgggctctggacctttgctgctgcctaccgtagcaggctttggcacctggtggcctcttttctatgtgaaactcctcccatgagcagccagccagcccaggagaagccctcaacagaggaagtgtgttcctcagctgtgttctgttcctctgccttcaggggacaggccagatccctgttttagttcacttctgggactcctaacagaaggctgcaggcccaacacagcatgaccaaaaatgcatcgccacccatcagagcctcctggttctgtttgtctgacttgcacatttccctttgcatctgccaatcttgccttagaactaatgacgatgttcctgtccccctccacccacccccacttgcatctgccaatctgccacctcctgatctgttcccgaaggctccctacccacatgggtgctgccaccaccatgcaccagctgtcagcgagagaaatggcctggaaatcaatcagtatcagccacagaacattatgaaaatacagattccagggccccaccctagacacagtgaatcagaagccctggggcggggctgaggaataggggcagtcagctgtgaggcggggctgagcaataggggcagttgtgaggcccagccctggctcagggccctccagagtcactcatcccaaacaggccaccgccaaccactcccagctggggtttgcattttcaaggtagaatgagaccagggcagggcttagtctaaaagtatgaagcccaagggtggatgatggaccttcaggtactcagtgcacttagctgggaagagggcctccttagagatctcaaaggttggcctcagaggtgaatcccagacaggcctaattcttctctagggcagcactgtccaatcaaactagtatgtgagccacatatggaatcgtatgctatgcagtagccatctttaaaaagggaaaaaaacaagtgaatttaattttaataatgtttcatttaactccaaaatagcatttcaacttgtgatcaactatcattaatgaaatattttacattatttcatatgaagtcttcaaaatcaatatgtatcttacactgacatcacatctaattaatatggattagccacacttccagtgcccaacagccaccagaggccactggtgacagggggctcctattttgcaaggacagccaactcacaggccagacgtgccacctcttcctccccctcccaccatggcctggccaggtgggcgctgcaggcaaggccagggggaggtgcgccacccacccatgatgggggcaggaagtggagcccacggttgggtatgcgaggctcatggttctccttgggatcttcccagggagaagatctcttggtcaggagctcagaactcatctactcgggggagctgactcgagttacacagcctcaagccaaaagccagcagcgaatgttctttctctttgaccaccagctcatctactgtaagaaggtaccagagctgctctgccctgctgccccaagttgagcaagtggagggaggggagctgagggctgggagcagctgcccagaagacaggtgccagccagaccatacccggggagcctggccagacccttggggctgggatggggtggctctctgcaggtgagcctggtggcccaggagcagcaggcggctttcacagtctgaccaggccgggtgctgttgagagcatgatctttcctgacctggccgctgcttgctcctcaagctacctcttctctccctgcaaacctccacatcccctctctccaaccccggagtcccctgctctagccacctcccagcttcctctacgctgccggcttctgctcctctttcaaaacatggcccagtggcctcatgtccatgaagccctccttgtccacgggtgatctttcctacgtgtggtgtgagccactgtcttagtctccccacctcaaagacagggccaaccccgggctagtcagtacctgcaaaataaaggagcaaggcctctccactcatggctcagcatgtctgtgggctgcagaaggcatgctctgccctcaggatctcactgtctgctggggaggtggaggcatcaccagcagcccctcctatggctggggagaggaggtgggagcagccaggaaatggtcaggggagcggttcagcagccagggctgaggccagcatctggcaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggttcgagaccctgctgggccttgccccgcccccagggcccacccggcgctcccgcctgcctggccgcctgccggtcaggagagcgccgctcagccctctcaggttgcagggtgtagcaaggctccaggcacctctaggtcccagtcatgagcataaggctttgccttcatcacctcaatggcagggttacctgaccgcatcccatgatacagtttcgcagagttcagccccaaggcatgggtctgctggcttttggggagttgtttcactacacgcgctcacatgtgcacacactccataggacggggtcctctgcgcagtgccctgggttgctgggacctgcgggacccctttccagccagcaaaagccctgggagagccttggagtgggctgtgggtactggcctcagaagcctcccctgccccatgcacgcagacatctccccactacaccttccctcctgtccacgggcccccacattacccgccacagtgaccaggtcggctcttggtctgggaaggagcctccactgcagtggaaaagacactagacatggagtgaaggtgagagatgggtgggcagaggaaggactcggggatcttcattttctgccaggagccccaggacaggacaccagagcatgccctctgccctggttggccaaggcaggctgactgtgcagaatgggcaacagtccccgctgtggccagtactgagtccccagtacatgatgagaccctgggcaccaggaaggtgcaggtgtgcagggaactgcacctggggccacgaagtggggcagcgccctcacctgtgccccttcctcaggcttctccatcactgaactgcagaggaagcaggccatgctgaatgccagcaagcagcaggtcacagggaagcccaaaggtaggcggacagcagccccacctcctcggctgcccggtccttaccctgctgacatcattcccttctctgaaccacaaagccaagccagctagccaccaggcctgaggggggcccactgccctttgcagctgtttgttcccaaaggttggtaataaggggccactggggaagcctgggtcagtatatggttgacattcttactctcaacaccttggctcccccagatcagggccattggtgacaatgcttgtttccccagggttccttcctgacaggcatctggggttggtgtagggatggagctgctttccccatttctacagagagccatgcccctgaaacatcacatgcctttgcacaggccacccccctcttcaggctgctgcaggaggccaggcccaggccagagaccccaggcagcctgagctcttggatgtggtcagctctccaggagcaagtcctgtgtggcaaaactgcctcctacggcggctctgaagcagagccctgggacggaccccatgctgtccccaacagctggggtggcactctgccctgggcacccatgaccctctgctgtctctccctgttcagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 36707 - DNA, 107781 bp, Homo sapiens
aaactttctctgatctcctctctctctgtgtctgctccaaatgtagacagcaattgtctgggtaggaccagcttataaagaagcatggctttgttaaggaagtcgtattcaggtaagatttatttctgcaatgtttttgatggacatagatttgaatgtttatcctggacattaatgcctttgtagaaattaacaaaattataccagggatctttctgctgagatatttttcgttctggatgggacaggggttcttgattccctttactccgggatgtttgacgttaagaatggattcttttggaaaaatgcatcatttttttttttctgggaggaatttaaaatattaattgttataggaaactgaatgtgtatttctgaccatttaaaactctatttacatttagaaaatggtggcactaactgattcaagagagatttcctacttctagatttgcatttattctatgcatacagcacaaaacattaattttaatttctaaagaaaaaagagaataagtaattataattggcttttaatgtatttttcttttagcttagtgaaagaaaggaaagaaagagaagatgacacttagctaagggaaggtggacacaatcacactttaattttgacaaacttattaggtgtatcttcagggaaatcacagaagataggcactctataatgtctcagcgaaactaggagagtatctgttcctccatggcggcaaggcagatgccgcagatagctgatggaaccaacgcccaagagcttccagctcacggagaaaaacaagctgagagaaggttgccggagcgaccagtttcaagtctctttgaaaagagcaggacagggattcttttggaggagtgaaatcactcctccagctacatttttaatgggaagtttttacatgtaactaataaaaaaatggttttgccaatcttcatattagctgaataaagcaacctcatgaagcaaacactttcattgaaaccctttgcacttgctttattgttgaacctgaaagaatcccagagaactcttaaccttgctaaatgttttattttgctagaacattttgtccagatgagtaattattcatggtgattttctgtttcctcaaaatccttctctctgtcctgaaactgctgagtagcatgtgtttattcatgtaattaactgggattaataggctttctcttctgagtacttcacaggatatcctcagctatttggagttctcctagagcatccccaaatggagatttggattgatctgtcatgttgcatgagcattgtttatctgattgtttttaattggtttccccataaaattgagagagaaaaaaagcttatttgaaagattagtacatcaagggcaatattagtgatgaaaatcgttacagaatttgtgagattagttcaacatttaattttctgattatttccacaattcatgtctctaagaaacccgttagagttttcaccttccaggtggtggacagcttataatcatcattaaaggcaggagctacagactatatgcctctttactcaggatacagtatatgtggctgaaacaagtacactcatcactctgcttgtaaagtatttgagtgaaacacacacactaattatttgctgagtaagatctgtgacacaggaaattctcaccaaacaattattttattgacatgtgagtctatgaattggagactgtcaaattgccatctaagctgtttggttagattcaagcacaaactaactttatgcttacaatagacttataggttgattgatgaaatgttataaatagacatgtccatttttaataaatgtatgtttgtgggaaactgagcccctttgcagaaatgaatgcaagctgtgggacagattggtagtgattgaaaatgctgcagttgctcctctgaaagaaatattaaaatatctgatatagcataggctctgagttcatggtagaacaatgcaatgcaaatgaaatcaggagaaaggatatgcagccaaagaatggcgagtcgcaagaaaggtcacatggtttatctcttagccttcatacgggaaaacacttcaacccttgtacacagatgagactgtcccagccaccgcatccacaagctctctaaagaactcatttcaaaagctctcaaggcaagaacatccatcctaagttctccatctccagttaagtctgctgcctctcatttgatcctcagggaagctaaagaatagacagcagctgtgctctgtgtaacccttcccagcccagaagctctcatgattatgcttatttaagttaaggaaccctagtttctttagtctaccctttcaatcttgtttttaacctaccttatttagctcacccatttacttctctaaatgtttttgtccttgttgtgttcccctctgcttgtccacaattacttcttcagctttttaaggtcctttcgtgttcttttctaagtaattatgagtttttctattcagtggctattcctacacctgcctagtactccatgtatcatattgacttagagtttctcaaacagcacatgaagacagattttcttctctcggggaagaaaacaatatatttacatatatatatttgtgtatatatataaaacagtatatttgttaatcatttccttagctgtagggacttaggaaacaatatgtttactaatttttttttatcaataatcccctgtccatttttcaggggttgcaaatgtgtactttcagctgttctatagatcactcattccaaacattgagtccattatcacctgggcagtgcctcaaagtgctttctcatgatatgcagttccaactgcctggccctgggcttgtgcttagtatatacttagtttttgttgagtaactgtatatgcccaaaatggctgtatagaccactagaaaatatttctttatattttctttgggaaaatgattaaacaatctagctgatcttataaaacaaagcataaatgaccatcttcaatttgggtttctagaatgtatagcggtagtctatatttgtcttttgccatttgccttagaaactggaagatttgaactgagaaaactattacaagtgaagacatccagggtggtagaaaaattcaccccagcagctaagctcttgagaaggaaggagagtattcaaaaggaagtgagtgcctcctgggtagaaggagttctgtaagtcccccttgggagtaccagtctcatgggagaaaaatgtgccataacttttattttcattccggcagggccactgggtatggcctaaaaatttaggcatatctcaattggcagtataagtgtctctcgttttataaaataaaattgtttccagaaaattatatgtaaatcaaatcccacgtgaaatccacatgggatatgcagtaaagaaaggagcctttttgtgagtgtttctataaagcgaagacttataatagacgtattaaaatgattactctttaatttatccatttgaaagtctgagttctaaaatgtcagaatgaaaacaagatatctgcattctattcagaagaaattatttgaccaaagcttgctaagcttatgtatgctttaatgtaataatgcctcatttgtgagtatgttaaaaatggttacatttaagtctgcttactttgctttggaagtttctgaagagcttattggtgtttcttactatttagcagctttatctgatatgacattatattattgccttctaaaatagaatttttaaaaacttcatccaaaggagccatgaataactggcatggccacttacttatgtaaatagggtatacacatatctcctggacccaaaactctaatctgttaccatgccaattccctatatttagttcaacatgccgctgaaatgtctaaatattggctgtttcccaatgtactccatcctttactctgttcttagagaatgaagagttatgatacaggaacttcgccttgtacaacagagtaggtgttatttaggcacattccaaggctccagagcagtcagccttggaggtgtttactaggactctttctgtggttggttagtgcatgcatctctgcgtaaatacaaaatataagtgttctttgtagtattcattgttccactaatgcttaactgcatagctgaatgagaagatatttttccagctctaatactagctaatatgataaaatctaaataaagtctctaaataccacattcattatgtcccttccttatatcaaaacttttactggcttcactttgaatgccaactagttggaggcagtgtttgatgttattctgtaagcaaagcctacagtagtctggctcaacatacctttctagtcttatctccttcctttcctacaagaactacttcagccaatccaattgcctcctagaggaatttgcccaattcattaatgtataatctatgcagtgctctctctgtgatgtgctagacaccaaggaaggtgccaagatgaaagaatcatggaccctgccttccaggaaggcacaggctggctgcccagctagcttctatcagacactctgtgatgaatgctataaccaaaataacacaaaagcagcagaggactagaactaggaaagatgctttctgctggctggatttgggatagcctcatcgaggaggtataaattaaccagggacttaaatgtatgtgaaaatttggtttgtgtcctctgagatacctttcctctcctgacaaccaaatgagatttcttcacctctagaactctcacagtacttactggctaaaccaatcatatgacactcatccaaaactttcttacattgtttttacctttgtgctcattttcccctctagattattatattcctaggaggcaaggcccatattcaacactttatttccctaactgatagcacagaactactaatgagagtaactacacatgtcatttatgtgaaaaaaaaacctgattgggttctgagaattccttgacttagttaaccactgctatacagtagaataccaagataataagacagatgacaaaatgactcaaatttactactactggctgggaacttcattccaaaccttaatatagtctcctgggaaactgcactggattgcatacaagctgtgaagattcctttgccttctttcattcactcaacaaatatgcagtgagaacctacaataatagtccaggcactgtgctagcttctaggtatgcagtactgaatagaacatggaatatatagtctagaagcagttcaaacagccttttggtccttttcccccaagtcacatcatgaccctgtcctatatagcttttctaaatttttttgtccccttgcgctgagcatctatcctatatatcttagtactccaaaggaaaacagtccaaagacaaaatgtcaggttttcattttttttttcctgtccatactatttcattctcagagtatgtgatctgcttgatccttgttaaacagtctcttggctcctcttcattaaataaagtagtcttaaataaccaccctactggttagactgtgtgatcaaaaaataaaaactaccgtttgttaagtgtcaactacagcccctttcccagcttgtacactgcacaggtgtaactcattcatacagtaactgcacaatgtagattattgttttcctcattttaatactgaggggaactgaggctcagagaggttacataacatgaccaagatttgtgattaatgaacactgaagccagtctttggttcatgtaatgccatcctatcccagatatagtagattttcagcaagttttggtttgttcattggttgattgttaccattctgattgaaagatctttatatattttagattacagtataagaggttgttagtctttggtagctattaatcccaggcatgtgtgtttatgttcctaatagcaattacatgaatgctttatgcttaatagaaacaaagctattattttgatgcttaaacattctttaaacatttttacatgaatacatattgataattcatgtataaataacacaaaaagatttagaatcccagttacagtttctgtaagatgcccagtttcaaagatccaactaaaaataagtgtcagctcattgcaataaaataaaataatctgattttatagacatatgaaagctgactcataacactcataactcatgaaaatatccaaaatcacattttgagcattagcttcaatgttgtctaactacattatttctatatgggaaaattctgtattctgggctgaaaattctgcagcccagctgttcccaaactttagtgtgtgccatcaatatcctctgtgaaactggctaaaattgaagatttcaagctgagttggttggaacccaaggatctacattttaataagcactccatgtgattctgatacaggaagaccatccacatctcacttctgtaagtattcttctgcaccagtgactcactagtcttcattgttgtcgtcccctcgcccatccatacacaagcagttgtgtattgcttttaaagtttttttttcaatttaagtgtaatttatataaaataaagtgctcagatgttaagtacttttatcagtttttcaaaatacacatactcgtgcaatttattcctctttcaagatctggaatattttcatcaccccaaaaaggttccacatgccttttcctagtcaacatttctctgccaccagaagaaaccacttaatttacttctatcaccataggttcgtttttcctattttagaacttcatagaaatggaagcattacattttgtgcttttttgtgtgtctggctactttcacccagaatactgtttgtgaaattcacctatttttctgtgtatatcagtaagtcactacatgttatggctgactagtatccattgcatgaatatgccagtttgtgtatctattctctcattcagagatatctggattgtttctagcttttagcttaaatgagtaaagctgctataaacattttttaccaatctttttgtggacaaatgtttttatttcttttggacaaaaacctagcagtgaaattattgggtcataaagttgatataagtttaactttttgagctactgcctaagaattttcccaaatggctgtaccattttatatccccacaagtgatgtatgagagttctggttgttctacataatcatcagcttttagggttgtcaattattttcattctattcattcttgcatgtatatggtagcattgcatcttggtaataatttgcatctgcctaatgactaatgatgttgagtgctttgtcatgtgtttattggtaatttgtacatattctttaaggaagtatttgttcaagtcttttgccaatctttattttcttatcttattgagttgttcacagtagctctttagtatctttttaatgtctgtagcatctctagtgatatctccacttctatttattatattaatgattcatttttttctctcttttcttggtctatcttgctagcggtttaaaattgtattaatcttttcaaagaaccaacttttggctttcgtgattatctccatttgttttctgtcactgatttcctttctcatttttattacttctttcttcctacttatttggggtttaattagtttttttcgtttcttaaggtggaaacataaatcatttattttataactttcttctgtttgagtgaaggcatttaaagctacaaattttcctataataacagctttacattaacttcattgttttgatatattgtactttatcattcaattcaacctattttctaaccttctttttgattttttttttttttactcatgacttatttagatatataatgtttgatttcttattgagggggtggtctatgtacattctggatgttaattccaagcttgatatttggcagtcagataacatactctgatttcttatgaatgtatttaaatttgggttatggctcagcttatggtttacttggtgaatatttcacgtgaattaatgtgttatttgctgttggtcagttctatacgtttatatcaggtcaaattgattgacagtgttgtacaattcttccatattctgactttgtatacaatttctgtcaatttttgaaagatgagtattgcaagttccaactatgattatggatttacctatgttttcttttagtgttatcaattttttgcttcaaatatgtagtgcctttgttagtaggtacacacacatataggaatttgtatattattgattaattgaccattttataattatgacatttcccccattatctctgataatatccttcaccatgaagtccaccttatctgatagttatacagccacaccatctttgttaggattagtgtttgcaatgtgtatgttttctatcttttgactgttattgtttatgtgcctttatgtttaatgtctgtttcttgtaagcaatatgtaattgagtctctcttcttctagctcccaaattctgacttttatttcgtttttcagtccattttattgtaattgttgatgtgtttggatataaatcttccattttagtatttgagttctatttgtcccatcttctctgtgtccctctgtttttcttttttaatgttttgggagtgaatcaaataacttttgtattacattatttttattatttttggcagtttctcaagattacaatatgcatctttaaattatctctgctactttcaaaacatattctattacttcacaaacaaggtaagacatttacaacattattcttccaattttcttacaaacttcatgattgttttctcatattttattctgtatgtgctataaacctctcattacaattttattatttttaatagcagtcaatactcattgatgtaatttctatatacatgcacacattattattatttttttattattatactttaagttctagggtacatgtgcacaacgtgcaggtttgttacataggtatacatgtgccatgttggtgtgctgcacccattagctcatgatttacattaggtatatctcctaatgctatcccttcccccctcctccaccccacgacaggcctggacatgcacacattgtttttaaaataaagatctttaatattttacaaatttatttactcttcgtgtttttcatttcttcctgcagaattggatttttatgtgatataattttccttcattataaagaacattttttgttcatttcttttagtgtttatctgctggagaaaaattctatgtttctttttttctgaaaacttatttattttaccttgatctttgaagaatatttttgctggatatgtaattcaagtttggcagattttatttttctttcagcactttaaagatgagatattccattgtcttctttccctcattgttttggtcagcagttatatatctctcttattgtagtcccactgtaggtagtgtttctgttttctctgccagcttccaagattttctcattatctttggtttttagcagtttgactatgatatgcttagatgttttttgtttgtttgtttgtttgtttgtttgttttattaggcttatttgatattctctgagattcttagatacataacatgttgtctttcattgattttgaacaattcttggccattatcccctcatatacttctgcttgattctctcttctcctgagactccaaattactcatgtgccagatggtttcctattgtcccacagatatcacacactgttccaattttttttgactgttttctttctttctgttgcatttggatactttgttttcaaatgtatccaagtcacaaattcctttctctactatattcagtcaactgattagctcttaaaaagaattcatctctgacattctacattttatttctagcttttcaattttttctctatttgtactttccatcgccatatgtaaataatacatttattcaagcatgtcatttgcttttctcactagaccttttaaaatatgtatcatagttattttatggtccctgtttgataatcccataatctgggccatctctgagactcagatctatcacttgagtatgtttcatatattcttcctttttttgtaagtcttttcttgttgtttatctaatttctacttgaaggcaagtcactatgtgtaaaagaacagaaactgaagtaaattatgtcaatgtccaaaaatgagaataccttttcttctattaggccattagtattttgtttgggatcaatctactcttatattgatctagatctgagctttagtgacattcagttcaccacagactttaccttatttaggagcaggatcaccatcttatctacagcaatgctttagctctgagtacctggatggtttgtctctgttctcttaacgccatacttctgcaagctctgtgttccataacacaggcaggagggtgttttctctcttatattttttacacttcacaacagtagagggtcaatgggtggtaatcagtgtactgaaggtactcaatgcccatggggtgtctctcagatgttattcctagccttcctgtactatgcacctaggactgggagaggaggtctctctcagccctccttcccctctcccaatagtagatggtcactatttcccactcattgtaaagcctagagtgtgggagggttttaactcatactttctgaaatttgtttactagcatatattagacttgtgcctgaggaccattatcgcagaagtatgtgaactcaatataatgtaaataaaatatccaccagccacctaatattccaaaactctgtgcatacttgagtaagcaataattacacacattgcctggttaaacccagtctccaatttggataccagagtttgttcttggtaaattttaaatgaaaatagtctttaaagtttcaaggggcaatggctcaagggatggagtatttgggaatgggagatactccccatttaaatgctagatgagagatggattccactctgaaactctggagaaccaggagttataacccacggagccaaaacaagaaagttgcaaaaattatatcacttagagtgaaatattatcaaataagccattccatgatggcttatggttcataaaaggctttgatctaatataaatgtgtttatattttactgcatgtaaggatcctcttcagagtattaattcacgcatttttctttagtttttgctaagtttgactttggaaaggataatataatatgaaaatattggatgaataaaagtcactgttaacatataagttttcccatctgtcttctttttcatatttattgttacaaccttttgaacttgggagacattttttgcacaaaattgaaatgagttacatgaaattaatgtccaaagatgaaagcatgaaattgcagaacatatatgtttttccatctctttattgttcatgttcactgtaatgctttggggagcattgtttatgggctatatattcaaacacctaatttaaagacaagaaaatattaatcattagcctagttccacgtttttcctaggtatattttcttagtagagtatgaagaatgtattagcttcacattgatatcctatgtatttctatggtaaatctagaactgttctcccatataattaaatagggtggatttgttccacagttattttctctatgcatctcattgtatttcatcgtgtagaaagtaatgtgattatgggctttagtcagaatgttattttgttcacttaagattcattctcaggaaggttgaacaaatttgaatttcatatgatagctttctttatgtgcttcagtaactctctccctttatataagagaaaatcttcttgttgaagagatctacagatctccccagtgcctggggggcctgaactagcagcagggggggcttcaatgaaggctactgcttcctgtgcctcattgataggggtgctatgcatatttcccagacagaatgttggtgttgcagttactaacccttctagatatttgatacagagtaaaatttgccttatttcctaaagcctctgagttaaaaaaaaaaaaatgaatcttattccttttcattatgtgatgtcgggcaagttagtctttctgagcatcactttccatatcagaaaaaaatgagatacacataatacctacttcgaaggattattgtaacgattacagatatggtttataatgagcttggtacttggtaggcacttaccaaatatgagctgtcattatggcagcagagcgaagtgttaaaagtagggactccagagccagactgtttgtgaccaaatcctgattctgatatgtactagctgccatttgggcaaattgtttaacctccctacctctcagttttatcatccaaaagttaggagtaataacagtacctacctcatcagtaggattaggttaattaatacatgtgtaagaccagtgtttggtgcatagaataagtgcaatataagtatttgctattattcttctccatttcacacagcccatagtagggcaagctgaggagatgggaggccattagaggtctcaactgagtatcagtcgtctcagttggtctacagtagataagagattatgactttttgtcaaaatgtatgtgcagataaagctgtctttaatagtgtatgtacatcaacaagaagaataacaaaaacagcaactacaatttattgagtctgtactacatgcgaagcacatgctaaactctttacaaatattaaccatttagttctcccaattaccctaggaggtagacactaaagttatttaaatttcacaatagaaaaaattgaagatcagagaggttaaatagcattctaaagtcacatatctaatgtgctactggatcaagattcgcaattaagtttcctagttataaagcccatgctcttaaccactctgccatatagtcctcttctgcactaagggggaagcttaccccagggcttcaggattcctgtgctgcatgatttttttttttcaatttgatgtagcaaatgaaaaccctcaaaactattgtctttttgattagtggtggactaactaaattcgaagaactttcatgtccataggccttggaggtcatgtaacttagatctgtcattttatcggtgtggaagtagatgcccagagtatagatggagctttcctgaagtttaagacgagttggcaggaaaactgatactcaaaccccaggatgttttttttccgacattccaccaagcctgtagtttgaaaaatggcaatgacaatgcaacttttatacaactcgatgctgtttctagttatgtgcaaacccataacaaatgttgccttattataatgcctagtccttacttttgcaaatgcaaagtcatgctttgttcattaccaataatataatatttttacaggagggttgtgggggggaggaacttcaagcttcctgagtacctataagtaaatatcagtagaaatacatgccaaataccgttaggaaaaaatccattatattatcaatactcattgccctaaatggcatttctctactgcaatcatgaacaccatctgcagccagcttccctgaagaagtacagacttgaaattcataatgtctggtgctggcactcttaatgctgaaaaatcttaccgtactgcttaggaagaacaagtgtgcagtttctgattgaatgagacataaaggaactgttcttgacccattttgacttctcgtgcactggctcttagatccagggagttttatcccctgggtaaataaccatatcatggccttcagtagtctttacttgttgcttttctattagcagtgacgaaggatgtgcatgcttctcctacagacctgttggtgcagtattattcgtgtactcaagatggtccccttaactccagaaattataaagttagagggaaaaaaagactgagtgaaaaataggccttattttacatacatcttttccagtcccataataccgcattacttatttccccatagttcgaattaagtagaaactctgttcagaccagatggttctctgaggtggtttccagatcaaggtaagaaatgaagtaaactgtaagttgtaaaacatattgaaccatagctcgcaaaatagataaattgaagccaactatgatgtgaaagacaaatgaaactccaaatatttttaataaacttataaaaatgttttgaataattttaagtttacagaaaagttgcaaatatagtacagagaattcatatatacccttcatctaggtttccctaaagttaacatactatggtacatctgtcaaaactaagaaatcaacactggtacattattatcaactaaaccccagactttatttggatttcaccaggttttccactaaggccctttttctgttccaggattcaatccaggatagcacagtgcatttagtcattatatctcctcaatctcctctggtttgtgagagtttctttgctttttattggtttttagctcagactgttttaatagtaattccacatggcttatgtgtcctaaagataagaccactgactattccagcaattcgcctagtttacaaattctaacctgcgttgttaagcactatacttaaaaacttctgtcctaaaatgaattacctttgactaaccccagccttgaaaaccctgtaagtactctttgctaactcctcctttttaacatagtactgagactctgtcaagggggactttctcttgcttagtgtgtttcacatacccagctttgtatgatcagcaggtttctctggtagtctttgtgtgagggctttgacaaaagggtctatgatgataccattcaatcatctactaaatgcaagaatcccttccacaacatctgattggtactggaataggtctgtgtgatcccatggcccttctatgaacattgccagtgacaagacattgattacctttcaagatagtccatgctacctatttttatacaatccctattgttggaaatgtcttcatcaaaatgagccctaatctatttccgtgcagcttctcttcctttgtcttatttctgtcttccagaaaatcaaaatattggatggaaagtaagctccgtgtacagttccactcaagtggtatgcaaggagtcggacacgattgggtggtcccagctttgttcacatagtgtcacttgctggttgtgtgaatttgggctaatgactcaacttctctgggccttaattttcttacctgataaaaacaaaacaaacataaaaacaccctacctcataggagtgttgtgaaaatgaaagaaataacatatgttgaagcacctagcacactgacaagctcagagaattctcttaacaaatgatagttaccttttggtcagatgatcaccccctgagtacccaagatgaaatgtaccatttatgttatattgcattattgtgttattagttctgcttcacagcagtgaattgtaacgttcccttcttgttaactaatttcttaaaaggtttaattttatttttctgttgacctttttttcccctcgagacttaattaagttgttactgaacagaattgaagtgttaaataacctaagatgatgggtttctagcattcatgaattccacgcatcgccaaccggtgagattagtcatggcagtggatgagagagcttggcagggattagcaaatactcctgttaatcagcagaatgcgcaaattaggccctggctcatggcattgatataaatctccatggcaacaccagggtgagctgtttacatgtgaagaagtgatttcaaagctgcaaaggatgatagaaattactgcaatgaccataaataggaaaaaactgaggaaaggagaagtattcccacttcttaaagaaattcatacaactttctataaatttagtggtagttttaccatctctgagcctctactactggaaagttaattgacagtgatataaacagaaagaaagtaagagggagtagaagagggtctgaaatcattcataaaatatacaatccatccctctgaccaaataactataaatcaggattatttgcatatctgtgtgtagcaggactgtctgagttagtatcctacttccaccatccattagctgtgtgaccttaggcaaaatttttaatctcgtcgtatcttttctcctcacctataacataaagctaataacagtacctacctcagaaggttgttatgagatttggataagttaacacatgtaaaacatttggaacaatggttggctcagagtaaatgcttgggaaaatgttagctgctattattattatcactgttattattattcctgttagttggccataattcttgaatatagactacctttctattttataccctgtaaagaaactacagagtgggaaaggttatatttttcattttctaattttgtttgtgctggaaaagagacttggaaatgtcagcactagagaggttttatagatattatcattttcaatttcagtacaacacttaagaaaatgatagctgtgatactagttgaagcataggatccaagtaaagccactttattatttaaactctcatcaaaacccgggagcaggtggatatctataaaatgtgatgtgatcaaaattgaattagattatctcagaaatagagctacctttttaaacatatatgtagctctgaaaattaaacccaggcccctgtcctctcatggaccaattttctctgtggtttcagctcatttcaccttacttgtgtctgttggttgattaggcttctaatccaagcaggataattgccgtaattcaagtttggattcaattttcagtgcttacatttgatgggagattattcaaatagatactgggctgtttgctttgtgaggtcaaaattgttgctacttttttattaatgccaacaaatctcttgccagtcaccacccagtggttcaaaagcttttggaggcagcctaatggagctgaaagggagtgagactaagagttagaaaccttggttggaaaccctgctggcctcctctaccatctgactcttggtcgttcactctcatgtttctttatttgtgtttcaattttattttcttgtgcacctttttgtaagccacttcaattcttctttggaatgaggtaggtcagcagtgacaataaccagagtaattcatattccagaaataaggcaatatgaaagaggctttaacataagtgcataagtgtgatcaaaatgttcagtaagataaaggaataaaactcttaagatatgatcagaacgttatgaaaaaatagacatattatcaaacaccaaacagaaattgtaaatatatatatgtatttaatatatgtgtgtatatatattttatatataacatttgtgtgtatagatatgattttgtatgccattcataaaatattattgtataatatatagtatttctaccaatgaaataaaaacaaaatcaacagataaatccagctaaagaggggatcagtgaagcacccagattttgcaaagaaagatacagagatggaactaggaaagagaagtaaggaatcatgagggagagactaaataaaatgaatattttatccgttatttctatgttttatggaagaataggtaggatgcacctaacagaagtttcagtagaacaacagagatttaaagagaggcaataagtaaagagttgatagctaaatttccagaattgaagcacagcaatagaaaaactgattaagcacaattgaagaggaatacagtgagcagggaaattttcaatatgttttcaatatattcaaataccaaccaaatcctagttgttcctctcctataggaatactgaaatctatatagatgaattactggcattacctggcttggacagtcttttcacacaatctttaatttgttaccttaaagttttatcatcataaaaattatttattgactgcccatgtgaaaaatctctggtctccaacctcacgccagttatatcaggagaatggctgacttaccatgacatacatgccaatgtaattttcatttttattggcatctttctaaagggattacttctactacaccctctgctgttgccagtcagaaatcagtaacaactgtatacttgaacatcaatgttgacaatatgtactgaatgcgatcagtaggaaaaagaagacgatctctttaaagcaaggaataaaaacttacaaatgttcatcagaatatccacatagcatagtcgatttctcccagtccccagtggttgatgttcaaagggtagtgatataaaaatctaaggttttgcaaattctttacctgagggaaagtaatatggcctagtaagaagaatatagtaccagtagtcagttgaaatccaggtttgaagtctggctttacctaatttcgttccccaacttctgagcttcttcccatcctcccacattcatcttcagtgacaggttttgttttctgaagctggattcaattcctgccctcctgccctcctgcccacggagttagctgcaccctctttgggctctgaaaacactggatatttagtatcattcttaaagtgcttaccacacttgtgttttagttaactatttacttctctttctcctccacttgaggccagggacagtcactggagaggcagtagagtcattttttaaaacatgaaatataaaggcagtatgcacaaatttaaattctgactccaccactccctacactaatgaatgcattagcctttcttcatctcagcttcttaatctgtaaaatggagataagttcataaggttattataagtattaaaagagtaaacaaagtacaataagtcctcgcttaaatgtcataaataagttcttggaaattgcaactttaagtgagatgacatacagcaggtcttcaaataatgtcatttctttcaatattgtttccttataatgttgatgagaaaaaaatttggtttcgttatgtcatttcgcttaaaattgcagttttcaagaacatatcaatgacataagtaatgatttattgtactttgaatagtgcccggagtagagttggtgctcaatacattagagctattagtatttttgcatccttcaggtcttagctcagtacttgtcaaacagttatcagtaaatgttgaatgaataaattaatgaatgaacaaatgaacaaatggcccaagccaaatgtattcaacttctcttgcctcagatctcttctctaaaatgaaatcattaggtaagcatcaaggcttctgttaggaaatcagtttctaaaattgcttgaggccttcagtggttgcacgaaaagttactaaataatttcagtctgttgactgtacttttaactgtttgtcagaagagaaaagttagagcaaattagctagaatagatattggagaagctcctaattgcaaaaggatagtcatgggcttccgagtatggaagtgaatacactgtgtataatatttttctctcttttggctgaactcaagcttcctgtagctaaaaacagatggcacaaaaaagcttacagtgtggaaagccagtttttcctgtacgaaaagaactgagtgtttggagtgctttaacttcttgtctctgctaagtagtgatggagagaaaggccgggaagtgtcctttgggtctcatagcattccaaagtcccagattacctgagtcaaaacaggttctagtgttaaactatttcttgggctaggaaacatagaataacattaagtagtgctttataatcctataattttcatgagaaagttagcaatgttttctttaaatattgctataagaagttattgagtgttatgaactgtgcttataactaggcatagatcatatgtattatttttatttcataattcacttttgttaaagaaaaaaaaactgattagaaaaatcatgctatatttcatctcgttcagtcccccaagccaaaacatagtcacatccaggcaccactgttgagcaacccaaattccagacccactgccaatgaggaaagaagtagtatttaaaggtctggccttgtatacataaatgtgctttttggctcaggatccttagcttaaatacttgcacttccacttatgtactagccaggaaaccagagtcatatcacttagtctttccaggcttcacttttctcacctttgcaatggcaataatgataatacctaccttacatgttgttgtaaggattaaagggattaaggttatagcacttaacaagttgcttgtccaactataaccatagtatttattgagtgttatcaccatttccaaccccagttttgggaaaaacaaatctaaagcagaagggagagcttaaaaatcatctagggcatctgcacagttctcaggtgggttatcaacctgtctttcatctcctccttagaatatggaggatagtattttctctgaatataccaggttcttctccccaaatcttggtcagtgtctgaaaagagatgtgttaagactcttaatcctgagggaacactaaagtattttcccattacctctctgttgctttaaaaaatataaattcttgataggaaattggagcaaacagtgccattggcaagtaggaaatccatccagtgttccttaatgctggttgtgaatcttgcctccatatgctaaataataacagacactagatcatttgcccacactgcattcctttcctcaaatactgagtttaggtcaccttccagtaactttatttcctgaattggcttaaatccagaaaaattaggttgtctgccattgcctcaaatcctccatcattttttcccctagcttttcatttaggttacctagttcactgggcaagaaatgaacccagtgttacagatattttgcctctgattcttgtacatttttagcctgccataaatgtctcaccatagaagcacctcacttaatgtttgttagccatcacttagttcataaaatagaaattgttccttcaagatcttcaaatattattgagtaaaacagaatcaaattcacttagagaacctgatgcttttcttggctctagacactctgtcaccactgaagcaacccatttgattaataatacatttattgtgtctacaaagtgttttctgcaagttggatgagagaaacttcaggaaatgaatgtgactgccttgatccacatgctccaagttcatccagtatgatcttccaaaggcaaaagcactaacaattagctttgtgttatggctcacacctgtaattcccagcacgttgggaggccaaggcgggaggatcacttgaagccaggagatagatagagacaagcctgggcaacaaagtgagaccttagccttagaaaaaaaaaatagttaaatgtggtggcacgtgcccgtagtcccagctacttggggactgagatgggacatggcttgagcccaggagttagaggttacagagagctgatcacgccactgcactcctgactgggtgacagagagaccagatctcaaaacaaaacaaaacaaaccaacaacaacaacaacaaaaacactagcaatccccatgccctatcagaggggacctttgccttctcataatggtgttactgcccctttccactctcctagtgattacttcttggtggcaggtcatggttatacaaatagtcgtgtagattttatgacagaatgatagtcttaatggaaaccaacccacatacctagctagatagaaaaggtttttgttgtattcataaaaggttttatagaagaaaaatcagcaatcaatcatagtatttaacaacgctcactgaaaagaatgttttccttgtacaaaacttaaatccccacatattaaagcttaagctcatttccttgtattctctcctcaagattaagggagaaacctccgccccagaaagctgctatttctctccaggttttcttgattaaatggccaagcaggtaatcagaggccttgaactctcgatgttgcagctgccatggctaattaaatggtgaagtgctgaattcacagacatgattaataccatcagggcgttttatggctttaatgttcataaattatgactgaacaatgaaatttgtatgtgggttataggatttttcttcttaaggatcagaattaatcagtgttttctcaattgattttaaatataaatcagaggtagcatcagtaaattctatagcttaagtatttagagaatgatctcagaaacaggacataatgaaaaccaagccaccatcctagtgtgatgcaagcctaaggtcttgtggattttcattctaaatgcaattcaggaaggccaatcagtttctaaaaggatggttctggagacctttgtttctgaagtataactcccctaaatgatctaatctttgccagctaatatatgtgtcagggtatgtaacagaatacagtagtcactctttctttacctggcattctagtgtgacactaacaagatttccttaaattgcatttttcttcctggagttaagtgtctatttcttttctttcttttttcttatttttcttttttttagaggcagggtcttactctgtcacccagggtggaatgcagtggcaggatcatagcttgctgcagcctggaactcctgggctcaagggatccttctgcctcagcttcccaaaatgctgggattacaggtgtgagccactgtgcctggctggctgaaaagagcctattctgttagcttttctctaaactcctcatttgtatttctatccagttgtttctctgagcctttgtacataattagaccacaaaaggtggtacttggctacctcatctcgtaaatactctctctgctgccttacttagtgaatggggagatcccagtgttactcgacgttggtgcatttgaatctgccaacatttcctttctttgagctcatcatcagtccttgaccaggtaacttcccactcagatattttggtgaactgttagtgtagaaggagaacaaactggcaagtgattctgagtgagcttatcttcacataggaagggtgtttgaaatttctcattttcagaatttcagaaagacagccaattcctttctgctcagaatggactgaggctgctcccgattaggctgtctgagttctctcatttttactcatcacagtcacatctgtttgggtttctgtctctctcctggagatgcctcttgagagcaggtcccctcagcttccttacagctcctctgaggcctgccaaaagagattggcagagaacgatcagcattctatgcccagataactcacataactctctctgaaaagaatgctaaaacctagttctcaagtgaacccacgaggagtggaatcaaagggacttttgcattttttccttggaatccaatttagaatttatgttctcatggggtgggaagagaacagagagatgggaagtatgaagaggggaagataaagaagtaggaacaggaacatatgggaaaaataatcataggctcccagagccaaaaggactttaaggaacatgtcatctggaggtttccaaacgttttgtttttagtaccagaatcttttcatttttattttttacgtaagaaatcatacaatgagctccactatataaaacagatgaaaagagaaagagaaataaacagttgaatgaaaacagttaaaatagatgaaatctactgttgaaacattggcgagggaacttttattacttttcattacttttagattgctgaagaatacaaagtgaaaactgccaatcttgtctaagtattactttaaagatgggaaaattgaggcctgtaatatggagaaatgacatactcaaggtcacacagccaattagtggcagagataggattaaaacatatgtttccagcctgccaggctagaactctttgggagttgagttagaaaaaaaagctaagaatgctttctttctgaacatggtcaaaaagagaggttggtggacaatgcaatgggagagcggacacgtgggagaaacaacggagaatagaccctaccttagaatagagcatagaagagtttgaaccaccagggataagcagagataactgaaatttacaaatatggaggagatccaggaagttccatagcaaggccacaatgtgaactgctaggaacaaatcaaaactggagaaaaagggatttggaaataggtgtcaaaagagaattctttattacttcccctacacaaatgtcgtactattggcccaggatggcagtgggacagcaaagacaagcaaaatatgcttctctaggattggctgcaattctttcattataccttctcaagatggatgtgactttggcatagtttcctgttggagatttgaaagtaatattcacattcgtctctgaaattttaagcacctgggaaatagacatgagagttaggaaaacgcgaacatatctgctttgtgtgtgtgtgtgtgcgcgcgcgtgtgtgcgtgtgtggagtttcgctcttatcgcccaggctggagtgtggtggcctgatcttggctcactgcaacctccgcctcccgggttcaagcgattctcatgcctcaggctcccaagaagctgggactacaggcaggcgccaccatgcctggctaattttgtatttttagtagagacagggtttcaccatgttggccaggctggtctcaaactcctgacctcaggtgatctgcttgcctcagcctcccaaaattctgggataacaggcgtgaggcactacgcctggccaatatctgcattattaatggttaagttcattgagcaatatgatttggacccaatttcaaaatggttttctttcactttctgccccagattgaatttaccctctggtcacaggcctttgtgagttctctttgtggaagagagaggagaatgaatgaggtccgtagacagacagatcacagagagatgcccccttctcaagtctcattaataatgtgccatgcattttcctgttcatgaaaacaaaagattcaagggggtcaggatataaaaagacagaaatatcttttgtgggttggcaggaacatgtgacagagggagagtctcgttccccctcccccatactcttcatttttcaatattatacaatttaatcagggagagaaggattagagcaagaaggacatctacaaacacgtgtagaatcacctggttatcagccttggcccagtggttccatgagcttatgtggatggtagacaggagttagaaacaaaaggatgtatttacagtttgtgtttgcaaatttgtaataaatgcccccgccattcttattatatattcctgaagtcttctctgagtctgtttacctctaatatgtaccacagagtgtccacaccaataattctacaggcgtcctgaaaataccttatgaatggtgtttgcagaagcaaacagtgagagctatctgagaggagaagtggaggaaaaacggtgtgggaaagcccttatgattttctcaataccatctcttcttctaaggtctatccccttcctgaatcagaacttcatccttctttagcttttgcatgcctgctctgggtcaggatcccaagagagaaatgagagtaggaacaaaaggcccttggggttggtgcttggcagaaggtaaaaacatgcagagaataagcagagaccttgtacctgttcatcacccaccccaaatatttgggcttgatcaaagcttctcctgacccctctttatgtaagatatttcccttcatggtatctggaatttaaacaacaatcacaaacattttgaactaggaaatagcctcctactcttcagaatcaatatcaatcagtcattcctcagggatttatttttccctatgaatcaaattttaaagaagtggatacttgaatagacttgaggtgttaaaactctcgtctaccttgtcctcccttttcatttgggaaagccaaaagcacaaaagagtaggtagaaaatgtcagaccctttggcatcattctcctgtaactatcagtctcaacccactgcaacctttaccccagtctgccttgcagacacacagtggtgcttctgatggagcaagagacatttcaagattgcagagaagtggaaggaggggtagcaacagcttcccctgtgaagcaatggaatctacagaagggtccggtgattcagctcttatgggctaagaagcctgaaagcatttcagtgttgctgagtccgagcttgtttgttgggtagtcaggcaaggaaaaaagggctagagtctgaagataagctgagcatctggttttgcatctacattagttctgaaaagaggtgatgggggtgccatgtaggagtccagtaaagacggtgtagggctgccaggtagtagagctgctctattttgcttcctagttggcctcagaaatcaagtaaaatagtcaaataattgtgtctgtttgaaggtagggatgtagacaggccatttctctttgctgcatttctggcctcaaaacctcttctttcttttcctccagaataaaatataacacagggagaggacagaacttgttaatagactgaggccagcaaaaagccagactggttcctgaattggagggaaggaggctgcctgactttggaggagcagaaaaaaataagttaggagattagagatgggccacagcttaaatagagaggttcgactctgcatttcccaaatacgtaatgcttacggtacacgacccaagctctctgcttgaatcccaaatctgagcggacagatgagggggcgcagaggaaaaacaggttttggaccctacaaattggcttgaaatgaaaagtcagcaaaaaccactgggtggcagcgtggtgtgcgggcgcagctctgcagtgtctgcttctgctgctaccgctggggctgaacccgtctggggactctggcctcctcccctgaatggctacaagtgtcgccaagcaaaatacctctgcgcgggtgggtgagggttctccgggttgttggtgcgtccaagcctgaggcagggatctggcgaacttctgaggggctccagcccgagcacaatctggtcagctcaaacactgaggaaacacccccaccactccatcccccaatgccgagcaaacccccgctccgtcagcccaactacctcatctcagttcctcctccatcactgtttcctcccgaagctcctttcgggaaaaggaggggagaaggatttggacgactggggcagtgcggaagcccctacaggtgttagccggaacgggcggccggggacttgggggggtgggggtgggggtgggggtgggaggggcggcctgcggctccgagcctacgggctcagccccgggagggaggggccgtcgcgggagggggctgcaaggaggctgtcgcgctgttccggagggtgcctgcggcggctgaattcctgtgctgcgactgtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcgtccctcctccgtccggccgcccgagctcccggcctctctcccgcccgcgctcactccctccgcccgcctccctcctctggcccccatcagaagggcaacagggcgagggggtccggcgaaattcggaccggagcagctggacatgcacggtgtccgccgggcgcaggggccgaccacacgcagtcgcgcagttcagcatccgcgtgccagtctcgcccgcgatcccgggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccaggtcggaaagggcttttgctttcttttccccatactttacgagtgaggtgggggcggtggggagcaggtatgtagcataggtgagtttgttggtggcccatcttgtgcagaagaggccacctagcctgtgtgcgtgcgtgggaaggcgctggctttcttgcctccgtaacagtaacacgcttgctgcattgcaactgccctgggacaggcgcagagcctgggggcatactctgccctgggtggcttgccctcagcttcggacatgtcacatatgtgcatgcccggtgggctctgggcaggcgtgacccagacatggctgtgatatgtatggcgtggaaattgcaggcgcagagctgggcagacaccatcctcccgtccccaggagagcctggggaatccctctcttgcttttatctctgcctcagacccttcccctccagcttccacctccaagggatgtgggcttctgctgtctaggcattgcgtttctttgatgacttttaagctttttgggacagacttgacttgtggtgcagcttcgaaatgtttgctggggcggggggaggggggatttctagaaccttgttgcaaagagctgagagatttggttagacttagtgtaatcggttacatgctactaaaatgcggtgttgaagaggggatttaagctcatacccagactgtggtgcttttgaacattttcagtggtaggagtagcgcgatattccagcgactggaaattcagctctaggtgtcaggttgcgtcaaggcagaccttcaggcgagcatgcagtttatttgccattcttaaccaaatgaatcttttacactcttttctgccttttactagataaatattacaaaaaaaataagagtcaccgatctgttatttctccatttatgtgtgctacaccctgggatggaaaagcagacataacgttttctgtttgcacaaagtttttaatgcattaactgtaaattaggcttgtttcaaaaaggcttaagtggttgcaaagcatgcttatgtggctcgaataatcacataaatattatttcagcgcaggagtctatattcagtaaaagaaaattttggataacatggctgttattggtaaatgagacacttgattgatctatggttattcataattgaaaatcattttaattaagaactcatatttttgataatcatacttctgatatgaaatttgaaaaattagtatgcactgattttttccttcctaccaacaaaaaccctgctcttttcacacacattttcactaatgataattaatatgacaagatttgttaatggtggttgtatctccctcctcccttttttggtataaaaggctcaattttccaaatacagtttccttaatggggttccacgttatttatgcattttctaccttcttagaataaaggagattatttattcaaattgtggtcattctgaaggaaatctttgctagtgggtttttggtccttggtcggttggcagacaactctgaattatctttctatttctccttttcctttcacatgaaaagtagcacaatttcaaaaggcagaatagccatttgccaacccattacaaatactcagtgagatagagttccactctgtaaaccaaaggacaggttatcagaaactatagacactttcagaagctttaccaatgtttccagatagaaataaaatgtttctttagtttgaaaatttattctgaaactcagagtttgttttctttcttccagacaccttaaaagtgtagtttgactttttccattaagatttgtaaatgaaattagaaattgaaattcctagtcttttcaactacataggcacaatttatcaattgatccaaatcattgttctctttgcagagcctcagcttaagggtatagttaccaagctatacagccgacaaggctaccacttgcagctgcaggcggatggaaccattgatggcaccaaagatgaggacagcacttacagtaagtgactgcaaaataaatagtatatgccagcatgttgttaacattctgtttttatttattttaaaaataaatacgctttcctaaatcctgaattaaatgcaaaatatattcacactacataatcctgtttacacaggttaacctaaaggaagttgaatatgagtctgtctaagatagtaaactagggcaaataatgttgacaccatctgaagaataatccaaatgtcatctccatggaaatctagatagatttatggctatcctttggattttattacttttttcccacagaaaatttactcacccacacactgatccagaaatagcatgttatctctactcttaagaaccggtcttaacccaagagagaggagtggtttcataccatgaaaattcatcattacaagctttcacttctgctccctgctccacacacacactgataactctgagactagtggaattttaacattgagatacctccgcaggtgggtaaagggatttcttttagttctttctttttaaccatggtttcagaccaaattggagactataatggtgagcctaaaaaagaaacacataaaaaataattaggttttatttccaattactgaaagaaggtgattccaagatgttacgtaacctttaattacatgttttatttattaggagtaataaaaatataaactcacaaatagtgcaggcttctcctcaatgatgattgatgttttcttgcaatttacagatttctggagacttactaaatgttccacaaggctaaaacacttagttctcacaattttttttgttttctccaatttctactgaatttctctcaaaccctttgataatttcgcattaatattccaattgtcggctgagaaaataaccaaggaaactaggtctgaatgctaagcagtatactctgcagctttttaagagttgtatggctacagcaatgccattgacgagggtctcaataagtgtaaagagtttcccaccttttaggaatgcttcgtgggctgatggccgatctataacctcgagaggaagtcacttttaattaccattgaagaaagctttgttggtatggaggatgaaaaaacctcatactgaatggttcttcactgttttgcaaaagttctatgtcactgttgtgatattaaagttttatagtaaatcctagttgttcttttatgcatagtcttctatttgaaactattaggcaagtgtaactagagggctttactgtaatcaaataacagacattagtgtatagtgatcatctgcaataaaacattcccataagttattgtgcaaattgatatttggggaaggaattaggggatgtaagctgccctgctttccagagtgcctcaggaaaatgggtctgttgagcattattgaaggcaagttcatgattagctgccagtgagcctatccagtcacgtttctttcccctttttaacatctccgggtacaaatcagagaagaaatattttggatctggtgttcacatgtgtttcctgaaaagaaataaaaaaaaagtagataattcatgtgctgtgtcctatgaacagcaatataccaaattcatcgagatcacattctaagtaatcattttaagagatacacacacacacaccacacacgcatatatcaaggctccatttcttactgtggagctttaaatcatacagtaggttttactcttcagttcctacatatgcatagcttctgcctttggttgtcttataactgactgatacgcatggcatttctgtgtactactaatgatattgaaagaccattaaagaacatagcctgataacaggaatctgtatttaggcagattaaaatagagaggtaagtcaactaaaggtaagtattgtcataacctgatgcatacaaatggaaagtatctcaatagaaatagcaagtcagtagagcttggatctgctcctgatgttaagagtgaccagaagctagtgagctagctcagctttgccattgaggatattgtggggcataagccatcatgaaacaagaaggtttaatgattaaactggtatatcatgaaggccagctatccaaatgtattctttttttttccttaaaaccaagccgttttattggtattaattgtttaattgtgcataacgagaatacaagttgtttttttcaactatcactcatgtatataatatttccctaatatgtattcgtgatactatgtttatatttttcttactcttcttatttttattaaccttcattattttcagcatattttctcatttagtttaatttgattgaattgcgttatttttattcagacatagtaagcaatgtcctgataaatcagttcacatttatccagatatatccatttctgaaaacatatgtttgatattatgcatttcaccttaccttacgtagatttattacaatgataaatgtcagttcaataaaatctcatcatgaggaaatcagccattgtaaattatgtattttcccttgaaaaggaaaagatgatagacattccatggcagtaattttattatgtctgccctgggtgcaaggaaggacattttaaaagactagttttccctttctcttcaaactcacggtagcattatcagttcaacatgttgcctttccaacctacgttaatatatactttcattaattattctcttttgagaaattgaccttggccaactgatgaagaagcatggcttcagtgttgccttcagcaaacactgggtgccaactaggtacatggctctgattaagtggcccttcaaatagaaggtgtttgtttttatgcagacataacagagaacaaacaagaaacacaggcacatttatgttttaaaagcttcttcaaaactttcactgaaatggaagaagagattttaggtatttaatgaatgtgttttaaatccataaatgaagtcaactgttttcttctcatgtttatagtatttttatcctgatcaaaataatatattaaatccatgaggaaaggtaccagatatagagaaacaaaagcacataggaggatatttatttggtttaagctcacccctgatataatttctttgcatttttatctgggcagactgtccctttagacatattttaaacaaacccggtttatgatctatcttgaatgtttaaagaaatgaaaagatcgtagtagtatgatcagtcaatccctagattcgctactctcaacaagtttttattttggggtgatgttttttgttttttaatcaggcttcatggaaatttaaagtacatagtgaaaagtacatagttttgctatatagttaataccattattcaagattaaataatcacaggaatgtactgctgatgtttttttcttctattcctccttctgttttctgatgtttgaaatttagacatttcattgctcattaaaacctgagtcagagtgattggagaacacggtgaaaatcaaatcagttttttttagtctctctctgtttctttcttgtgcttgttataagctgcattaagagaactaagaaagttcataatattattttaaaaactgaagttctataaataattctgaatttcatttatcattctctgtcatttattactatgactaaactaggtgtcaagcatatactgatattatagttgtcaagtggtatgtagtgatatggcttttaaaccaaccccatgttggaagttttgctttagttttttagatctcagattttttgaagtatgagcttttatataaatgggattgtggtctcttacttttcaaaaacatagtatcatattttcaccatacagattgctatcaatccacaaatgggtgttgaacacctgctgtgaacaagacatcgtcaacagaaagggatatgacaaacatgacatgctcagagatgtcagacttcttgcctgtgtattgcattgtcaaatatagcatgagatcttggcttgcaatctgtgcaattacattcctttacctcacataacagaagggcacagcttttaatttgatgagtattgaatgaagtgccatcagtggcatgtggtaggaacacttgtcttttgaaccgtacaatatgtcctagctcctctttggtaacaccctggttttaaaggaacgatacgttgtaggctcaccaaggaatatttaggtcttcattagtatttctcatccatattaccccacctactgcagcagaatgtatatgcacagagataaacgatcccagaaaaactattcttacccacagggtgactcctttacattcttgttcacagaaaccataacagactgatttattatcctcaataaacttacaaaacaaggcaaaatcatcaacattggtctacgactcctgagagaaaggtgcacaggctattttcaaaagatgtgtgtggcaagcactacgttttaaaaatgtactgttttatttttattcacagtgtgggagggagtagacagctggtagtgggaggacacccactagttgtctccagtgagtggtgtgtggttgtgaggaaagcctgggtgtaagtttcacgcagtcagatcttcaaatggagaaatgaagtcctcactggcaccaactggctgcccacttgcaactattttgctaaaataataataataaaataataaaataaacctctttcaagttcattatttttattcctatgtcctttgttcttggagactaaaagctaggagccctctcaactctaatcttggaaaatgttggtcctttaagaaatactactctgaagccgggcatggtggctcacgcctgtaatcccagcactttgggaggccgaggcaggcagatcacctgaggtcaggagttcgagaccagcctgaccaacatggagaaaccccgtctctactaaaaatacaaaattagccgggcgtggtggcacatgcttgtaatcccagccactagggaggctaagacaggagaatcacttgaacccaggaggtggaggttgtggtgagccgagatcgggccattgcactccagcctgggaaacaagagcgaaactctgtctcaaaaaatgaaaaaaggaaatactactctggaaacataggactacaaaatgactttttctttttacaagacctgaatttattttggagttcttgtatttggaataacacagataatttagatgagggcattggactcttctaaaagtctaggactctctacccaacaggtagattttaaatatgactgtgagaatttcagcagttatcttggggagcagtttaaaaccttaatttgttgagaatgacactatttaatgtacagaacaattcttgggactgtatctttccagaagcatcaagattccccacctccaacactgtaaaaaccatgaaattgtgaccaaaagccttccattttctccaggctgttaaataatatgtagttacagctccagttacctggctgcaaccatgaaattaaatacactaaaaggtagaatgagacctatctgtctgcctcggggtatgtgtgggtgtgtttgtgggggtctgtatgtgtatgcatgtctacataaacagacatatatgcataccctcaccaactacacactacttttggaggaccaggcagtcctgctggaaacattgaaaagttctgaaattcagaattgtaacactgttttcattttcttttttaatttcagctctgtttaacctcatccctgtgggtctgcgagtggtggctatccaaggagttcaaaccaagctgtacttggcaatgaacagtgagggatacttgtacacctcggtaagcttttgactgtgtgcatgttttgactattctagttttcatccaatatgaaagaaaatgtgctttatatgtgttatcattacagatttctgtgatgaggagaagaatgttgatggaaatatttcattgaaaggacagattaactttctgtgaaaaatatatctattactaatcagttatttgaagcaagcattttagtatataatcaaagattcactgaacattttttaatacagtgtcatttgggtcatcttatgtagcatataatggtctgtcttgctgccttgctttgcagctgtgggaaacaaagtcatttctataactcagttgaacatatatttatccaggtttactcctaaaaaaacatgagatctctccctcagatcagctcgaggacatgaaaaccagttcttgaagggtttctagagttctatttcttatcttcagtttaattgaacaggattcctgattgcttctgctttaaatataagcactatttaacctttccttacctataaattcctgcttgtctttttcttgtaactttggagtgaacagaatgaaaaatggaactttttctcagatgaatgtataaacaatgtagattacaattcaatatggaacatggggccaaattaaactttaaaaaaagttaacatttagatataagcaaaatgatacagtattagggttaagattttattcttattggcagatctagtttcagattataagagactatttgatatatgaatttttattttaacttaattaattaattaatttatttatttatttatttgagatagaatcttgctctgtggcccaggctggagtgccgtggtgacactccatatttttagcagagatgggtttcaccacgttggccaggctagtctcgaactcctggtctcgaatgatccgcctgccatggcctcccaagttgctgggattacaggcgtgagccaccgtgcccagcgtaatatatgagtattttttaaatctttgttttgaattcatgtattttaataaaggaaaagaatgtttaaaatggagaaaattgcttgtcgaacttcttactagcaagtcttgaagcaggttgttagtataacaataaaaatctgttcctcaaacttcaggtgaaacactacctttaaccactcttgcttgcttgtttcctgaatttctttcaaagccaggtgtgcaggaagactcttggcagatatggtggaaaccatatgataaccctgttttgcagaggccaagatgggaaagaggtgggaatagagtaaggccccagagggcctgtttatttggtaaatcaggtagtttgtttcatatgatgagaaaagattatgaaaaaaagagaattatcagcatatacctcaaaccctggtcactatcagttttcctatcaggcaatttcagtggtctggttgcttaataaatatgggggtttgctctttttactaaatgaaaaatgtgattttatggcaaagttcatgaaatacgtcattttattactagagtgctactataaaagataggaaaggggattttattttagatttgtgtactaaggtaagataatttaataatgaaggattttaagtaatttcctttagatcaacagactgcctcagcaggaccagatacaaaggtaggttttttaataaaatagacgctttctgaaaatattgtgaaggcatgataaggaaacggaatatactgggcatacttttgagaaagcacatgccagatatcatatgaaataattactgataaatcatccagaatttcaatgggttgcagtcaccgttatggtgccctgatgagaaaagctaactaaatataaattttgcaacatcacaattgaagaacgtactttggaaataatatttaagtaagaatgtggaaaattatttaacttgggttatatgtcaggtgcccccactcaagaaaattagggcactcagcattacacttaaggaaccagcgttgaaaatgcatagcctaccattcaaattaatcattattccagcaaactggtaaatgtcaatgtgagctcatttctagaaaggcttcccagggaaatgaggactgtagattggtgaacttcctttccgtgatgggtgggccaatatacatccaaatgtggcacatcttgtatgtatttcctattaagaaaaaagaagccttaagtaagtgtttctattagagaaaaggaactatgtttttgttaaggaggaaatatgcctgcttgatgatcctggagttcatatatggaaagaatatccaaattagtctgctccaggaaataaatcagaatcctctttagaattaattttccaattcttccaattactccttattaattgtggctgggaatccattcaccaagttgatcaccatcctcagtgggcacttcattttgttgtcatcttatttaaagtgtggtgcccagattacttaggatggagttctatcctaataacttcagcaacttatattgctgagatcaaaagcttaatgaaatatcatgtttcatcaagaagagacagcaaccaaagaggaaggatcactcttcccttgcgtaaaaccatggcacttctactacaaaatgctatatgcaattttgcaaagtgcctcttagcaaagagaagacagaacaggacaatgacctaaagagaaagcaaaagtaagcaaaggaggtaaggggctactgatgtgggcaagttaaaaaaaattggtgagggatgactacagtctgcttaaaaagcagttgcagtgggaatggctaaaaggagatggattgctgagatattttagaggtagaatcatcaggatttggtggctgattggatttggaaggaaagcaggaccaccatacatggttaaacatgtatggttgccattcactgcacagatgagaatgaggtgtcttcaggtaagaattaaaaaaaaaaccttcacagaagtcagaagtgctcagtggattatcaggcgtcatgagggagagggggaattttgcctctggcatttaggctgaataaagcgggaaaaagcagatttgaggaagttacctgagtatagctttcaagggatatttgaaaatatgaacctagcacttgagaaagggacatgaactagaaataaaactcgggagttatcacatgtaggtagcagtccatgccatggaaatagttatgaaaatatgtagcataagaagaggagagagcttgtcaaataatgttagaaaataacagcatgaaagtgaccagcagaggaagaataactaattatggcagatatagtggtattgcaaaagctaaatggggaaggagttttaagaagagtcagcaatgtgaaatgtttcatatgttgtgggtgatcttaacaaaaacagttttggtggaatattgggaacagaagccagattctagtggcttgaggagtaaatgggatgagaggaagtagaggcaacaggtatagaatttctaagggaagggaagggaagggtgggtgtgtatttagggcagaacacagggttgaggaagactgaggattctttggttaaggatgtcacttgaacatatttgttaagtaaaagaaatgaacaaatagaaagggagtgattacagacataagaaatggtattctttatggagtcgagctgcagaagagatggaagggtgatggaattaagtataagtgaaagaattacattcatcttgaaaagaagggacactgaatctctaataggagacaaagagatgaggacagatgcagacataggtttactgagtctgcaagtaatagacaaggaagtagaagaattttctaccagatgatctgcatttttccattaaagtagaataagaggtcacctactgaaagtcaaaggtatgggggtaaccacaggtaaacaggggtgggaacaactgttttgggcaaggggaatggaaacagtttaataaacaggagtaggtaagctaaggccgtgggtcaaatccagcccactacctgtttatgaaaataaagttttattggaacgcagccacacccattcatttacttattgtctacggctgcttttgcactgcaacagcagagttgaatagttgcaacagagcccttatggcccacaaagcctaaattatttactaaataacttgtcccctttacctcccagaaagtttgctgacccctagattgtaatcagataatgattctcagccttaggtacccatcagaattacctgaggaactttaagaaattccattctttgtgttacatttggaccaattatatcaatatccaagggtgggatctacgcatgaatattttcgaaagctccccagctaatgcttatgaaaaccactgatctgagcttaagaaaaatggttgttgaatagcactgaggcactgaggacacgccactgaagtcagaaaccatgagtttatatgcacttaatcatttgttccaaattcctgataccaatgtttttctgttcttgcaagcaaattgcctttacatttttgaaggaatatttcttgagatgatggaaaatgctgatccctggaagagcgttcttattttatctctttttctttattctaccttcttttgcatttctacttctatatccctcaattttgggggggttgaattcaactttatagtttttgccatttattttctcccttttgtccattaaataaagaaacgacacctccacattgttattgttacagagatagcaatttactttccatgattaatctcagaattcttgcactgcaccctcccttccccgccctttttttttcttgttgccatgggggacagacttgatgtaggcacatctgtggcacagagaatcataattagccattatttcataacatatttacttttgtccatgatatatgctgagtctttctgggactgcaagaaagttgttatttgttgtgcagagataattttgttcttacctttggttttctttagcaataataaggagttgtacacaagcttttgagagttcctcaaaacttcacagtatgaatatttaataacataaagctatttgtaataaatgttttaaaactgcttgaaataaataatcattgactatagaaagtcaagtgtcttaaatataaaaaaaattcccgttctatgtctactttaataagaaataacagatattagaaacaggatagcaaaaactcaaagttaaaccaaaagcattactattattttttttattttggaatgttctagaactcattagcagcagttctacccatataattacttacctttcaaaaaattctagttttcctttttcacaatacacagtattgcttgggttgaagttggggcagacaaaacgtatagacaagtagaaatcctttgacaagcctttttcattcatggatttccagggaaaacttgtaggagtgattttactgtcacgttttgtagtcctgggactaccatagcaaactagatgcaagaccagaaagcagtcctctttctgagagtcagcttgatgccatgggaatgagacagcttgtgttactgatcccaacggctcagtcagattgcaatctgaactaaggggacatatttttcttctctactggattattttcacataccttaaatttaccgtttcttctctcattacatagagttgttcttacctatcactcagaacatctcataatacaatctcctttgaaggagtcactatcagaaatagtgacaaatgaaacaataccagccccttagcagttgtgacaccttagcttcacttgttttattctttgacaacttagatttgctttcctttaagaatgttacatgcctaagttaatatttaggttatatttaatgcatttagcttggtttttaaaattttataatttttcaacacatattgcaaatttttggccattgtaaaatcagttaagaattactgttttaaacaaactaaatatgagaaatataaatattaaatggaaaaattcttcatttgaccatgcctctaaacacgttacatttagagagatgcatttgattactgaggtgtgtgatatatgaatacatgcataaatattcttagaatgcttttgctgatgaatagggaaaagcccgagatggcagcccaagatgcagcatttgctacagataattcaattagtaagtgttttgtcattttccttgttctcaaagacactgacattgagtttgtcagtcatatgttaacattcttggtaacttcagaatccctgagatgacccgtccaacaaaactggtctcaagttctgtgaccttttttagctgtaaggatatttttctattcctcagccttatcaatctcatggccatactcttggaccttttcatattccagactattgaccgcttttccattatctattacctccttctttttttaaacagcttgaatgagatatagttcacagatcttaaatttatccatttaaagtgtgtacaattcagttgtttttagtatatttcacaaggctgtccaaccatcaccactgtgtaattctagaatacttttatcacgctaaatgaagaaattataccaattagtagacacaccttatcccgttccccagtctcaggcaagcactaatttactttgtctctctatggatttgcctatttggaacatttcatacaaaaggaatacaatatatggccttttatgactgtctcctttcacttagcataaagtttagaagactcttacatgttgtagcatgaatcagtacttcattccatctgatggctgagtaatattccattgtatgttcctacattggtttattcattgtcagttgatggacatttggattgtttcccccaaatacctgcatagctgcttccttctttgttcacgtctcaactggaatgacattctttagaaaggccatctctgaccaccttaactaaagcagtacattcactatctgtattatccacatttatcttcttcaaggcattatcactatttaaaattattattttgtgtgtttttcatcttccccaactagaatttaacatgttgacagcatatattccatttttcttatacactactatatccccagtgccttgattaatgcatgctgttgttttctcaatacatatttactgactttgttgtcttcaaaagggaaagcaaatatgtacttatagtccgattttagttgcgttgcttaaaattttttatttggaaacaacttcaaacttatagaaagtttgcaagaataacactagtacaaatgactccatatatcctatcctccgattcattttgctccatttgctttatcatttgttctttctttcccacacacacacagttttctgagccatttgagagtatgtaccctggcactttacacctatttcctaagaatagggatattttcttatatactgacagtaatgaactgcagtaaatgtaacattaatacaatactttagctaatctactgtccatattccaattttttaagtaaaaaatatgttcattttttccttccgtagagaatccagtctagggtcagttacagcattggcatgtcttcttagtctcttttaatctagaacatttccagagactttctttgtgttttatgacattagaatttttgaagacaagagtccactttctaattttaaaataagcattcacaattttgggtttgcttgatggtttttcttaattcaattgagattaagcattttagccagagtactgcttaggtgatagtatgtccttcttagggtatcacatctggaggtatgcagtatccatttgcccctcattggacgttaattttgatgataaaatcaaggtgttttctcattttcccctgtataactcttggttttctgggtttgtgtgtgtgtgtgtgtgtgtgtgtgtgtgtgtgtgtgtgtgtgtgtttcaactagtaaataatccactgggagacactttgagaccatgtaaatatcctactcctaagatcccagtttttaatgttatgttttcagcaatcccaaacctctttagaaaagtaaaataattagtccataaattgagaaataaccagtgattcccagatatgtcatataagtttactgatagctaaactgaggtagaaaaaattaacatggccgggcacgtgggctcacgcctgtaatcccagcactatgggaggccaaggtgggtggatcaccaggtcaggagatcgagaccatcctggctaacacggtgaaaccttgtctctactgataaaaaatttaaaaaaataaaaataaataaaaaaaaaattagccgggcttggtggcaggcgcctgtagtcccagctactggggaggctgaggcaggagaatggcatgaacccaggaggcggagcttgcagtgagccaagattgcgccactgcactccagcctgggtgacagagcgagactccatctcaaaaaaaaaaaaaaaaagaaaagaaaagaaaaaagaaaaaattaacatgtatttccaaaaaataaaaaatgtcataaaaaatatgatctggcagcaatttctggattccgcattctagtcactgggcttaaatacaattaatggaaaggttgtttgcattgtttaggtgcaataaaatcgattctgatatatgttttaatttcataccatgagtagggggttggttcatgttaagatgcctcagatgttcagtatgtttacctgtcaaatgcagggttacacttttgctgatttgtttacttcctgtgattttaatgtgtgacaatcgaagacctaattttcaatggtatggctttgcatctttagctcttattctaatacagaaaggatgtcaaactttagatgaactcattgatcaatttacagtgatgaatgtacttctagcaaatatttgtagcatgtaaaatgtttgaattatattagatggtatatcagcaagtacatctaatttaaattctagggttactttttagaggcttaaaaatctaatagaattaaatggagagctttgtttaataatgaaaactctttaggaaagtgatatggactcaattattgaaggaaattgatctaaaataaacacaagcagcatcacatccaatattgaagaaaatgatcattatcaaataaaatcaaaaagcataggcacaaaggtattttaacttcagattaaaacttttgcttattgatatatatcagttaattaacaaattgttgaatttggtttatttaaaattggaaaagtgtttactatcaaaacttaggttcctaattttggtgtgtagtatacatttgataaacttttttgatgaatcatttagttttatgggattaaacatttctgatgaatgttttcagttcacactaatggtttgtatgggtaattatacaaacacatatatttctgaatgctatcactagaaatggaaaatatagaaagttaaatttttacaggaaaaaagcagagaaaataagcaaattttatttattaccaaatggatctgctagctcaaagagctagattttatgttttaaagaggtgtccagctattgagttggtgttattaagatgaaagtctttaaaattattgcagtgaaaaatatacagaagtagcagtattcatcttagattttacttccaaacacaagtaaatcagcttaattttcaaggccaaaaaacatttcctacatcacagattatttcacgtttattattctttgcaattaatgtaagtttcactaaaatatgaagaaaacctagcttggcattatttgtatgtgaaattgcataagtctggttgcttgtacctattttctctttatggactctaagaaaataacaaaaatgggtaaagtattcagggtgatggtctagtgttttaggtgtaagaatgactgagaatggtactttctgggaaatcagggagactattggttgtagctaaatagaatgtgactggctctgtattctgtttttgaggccaagttgacaaaaaaaatccaaattagaggtcatggagcacatatttaacagagtgtttcatgattttaactctgaagctaaattcatatttgtgggaaaaagccagactcttgaagctaaacaataaaataattggcaagaaagactaagaggaattttagcaagtaaagccagatgtaaggggatttacacacacacacacacatacacacatgcacacacacatataagaaagacaaatggaaaaatgtaatgttatattcattgctctgttgctataacggcactagttattttggaattcctaaaataattctaagttttaaatacataacctacactgaacatttggaaattgctctagcaacatatttggtaatgctaagtacctttatgaaagagagcaaatatgactttttagctttattttatgtgattacccagtgattctcatgtcttggtgaagacgttgtttttagtctctatctcctcgtttgtataatgttaatccacaacatgatagaaaaaaaaaaaaaaacagctcaacaaaacatttttccccatcaaccttgtgcattgaaatagtttgcctacaaaatcctatgctcattaattagtaactgatttgttttctctctacttcccccttagtcatagagcagcctagcaaaagtatgtttttaacacatatttattgaaataattaatagagatgtatataataaagcataaagactgatgatattgtttctgtcaggcctattgaatattttaaataagttacagagaccaattatgaacttttgtgggtcctctgaagtgttaacatttcaaaattacataagaaagtgaattactgagacacaagaaaaaaaattggaagctacagcactggtttcagtgactacaccacttaaagggaattgtgacttctgaacagggaagttttgaatgaaagcattttctgatcattataatagctgtaaccaaggttaataacgggcaagcccctgaataatacagttaatatgttttgtccagctgaatgtgtgagtagataacacatctatgctatcattctgattaagttattcatcagataatctgatgctaactacttttgacagttctggaaatagaactactgtgaaaacctcaattgatttcttggatatataacacctccttttaaaagggcctcagatgtgtataggaattctggcatatcatataacaaaagtaattaaaattaggtgtgatgttcatttttacccaagaaaaaatgtcctataaagatttggaagagtcaaatgtaaataacaaccccaaagtattataacttagactgtaataatacgaagagtgaaaaatgtctgatagaaagagatgtgagtcattccataatactttcataattgtcaatgagataccaggaaatgaaagtcatagctttcagaaatgaaattcgaaaaggtaaaaacttcattgtgtatagtaaatactataacaaaaaagcctgtgtgtaacaaatctactgctatatcctggccacaaaatcagcaaggctacaacaacaaaagtcctctttagagtgcttggtggttgatctgattaaagacttcttaaaaatatttaaagtattcccgggctccttcccatgtcataacagtgattcactgtaattaacgtgttaatgaaagagcctctttgcagtgttattttcactgaggaagatagagcctatgggagacctgaagctgagagcttttatattgtatcataacctttgaagcagaaatttcctgaaaactcccttcattgctcttcaagtctcagagagcccagtcacacatctaatctcccagggaagtcgaagcataaaatggtccacaagctttgccaaccaattgattagcatatacctgttgaatatccataagatactaggcaccccaaaccatgatcatgttgatccattcatactgtcaatgtctggaatttatagtatacataaggagattcatcccaaattcagatctgtaattgttaatagttgatctactacaggatcagcataaactgtttcatcctgacttctgcagcttggcaatgctatttttagcccagaactcactgtaagaagattccatatagggaaacaatttgaatgccttgggatgggggtgggtgagagtgcatcattatggaaatttaccagttatatcaaacaatatatattggttgcttggcaccacagactttagcagatcacactaagatcatgcttctatgccatgaggaggtaaaattgaatacactggacaatggttttcaattatatcaagaaatgatgtaggataaaatgctttaaaatttttatatatgtgtgactcagaaaaaaaaaaggctcccacttgcccagcacaagtggattacagtagattcaaccaaccaaagcttttagatgtatcaaagtccacctcacatgtttggccaatgacacagggatatatttccctccatttttctataatttcaagttccaatagtaggcataacaaagagaaacaatgctgacccatagagatataatttcctgaagctataacatgcaatatatattaacacctgatattttgaggaacagaaagtgcttatttctctaaaaaaaagagttatcattttctactattgactttcatgagtgatgaggaaagagcaaagttttgaccctcctatctcctccttctttgagatccccattactcatttaccccttctctgtgattagatgggtggttaacactagaagcaataagtggatacaaaacacatgtattaaagctcttcattacatttatgttcctcatatctttaccagtaagggaagcgacctggccaactcattatgtttctctgtactcctctagtcccaaaaataattatttgcttgaacaaaaaagttctgctttcagtagggctgtcaaaaaatcaaagctcatgtacattacaagggtatttcagtcaaacgattattaaatttcacataagaaaatacactcaacagacactttaactgctatctctgatcaaggcatgaaactgttcaaacaaataattaaacttgaaaatagggtgtcaacagaaccatgatgggtggttttgctgagttattttctttgctgtggaactcggccttaaatgtccacatggagagcaaatagagcagcattttattttatgttctcttttccaataccctacttacttgaggtatgctttctcttcagattttgaggttagacttttcttctctataactcatctttttgcctcctctgctcagcggcagctatcttgaacctcagaagccttggtgagactaggagtttcagcatcaagagaggtgtttggtttggtttggttcatttgtttttcagtatctgtaacacattctagtgatgcctgtcagtttgctggaaccactcatggtccttgctgtcagaggcaaggctctgccacttggggcgtgagtgtaggtgtagacccatggagaaagttgttttgcaacaaactgcctggatagtagtgttgctttgtaattatgtaaaatcaaaacattcaaaagatgctggcagataaatgagagataataatagtaaagaaatgagaattccagaaatgtaaaacaattctgaattagatttatttcagacttagctacctttctttttggcagacagagcaccattcttgggagtttcagggaatcaaaatgaaaatgaaaggcagtttcttccacaaggtttttagtattctctgaaattctgactagcctctgcccctcagggttcaacagtgtgagagctcttggtccagatgcccagtaatctctgtatcacctctgtagtaagaaatacagtataaaaaggagtaaattcagttatttagtagtggaaattacatgatgacagatattttcaaagatgcttatcattgattttctctccatctgtgctaatattcacatgcatacctatgcaaataggctttaaatgatttgatttcatacccaaaagtcagattctcctgttgttcatttagcatttttctattaggatatttgaaaaaagtattttttatggtaaatatagaagcatttgagcagtcttctttttatatggtcagttttccattttgaaggggaaacacttgtccttgtcagaattattgtgaactgccttagtttaaaaattggaaccaaaatgagatttgattgttactggggtaggtttttttttaagttttttactgatatgtaataattgtacatatttagggggtacacgtggtattttaatacatgtattcaatgtgtaattatcaaatcagggtaactgggacatctgtcacttcagacatttctctattctttgtgttgggaatgtttcaaatcttttcttctagctattttgaaagatacaataaatttttgtaaactataatctccctactgtactgtcaaatactagaatgtattccttctatctaactgtatttttgtacccatgaaccaactttgctgcattccccctcccacctacttttcccagactctggtaaccatcattctactctctacctccataagatccaatttttggggccgggcgaggtggctcatgcctgtaatcccagcactttgagaggcccaggtgggcagatcacaaggtcaggagatcgagaccatcctggctaacatggtgaaatcccgtctctactaaaaaaaaaaaaatacaaaaaattagccgggcatggtggcacgcacctgtagtcccagctacttgggaggctgaggcaggagaattacttgaacccgggaggtggaggttacagtgagctgacatcgtgccactcactgcactccagtctgggcaacagagcaagactccgtctcaaaaaaaaaaaaaaaatccaattttttagttcccatatgcgagtgagaacatgcagtatttgtctccctgtgtctggcttatttcacttagcataatgacctccagttccatccaggttgctgcaaatgacatgattttattcttttttgtggctgaataatattgcattgtgtatatgtaccacattttctttattcgttcatttgttgatggacacttaggttgattccatatcacggctattgtgaatagtgctgcagtaaacatgagaatgcagatatctctttgatatgctgatttcctttcttttggatatatacccagtagtgggattgctggatcatatggtagttttatttttagtattttgaggaacctccatactgtcttccataatagctgtactaatttacattcccaacagtgtacaaggattctccttccttcacatccgtacccagcaactgttattttttgtttgttttatattagccattttaacagagttgagatgctatctcattattttgatttgcattttcctgatgattagttatgttgagcatatttttcatgtgtctgttgaagagttgtatgtcttcctttgagaaatgtctattcaagtcctttgcccaatttttaattggatttatttatttatttatttatttttgctattgagttgtgttcattatatatgctgcttattaatcccttgttaggtggacagtatgcaaatattttctcccattctgtaggttgtctcttccctctgttgattgtttccctgctgtgcaggaactttttagcttcatgtattgtctattttttaaattttgttttctgtgcttttaaggttttacccaaaaaatctttgccaagaccaatgtcctgtagcattttctggatgttttcttctatttcacagtttcaggacttacatttagatctttaatacattttgagttgatttttgtatatgttgaatgtggtaggttattgtactagtgaaatgctgacaaaagcatgctgaaggaagatagatcattattttgttttggattcttacattgctttaaccacccgtgcttaattgttttattattatttcctgaaatattattatgcatcattgaatactaagtcagcctttaagaggctttatatatacacattctaggctttttctaagtataactaatcatcaagtataggtgtcatttacacagtttgtttgagtcactcctttaatatgatataattttcttagctgacattgtatagattttatcaaacctaaaattgagtaatacaagaaattctaccaagacatcagtgtcatttgcatagaggcgtaagtatattaagatctctgtatgaaatgtgttgtaagagtatgaaatattatcctactgatttattgaataaataacatgtattaatagttaaatcttgctttttatatgtctcagagccctgaaccttacagatctcaaacttcatatagtatttgcaagtcaagaaaaatgaaaattgggcacattgtgaaaaatcctggaatgtattaccaacaaattgttcatttctggcacattaattatttcacaaattgttcgtcatgttcccatttcacttttataagcacagtaacactctcttttacagaatgttgccaacatttaatttcttaatgaatcaatgactctttcatacattataaataagaatataggttcaccttaccaagtggctaaacagcattctctaatatttgttggagcattagggaaaagctgatggcaaccagtatcagttttgcataaatagtatttttttcccttagaacgtaagattaaccttttttcttaaaagttagcagcaagatgttaaaacgtaatattattcataggaagtttaagtacagccatagtaaagaatttttcttttttattagattttattgaacgtttatttgctgttactgtggtcacgcaacctgttaccgtctcatcacaaacagcatttcatttagtatattgagaaaagtgctgtttcaggaagccacatgcagtgctactagatcagaatacattgagggtcaaaagtttatagggacccttgataaaaaaaataataaatgttctcactctatatagggggatctcatctgagggaatttagtttgtaacatgccaaataaactttgctataaaaatagtttccatttaaattgcttctaggattctaagagtaggattatagagacagctcagtgtaataatattaaaatacatacttttaagtatggcaattcatacttttaaagccctattgcctgcattatcttacatcatactgtgtgcacttgtcaagtgatcgagaaaagctgctgtatttgggttgctattttgaactgttgaattaaatataaagtccaagtaaatatatttgtaacagtaagtaaatcgtgataatgtgcaattcatcattttgtccatttttttttcatttatgacagtttttttatggtgtagggtcacactgaaagggttatttcattctagaagttgtagatgaagtacctttatttgttaggggtgctggccaagaaaccattaattggctttcttgcaagatacaataacttttctttagttgtttgatgagtctcaatctcgtgtagaattctcaaatcactgcccctggtatgatcttgtggcagatttgtatagattccggaagtcttagaaagtttctcttgctgttacgacattgctggtggtccccaaggcaattatgctcctttagtggtcatcccacttaattaaagggagaagtgttgctctagatagttttattatatctccttgtggttgctaaacgaagcataccagctcaacagtacttcctgcttttaattgaagtttcgttttctaagaatatttagtagttcattttcctttcaggtgtaacattctaaattcaaatgagttaggatcttcttttggtttgtttttgctttattgtttgttgttctctgcaattattccctttcttgaattgtttatggaaggactcactgccttcatatttttatttagcaaaaaatctcttgagtagaagaagttggattgcatgcccatgagaccacataccctgtttgggcttcattaagtccgttgtaaatacagatattagagataagtaatattggctaatatcaggctattttcttgtgatgttacaacctcataaaaagcctgcagaggcatcactgtgcctcattttgtgttcttgacgcacaatgtgtgtaatattttctcatatctcctttatttccaaatgtttgttgcatgtaaatctgatatttcccaaaccatattttaacctatttgaatataagaatggtgccttccccatcttttatatttcccaccataccaaattcattactaaataccaagtaaatattttaccaatatttagtaaataaatgatagaagataattttactatgtacgaagccaaagacagaaaaaaaatgagtgatttttctctttcacataataagagatgactggatcaaaatgatacactttagtaaggaagaatttggaggttcaaattatgtgtgtttcacaatatgggcacaccgaattagaaatacaggagtgcagtttctaacccctgttcaaatgaatgtatgaacttgagcagctcccttcctttgtcaggttatcaattaccttaaatatcaaatgatagtgtataatatatttctttgacctcttaagtctattttgcaagtaataaatcccttaactttgcatgcattattaaatttttaataaaatctacagcaatgaggttatgtagaatatagatctaatgagtgctctttagtactgagtagccaggggatcatatttgaaatagatgggatatacctagggaaatgaacagttatttcctgctcgtgattacaacagtggacataggtttctaatgagtctttcatgacagcattcttttattttcctctgcctttcattatttggtttatttatataaaagtaacagaattccactggggcataactggacttgaccaataaaggatgactctttgtgccttctatttgcctccacttaattgtcctgctcgtcatcccgctgaattatggaaaatgtcacatttccttggcctatgactcatataacaaatgaatgtgtgaatagtgtcaaaatacagcaatttgctctatgtaaagggaggtagacagcttttgaaaatggtaaggtatataactagatatttctaaactgaagaaaattctcatttgggcttagacgtgtgcatctatggtgcaattagttgttaaatcatttaattgagggctcacttgcctagtctgtatacttgcctcactgatagtgactcaggaagcaaatcaagtggacttaaaactaaaatatcaataccctatacaacaagagaagagacatgatttctttattaacattggagctgtgtgtgtgtgtgtgtgtgtgtgagagagagagagagagtgtgtttgtgtgtgtgtgttagtttgtttagcttccatccaagcactgatggtcctgcaaattaagtggattcagaatcttcatagttcctgaccgataatccccatcttcaaacatttttttgcaggaggaacttggaatcattgatcttactgtgtttctctaaaatataataatttgtgcataaataggaattttatgacatactctatgtcctctaatagttttgtgtaatttcattgccatttagtgatcaacaaaaggagtttgtaaactataaactagctttttcctggctcgcttatgagggaataggacagaactccttgggtttaattttcagaaatcctaaatatcaacattttttatacttgatagagttaaatataaaggaataaataagcaaaactaaggccaaccttgtgcattagcccttccactcacttcagatcaccagagcttggatgtttcatctgctaacaattcctctgaagcattctcaagcatgttttcttgccagcaaaagtaatataagtcctaggcaataatagcttgataaattcatagaagatagaagattcctatgaatataagcttgctgacattttacagtaatacaaataaaacctgttaacatagtaaataacaggtactttcgggggggtaaaattattttaatttgacctatgattacatgtcttgtctattctgctatgcccagagatcctttctgatgaagatcaacttttctaatactattttactgagtttggaatggaactatagattggataattaccatccgagggagtaaagcctctaactaccacaattactcacatttattcacatgacatgaaaataaaaataacaaatggtttggaagactgcactgtagggggcaaattaaacaaaggtgcgcacacgcacgcacacacacacacacacccctctgatattaacagaggaaaggaacttattcaatgatgtagctttccactattggcactttttgttttctgttttagagacatagctcacctgaatggcacaacttgtgtgggtactgtaaatatttcctagacatggcaatgcattatattttccatttcaaaatatacttatagacagctatgggaaagaattacagtggtagctacacacagccttgttttccttgtatacagagttagaaaatagagatataggggaatccactcctgataccaaatatagccaccataagcatgtacaggcataccttgtcttattatgctttgcagatattgcagtttttacaaatcaaagtttgtggcaaccctgcatcaagaaaatctatcagcgccattttttccaacagcatgtgctcactttatgtctccaggtaacatttggtaattcttgaagtatttcacattttttcattattgttgtatctgttatgggtgatcttgtgtaatcagtgatctttgatgttactcttataattgttttggggcaccacagatcatggccatataagatggcaaacttaattgataaatattgtgtgtgtgctgactgctctactgacaggccattcccccatctctctgtttctacttaggcctccccattccctgaaacacaatattgaaattaggccaactagtgactatacagtggcctctaagtgttcaagtgaaagtaagagttgcacttctcttactttaaatcaaaaactagaaatggttacacttagcaggaagggcatgtcaaaagctgaaataagccaaaaactaggcctcttgcaccagctaaccaagttgtaaatgcaaaggaaaagttattgaaggaaagtaaaagtgctacaccagtgaacacataaatgataagaaagaaatagccttacggctgatatggagaaaggtttaattgtctggatagaagatagaaccagccataccattcccttaagccaaaggctaatctagggcaaggctctaactctcttcaattctgtgaaggctgagagagatgaggaagctgcagaagaaaagttgcaagctagaggtggcttcatgatgcttaaggaaagccatctctgtaacataaaagtgcaaggtgaagcagcaagtgctgataacagaagctacagcaagttatccagaagatttagctaagatcattgatgaaggtggctacacaaaacaacagattttctttttttctgattttttttttttttttttttggtctcactctgttgcccaggctggagtgcagtggcataatattggctcgctgcaacctctgcctcccgggttcaagagattctcctgcctcagcctctgaagtagctgggattacaggtgcctgccaccacgccaggctaatttttttgtatttttagtagagacagggtttcaccatgttggccaggctggtctcaaactcctgactttaagtgatctgcctgcttcagcctcccaaactgctgggattacaggggtgagccaccacgctcggccatacagattttcaatgtagatgaagtagccttctattggaaggagatgccacccaggggtttcgtggctagagacaagtcaatatctggcttcaaagcttcaaaggagaggctgactctcatgttaggagctagtgtagctgcagccaatgctcatttaccattccaaaaatcctagggcacttaagaattatgactctacttctaatctataaatggaaaaacaaagcctggatgacagcaaatctgttttcagcatagtttattgcatattttaagcctacttttgagacttactgctggggggaaaaaaagattcttttcaaaatattactgcttgatgacaatgcacctagtcacctaagagttctaatggagatgtacaaagagattaaagttgttttcatggccactagcacaacatccattttgcagcccatggatcaaggagtaattttgattttcaagtcttcctatttaagaaatacttttcataaggccatagctgccatagatagtgattcttctgatggatccaggcaaagcaaattgaaaacctgaaaaggattcatcattctagatgttattaaggcattcatgattcataggtggaggtcaaaatattaacaggactttgaaagaagttgattccaatcctcctgatgactttgatgggtttagggcttcattagaaaaagtaactgcagatgtcatggaagcagctagagaactagaattaaaagtagggcctgaaaatgtgacagaattgctgcaatctcatgataaaactcatgacaaaatggatgaagagttgtttcttgtggatgagcaaagaatttcttaggatggatctattcttgaatggtgacgatgctatgaaaatttttgaaattacaacaaatgatgtagaatattccaaaaacttagttgataaatcatatacagggtttgagaggatataatccgattttgaaataagtttttccgtgggtaaagtcatatcatacagtatcacctgctacagagaaatctttcatgaaaggaagagtccattgatgcagcaaacttcattattgtcacagaaattgccagaatcatcctgaccttaaatagccaccatcctgatcaatcagcagcaattaacatccaggcaaaaccctcaagtaggactaaagatatgacttgccaaaggctcagatgatcattggcatattttaacaatgaaatatttttaaactaaggtatatgcactgaatgtttagacataatgctgttgcacactttatagaccataatatagtgtaagcctactttttaaatgcactgggaaagcaaaattcatgtgacacactttattgcaatattcactttattgagatactcactttattgcagtagtctggaactgaacctgtaatatctccaaggtatgcctgtatattctatcactcccaagctgtgtgctcttgggaaagttacctaatagaatccttaataaaaaatggagtatggggctgggtgtggtggctcgtgcctgtagccccagcagtttgggtggctgaggtggaaggatcacttgatcccatgagttcaagaccagcctcggcaacatagcgagaccctgtctctacaaaaagaaaaaaaaaattagcggggtgtggtggcatgtgcttgtagtcccaactactcaggaaactgaggtgggaggattgcttgagcccaggagattgaggctgcattgatctgtgatcatgtcacagcactgtagcctgggtgattgatagagtgagaccctgcctctaaaaataaaatggagcattatctattcatggggttatgtgagattatttgtgtgaattgttagtcatatatatttgccaaataaatgtttgcatcccatcaccgtggctgaatgagcatcggactaaggctaccttcttctatgcgccaaaagttttggatacatttcttgaggctcatgtagttgtagaatctaaaatctaattttagcttagaagtgcaacttgaggaaaagcaatcaggatttttgaacttttaatgaaacattttataaagaaaaacatctcttgtgagtgctttgttccctgtttaatttggttgagggtactttgttcagtagaggccaaaagcctataagttaaataagctgagactatcagtggaaaaagaaacactacattcattcaagttcatgttatataagtttgccatcatttcaaagcaaagattttacatggctcacctgtgtaacaataaaaaaatctacggttcagttgtaaatgtgcacaaatagggcatgatgataggctcacagttgtagcttcctctaacttggtcatggactcaagatcaatgtgaatgccatatatcagaaaggagcaaagagtgctttaaaactacaataagaaagattggcatgcgtgaatctaacggtttagttatccattttgagggataatttatttggaatgctactttatttctttattttattttattattattatactttaagttttagggaacatgtgcacaatgtgcaggttagttacatatgtatacatgtgccatgctggtatggtgcacccattaacttgtcatttagcattaggtatatctcccagtgctatccctccccactctccccaccccacaacagtccccagagtgtgatggggactccccacaccacaacagtccccagagtgtgatgttccccttcctgtgtccatgtgttctcattgttcaattcccacctatgagtgagaacatgcggtgtttggttttttgtccttgcgatagtttactgagaatgatgatttctaatttcatccatgtccctacaaaggacatgaactcatcatttcttatggctgcatagtattccatggtgtatatgtgccacattttcttaatccagtctatcattgttggacatttgggttggttccaagtctttgctattgtgaatagtgccgcaataaacgtacgtgtgcatgtgtctttatagcagcatgatttatagtcctttgggtatatacccagtaatgggatggctggatcaaatggtatttctagttctagatccctgaggaatcaccacactgacttccacaatggttgaactagtttacagtcccaccaatagtgtaaaagtgttcctatttctccacatcgtctccagcacctgttgtttcctgactttttaatgattgccattctaactggtgtgggatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgttttttttcttgtacatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatacctaggttttcttctagggttttcatggttttaggtctaacgtttatttcttaagctaccatcccacaattcatcactattcctgatggtctgttttacagaaattttctgtcagcacataactataatagatagtacataatatagtgaaatatgaaaatctctgtgaaaggatcaacgaaatttgaagagagagctagtttgaaatacgaatcatattctcaaccttttaaatttctgattgaatgatttatgggaaacattctgtagcaatgtgaattccttataaggaaatagtgactgtgtccataaggatgatgtactctataattcagataatataaccatttatgctttgtagcaggagttccccaacctctgtaccaattcatggcctgtcaggaacctggctgcacagcaggacctgagcgatgggggagcaaacattaccacctgagctccgcctcctgtcagatcagcagcagcattagattctcatagaagcctgaaccttattgtgagctgcacatgtggaggatctaggttgtgtattccttatgagaatcgaatgcctgatgatatgaggtgggatagtttcatcacgaaaccctcaccgcttccaccacccccatccgtggaaaaattttctcccatgaaatcagtccctggtgccaaatagcttggggaccactgttttatagggtccgtatttcatagattgaaagactgaggacacagttaaggcattatgaagtcaatgagacatagtggtgaagaaaagataaattcttaaagataaatctttactggacatttaagtgggttttccaagtccattaatcccattcatgttttaacatgtctttgaaccctgaatggcccctaaacttagcctgtaccttagttccaactcacccagttttcttagtgtgcctacaaggctaacagaccttgtaggcttggtggggccaggcatgaggtagctgtggattcactgtgctattacaagtctaaaatatggaagtgtttttcagctttttttccttatgtctttttctgctgactctaatctttagttgcttttccccctttggttttactgcagattgaaaatgtttccattcattcaaaacaactatttcttgtttaaagtaaaactgttagttaataataatgatgctttagcaactatcatttttctcgatgatttagcagaacactgaattactgcgaaatgcaaacagtgagagggtataacagcaacaaaaatatatcttggaagactcaggtctcatctcttaggtctccttccctaccaaagatgaacattccccaaaaagattcaaaatggctgtcaccacatggtggaatcatatgtgattcttacgtttatgcccgtatgcaagtttctaaattagttttattacctttgttaaagaaaaaaaaagcagaagaatggaccctttagacagtgtctaacttatctcaattttccactcccctttgtgtaggcattgatttaatttgtggcatcgtttttaagatgcatattagattatcagaattgcatcaatgtgaaaaaaggagtaaaattaagaataataaatcaaaatagaataaatatgaaaataatagtaaatagaatttgtaatattttatagatgttattcatacttattttataacatttatataataaatacaaaaattagcaaaagaatttttctttcacagaattattattgcatgtaatatacaatgtagagttaaaaatgtggcagatgaatattatgatttctcaagattttcataataaaattatgaatgtttcaaatgtcaaagatctagattccatttatcctttgccttgcagttgagtaaatcctatttcttcggctaggttaccaggactttaaagaaaaatatttttctaacaaatatttctgtttggagctttttacaacaaatgagctctgcgtttgcatcgtacaaagtctagcttgcttcattgggaagaaaatggcatgagaaacagtatccatagatttaacaagctcatgacaacataagttatcaagtagcaaactgatagaaacgtaaactgattacttgggaaagcggcaagagtttggggtgctcatcagagccataaccatgagaactgccaaatgtttgtccttaactattagtttaccttatactgtacacgactctttagttctcccttgattgcacctcctgtaaaggggagataaaactctttgggagcctttcctgtgtttgattatcattctctccaacaccactatcaattgcccttgacaattttgtcacaccctccagcattactcttgctataaatcttgataattttagtatccatatagatgattcttaagtgctctgccatctcagttccttgaacttttgtcctccaatgatcttgtccaccctatctcagccatccactctaatggaaaaccttagactgtcatcatcagtaacctctgccctctgccccatctccatttcaagcatcccactgtttgactgttaccttctacatttacagattattccttcttgttctcagacttcaaatttcttgaccccacagagagatagtatatttaccctaacaccttttctcagttcctcaacctccactccctctttcagcttgcttccatgtcttcacttctctctttcctcatcttaggtgatgcagacctcataataatcacactttcagatattgattcaattttctgtttctcccaccgtaattaatcaactggcaatactccagcccttgttcaatccacatctgtgctaattcagcatctatactagttctgctggaggaaaatacaaccatgctgattggttttgcttaaacttaatgaccatcagtgcagaccaataagtcttctactcaaatgagttactgactttactttgttctctcatctataatatggggataataatagaaaactatagtcatagagttgagggatttaagtgtattcccatatacaaagaacctgacaatagtgcctggtacctagtaagggctcaatttattctacttctccccctcctctctccctccttctccctctcctcttccaccttctcctttttagtagtactacattagaattcccctagttaaattacctttataccaacctaattaattattttgaactttatttctcctgaaatcctgaatgcctccctctccccctcctaaggctaaggcttttaattcgcagagaaaacagaaagtcagaacaaaatggcctcatacctccaccaccatatctactcacccacttctagctgtgacccatattctgtctttttctttgttactatggatccttttccttgttcttatataaggccagctcttacagtcatgcagtatattcaactccatatttcatactcaaatttctcagtctagaaattgttcttttctttctttctctctctctcatgtcttcgtatccctctccaccatatcaaccccatcagcatacaatcattactgttatttatcccatttgatttaggcaaataaaaagaaaaaggggtccttaaaaggttttttgcagttccaagtaatttcttgtctagcataaaatccctggctcttaaacccaaactgacagtctttaatatgcaaatccaagccaagaaaaactgggtccacccaacatggcaattcccaccgttgtccccttgcccttgcccccacatgtgcttggcagcatggctactcccacatatccccatgtgtgtaaaacatcatggctccctgcatttccatattaaaagactagggtggaagagtcagtttttccgcgggctacgtaaataacatgcctggtcaaaccaatcccctgagccctatgcaaatcaaacaccacctcctccagccatcgcatgtaactggctggtatcccctaaacacaaggtctcctctttcagcttcatttaaatgagaaaaaatattcctttattgcatatcccttaccagctaccattccatttaccagtttccctttacagcaaaatccctgaaagtattgtatatcattgtgtccacttcatctcttcccattctgtctatttaaacctattccaatcaggtttttacccctccccgcattattctacccaattactcttcctaaagtcaccagttacctccaccttcccaaatatggtgtcttgtcctcaatatctgcttccttgacctaaacagtggtggttgatgcagttcatcattccttcctcctgaaaacattttcttcacttggcttcaggacaccacactcgcttagcttttcttctacctcactgactgatccttctaagtctcctttattggttctttttcatcttcctaacctgtaaactttggtgggctccaggactcatccttgaacttggtcttttctctgtgcacactcaccctctttgtgtattactctcatgacttcaaacactgtctacatactggtgattccccaaattctccagcctggcattcttatttaaagttcaggcatatttccaactgcttccttgacttctccatgtagatgcctgattatcgtatttcggttaacaagtcccaaatagaaatattcatgtcacttccctaaatattatatgttcacagtcttctccatctcaataagcggcaaccccatccttccatttgcttaggtcaacatccttggagttttccttgccttctctctgtctctgacatgacacatcaatgcaccacaaatctttggctttctttcagaatatatgcactccagaactaaaccaactctcatcacttccacttctaccttctacatctaccctctcacacctgagttattgttatagtctcctcattagcatccctgcttccatccttatgcctccccactttgtgctccacagttatcctgttcatagtaagtcagataatgtgacaactcctctgttcagatttctccaatggattcttcaacgtccaaaatccttagtatggaatttaatgccctctgtgacatggcctaggggactatctttctgacctcatctccctaacccttactagctccttacttaccactcactgtgctccagtcatatcagttttcctgccgtttcttcacatcatgacaaacccacccctgctttagagcctttgcactggctgtttcttctgcttggactgctctttcccagattccccattgctcactccctcactaccttcaggtctctattcatatatgactttttcacagaggcttccctgactacttaatttaaaatagcattttgtcaccataatttcctatctcccattatctattatttatatatccattttatgcatccataatttatacagcacatttaaataaatcaagtcatgttaaatatgttaaatgtacatttattgaataaaatgcctatttgtatattgtttgtgtatgcacagtagagtataaattttttggcggtcaggatttttgttttgctcactgttttttgttgaatgaatcaatacgtacttgcttatttgtttattgtcttcctctactagaatgtcagctccttgagggcagggtctttattttgcttagtgatctttcccgagtacctggaacagagtctggaatatactaggtactcaataaatgttgcctacaatatttaattaattgattagttagttcagacattgaaagagcttccaagagtaatgtttaaactcaatcaatgtaatggataaatatccaagtactgtatgaggaaaagatattgataaacgttgcctgtatttataagattcataattttactcaactctttgatgaggaaatgttgacttgtccaaaagcaggtaaatataaatagaaaaaccggaggtttttcttgataagagtatccctctatatgaagcagagacgtaattcagcctaatttatattgaactcctatagtccaactattgattccttatcacttgctgacatttgttgctagggagcattgtgagtatttgaaatatacatttatttccactaagagttatgtaatcaattttaatatattttaaatatactttatgatgatgtagattaataatggaaatgatgatggcggtggtggtggtggcgatggtgatggtcatgtgtgtttgtcatagctaaagaacagcattgaaacttttccagtgcacacaacacacacaaaatccacttataactaaaaattaattatgaagtaggtcagtcttataaaggatttttaaggaaacataattacatgaattttctagattaactcaaactatgctaactcttgtcctcagatgacttgaattaatgaaatgatatataattagtgtttcagttgtttacatgtaaatataagttgagtattccagaaaagtttgttcgtaggcactttttcatctctagtttttattttatactgaaacaaaaagaaataaaacatcaccccaaactcactacacagatatttcagtgtctatcacctgtatgcctccctgtgtatatatacacatatatctacttgattgtatgtaaatgagataactttatatgacctgttctgtaacttgcttttttacgcacatcttgtgcatgtatttctatgtcaataaatgtacatccacattattgttttaaaagatgaataacattctgttgtatgtatgtaccataatctgctcatccagtcctctgctgatgcatttttttctttgttgctgttacaaaataatgttatggtaaacattcttatgcatgcatcatctttataatttgacttgcaagtatttttaaagtttctttctcagtgtcattattttgttctatacgtataaagggatctctaaacaaaatcaagtttcttccctattctgtttttaaattattgtaaatttcaaagtagcgaaattggaataaatgagattttactgtgtactttgcctggagccctctcttgaagtgtattcaaagggaattaaagggcttattaacggataggactatttgtgttaaagatgaagtctgttgaacattttcacctaaatataccaatctgatattcttgacgtttttttgttaaatttgatgctgacaataaaaactttggaataagctataatttctgcatccatgcatattcaggtctgaaaatgaaagaagagtgtgacaggtttgcatgtagaacttcccacccactcatttctttcctttctgcttctgacacttcagcctttgaaacagtttcccatgagcaatactgagattcagactatttagatctaaaggaaaaaatgcaagctcttctacagcttgtatctagcacctggaaacgtcttagaagaagtgctaaaatgtaaataatgctgttatttgttatgcacataggagaaatcctaaaggtattttagggaagagatggaatccagagatattaagaacaaggtgtgggggccaggggagaaggggagaggcagaaggatcctatccacattattaaagtgaaatatttccagtatactcttatcaactgacatgtagactgcatgccgctttcatgcaaaggtatcacatttcaaacttagcatttaaaagaagccagacaagaaaggaaaagagacagttatttgttgaaaaaagtctgggtttagcatcaggcacaggggttattggtagttgtctgaagtacactggagccttgtaacattgttttgtgccatgtattgccagcctgataccactggagtacatcctctgtctagttttccagaactcactacaataactgtaggatttttccatcctttatgaaattgcatcagtattgtgaagggccttaaaagccattcagttcaacaaccatctcccaaaagaaaagttcctcttctttttccatttattttatctcttcccaaagccatggggacctagatacatcaattatcctttgtcctgtaccttcactacctcctggactactaccttttttccactggcatacagatcatttcaagacttctcatcctaaaaagtccctcctaagtttctctttcagactgtctctttcctttgataggcaagagctttcttcattttctcgcctatttttaaattattcagcttcacctttgcttttattttctcatctaattcttaattattcagccctccgcattctatcttctgcccacattgccatccatgaactcctcctgctaatgtcgctagtgactgccaactaaaatccatttctcccttcagtccttaccttatttctcctttctacagcacttgaccaggttggtcaactttttcattgaaaccatctcttctgtgggctttcacaacactgctttttctctgttctacaccatcactatttttcttttaatttttacacttccctcgtcttttctgaaatgtttgatgtcctccccacccccagtttccagcctcagtagttgtcttgtattctgcttgtgttctctagattattaaatgtattcttgtggtttcagttaccatccatatgcagacacctttcatcttgagagccaggcttatatatacaaatggctgctgcacattaacctatcactaatggctctttaaactcaaaataaccaacaatggagtcattgtctctatctctgaaatagaacacactaccctcccccacttcttcccctttttaccctgtggcaacaaccttttgctatcctgattttaagcaggctgcagcatcataataaatgatacataatatctgcctttaaaatgcctgtagtggttaagagggagggctctgacattacatggatttgaaacacaattcaaatgcttataaggtttatgatttggggcaaaggaattattaatccatctgtcctttagtttcctcatctataaaatggaggtaatagtagtatagacctcatagggttcttaagaggattaaatggaatgataatacatgcacagcattttacagtgttaagttcattaagttaacaaatgcttcatattatttgccgttacagtccatataataacatgctgccttcaggccaatatatataagcctataattcttggaagactatggaaatcctatcatatattaaattgtcattttttttaagactaagaaaaatttatgtaaagtccaaaagtacagctgtttacaggggacgaactgatccacaaggccacagtctaccctcatcagttagtgtccatcactgaagtggaataactcaaaaggaaaaggtaactcaacgagccatccatttcccacatagattcacaacagaagacagaaaatatggagtggaatgttgaatcagctgctgttgggagaccctggtctgcactctatctgtattcttactgaagggagtgcagggcagggtttcccatacagagggcacagactaccaccgtatggcaaatgttgactggaactcaacttcaaagccatttcacctggaatcttaccccaccaccccaatgcttcatgaaaattcaactgatcctcttctatgaagaaactcaatcctgataagtctctttagtagttattgaaatgtctttgtaactctcttatagtcaggttcagtaagaatgttaagtttctaattgagcttttctttctgaacagttattttgtgtatgtttattttctgtttaccaatgtaatatatgttctttgcagaaaaattggaaaatacaaaaaggtatctacaaagtcccccaaccaagagaaaaccaatattaatgttctgttatagatccttgtagtggctagctggaattcgtgtatatctctctctctctgtctttgtctttctttctctctctctctctatatatatacatatattccaaatatacatttttatgtaatatatatgtatattatatatgtatacatatattccaaatatacatatatatcttcatgtaatatatacgtattttatatatatgtataaatacataatatacatatataacctaatatatgatatagcataatatatgtatacacatatatgtgtacatatataaaatacatatatattacataaagatatatatgtacatttggaataactatgcataccatgtttcaaacctgctgtttactcgttattatgactattcctctatatattaaaatattattcttaatctacattttagtggttgaatagtaataatctatttagtttgttctctgtttatttgtttttgtttttgggaacaaggaactgttcacacctaaatgtgtacaacctttatgtctagatcaggcacttgaattcttaaaaaagtgttaggaaatggaataatgatcttttatttataagttgtatatgtttctgtattctgttcatatatgataattgaaatagacctatatctaacactttaaaatttatagtattttcatctttatttcctcatttgatccctgctacaccttgtgagatagagaagggcttattattctgtccttatagataaggaaacttatgtccagaaagatgaagtggttttccaaaagacacgtagctaataaataattgacaacattggaatttggaattagaaagcaagtcttgtgactcctaaccaatactctttccagtacactttgccatgtcccaacttcactttctttaagtgcttctttctagcacctcttattcaattattgtcatacgtactttttggatcataccttaggagaatgtagctttctcatgaatttcctcattagctgacaactgaatatggctagattttaacaataaaaacacatttttttcttttcaggaatgcaaatacacagtgtattatatgtagaaaaaactctcagatattggatccttattgatgaggcttatgagataatatagcaactcagacttttctcaggaagaagaaaatccatgtcttttgttggacagtttagagagtctagactaccatcattcagcatttgaacattttgatttcaaaatgtagacaattgaagaaatacaatgtaaatgccagggaattaaatcataggacaaaaactccctatgaaaacatcttagtgatagcatacatgttaaaatttttgaaaacactgggaatggtttcacttctcatctgagtatctgagaaacagatgattatgtacctcccagccctgtgtcagccctaatttagttgatggcattattgctccctgctttcttttttttctctttatagcagattgctattcttttttactttaaaatagcaccttttgctgccctgtcttatccttgtgctcttttaaaaagtggtcaggcacacacttttgtcactagttttacatgagggtaggggctttctcttttcttttcaaaaattaagtgccactacatctcagttaaactgccttcatctgacaagcacttacagaatactgaaatataatctactgcaaaaaatctacatgtttttcataaatacgaatgaaatgcttttaatattatccctgtgttcagagttaatgcttaggcattaactaaagtacgctagacgcttttgatatatttccaaaggcccagccagaaagatatattgcagatacacatattctaagtgtttacaaaatcttccaaaattattttgcctgtgtctgcttaaaaggcacaggaaacagctcccctactatctcctctatccagtcaggaacacttgcagtaaggacactggttgttcagtgcacaaggattaaagtaacttaattacacagtcaaatcaataataaattgagatcattagagccttggctcgagctgaaccccaggtagccgtggaatccctatgatacttgaagaagaattgacacagattctaaggcctcacaggttcaaggagaagcagacagcctcactttgttccttcaaattagttttgagtggaggaatcttaggtttaagtgagacctggatcttgttttggggtgatctctggaaactgggatataatctactctccagggtagaagactatgaagggactaaaggagcaaactctaggtcactgagaacccctttcctacaaacaaagatcttggttgtgttccctcacttccagagagctcattggaccgagcatacccttgagtattaaggtcagtgcatactgagtttaaaaacaacataggtataaaattgaatggagcagtggtgaggaaggtggaaaaggatgagaagggaacttcctttggacttctttgagccaaaataagtagtatgtttcctaaattcttgtaatcagaccattgttggctattggtagagggaggttcagattttccatctctatcttttttcttctgtttcttggtccttctgccactgcttcttttaaaaagaaataaactcatttttttctcagccttatgtgggaaaccctcttggcattttctaactgccaagtgttctataactagccatctgtggaatatttttttgttaagttaattttttaaattaattcatttcccttttctctctctctctctctctctcacacatgcaaactagtgtttgaagatcaatgagcaaatgatctttcttgtaacaacttccctttttcagctgatcgcttttctgaattttatctcctaaaatcacttaaataatttcactgaaacaaaggaatgattggtcttttaaagactcgtacatgtattgaatataacatttccgacctgactaataatttgaagtaactttgagcttttcgagggccctagccaaaacaaaatgttagatggcctttaacatttatgtcttcaagggactgtgctagccaaagtttcctcccaatctggaggcagctttgtgccatagcaattttcaggcttcattgcatcaatcaaacaaattgttcttgtagtgcttacttactggggaattcaccagctggaagattgtaccattgagccaaaacaggccactggaacagccatactctttacttcatttatggagccatttaagaagatgctgtagtggcagctgcctgtttgtcagaacagccttggaggtgtgctgaatgaaacctaatttagactagtagatgatcagatgacaaagaataccagagatacaggtgaatcacaaaagaagatgctgtgagactttctgtaaggaattccccaccatgactttagaaaaactaaagtttcagctgcagttatgttgagtgaagtgtaaagccttgaaaacatagactaaaatggtccccctcctctctctcttatcatataaacacaccccaaccctataatttttctgatacaaattgtatttggattttgcatagatggccagtttacttttaaataagaattatatgcctgtttatttgaatgtctgttcctaagattatccacaaccacaactccatttattatatgtttacataatgttgggtgagggagagtagtcaatgatgattcatttgggactagatacagaattaaaatataaaacaaatattatcattctcaaggttttaatagatggctgaacacaaggtatgagtttagaaattgtcatcctggattatggtgtggattttatgtgcaccttttcatgatgggcatcagctgctttgtatattttgttcccaaatcttgttagtcaactttcaactatctgtgtatataaataatcaaggtgatgttaactgctttatggattttcttgagcaatttaacacaagattgattagtgatttctgtctgtagaaaatgtttgattccaggctggcttagcctcaccacacttctgactgcctcctccctatctgaggaggctcagaaaatacacaatcatttcaatattcacctaagcaaaataaaataggaagataaatttctgccctgaatactgtgatgcgtaatattaatacaaaactccaagagaaatacatttgaggtaattttttttttaacttggataacttaactgtgagtagaggcctgtgattccacaacttcactaatgtggaattttttctttctttccattagtccagactctagactttgagggtggagggggaactagtcttgttcaagctggagttccttattaatgagagatagtttagaaatcctgaataaggctttggaccagacaataaaaaaggaaatgtgaaagctcagagccttctagaacaaagaaacaccccaaatcttatgcctgtcagctggatggtgacagtacccagtagctctgcagtaggcaccagagcatctgaagtacaactggtggacctcgagagaatgggagctagctgaaaaccattctctccttcttaatgattatccattagcacaccatgtttttattgcagaatagattagaaacaattagcaaatggaaaattgaagaggcccttgctgcttttagtgtttagatgtaacttttgaacagaatcaaaatgctctttttggagtcagatttgccattttacctgaattccattttatgcgtctgccatgggttacatgcttcattccatttaaaaacggaaattttctggatgtagattcagtatgtcttgctgattgctgcatttatttcagatgctctttagaaagcattgtttagtaagctaactttttcatgctgagcattaaagtgatggttgaagcatattccaaagtcatcttttaactcacaagaatatggaaccatattgacttctaccaagacagtttaatcattcattgttaacaaagaacattatcatttttattgtacttgtcattacctattactgtactcttgtctgaaaaggcactatggtataagaaaaaataatgaaattaaacgaacaatggatctgattttgtcaatgctcaggaagtgaatcactcaatgccagtcctatagaattcagggaaacatcattagggcttcaggaatttcgactttactaatgtggattttgttatatttctcacatagacttggatgaagctttatgtgaatgcaaattttctcatttcttatattgatgcattgtttatttgcatttttattgtaactcctccaaagagaagaaaatcttggttaatatgcagattagaatttttattgaggattgtgttttattgttcttaaagactaaggtggtaaagaaggttagaaccccctgatgaaatctgcatcacattcaaagaaatagtacttagtgagattttgtcatgaacactttcacagcttgattctatttctcattatatcccaattatcaaacgaaataaaacaaagccattcctatagaatgaaacacatgaaaatggcaaactgcctgtaaaaatgaacaaggaaatactgatcttcaactattcctatacccttatttctaacctaatgtaccaactctccttctctcattttcttttaccaaagtactctgaggcagagaaattaaatttctatctaatactattggtgaaaacagaagactatatgagaaacagagaaaatctccaaacaatcatggtgtctcctggacttcctaatatggaagtcatctaatatgattaagtaatgcagcactagtaacatcaccagagttcacagtgaaatgttttcattcatccccactggaactccaaagcaccaagtggacttagcatcagaacttaagaaactgaagccttcgttagccgtaagtctttgcaaagaaatggaatcacagttttgatttatgtaagaggcacaaagcaaaccattactctgtatccacaaatgtcaattgtagaggagcaccaggtatctgagaggaagatctttgagggatatgctgcttcttatacccttttccaagctcttatttgtttagagtacaacaaaaggaaaggctgagtaagagaactgtgatagggtttgggagaaggaaggaaaattccatggacatatactagccaagtaacttacgtagtttgggtcacttgttatctgttaactacccctaactcctctagtgaatgaggagtagtggtagtagatttctgaaaagacaacacagtgtttattacctaaaggagcagacttcctcaaatgtgtttctgttggacctttggattgtataacatactgtttggggacagaaatgaaacttcctagttatatttttcttagatgtatactatagtgggtgtgtattatctgtgtaattcccccaactgtaatatatttcaaatcactttattctaaaaatgaagtacatcttacatagagcaacattcaaataaaatatttgccatagaaaatagagggtacaacgatggttactagaggttggaaagggtgaggcagggagtggggatggttaatgggtacaaaaatatagttagataggataagatctagtgtttcatattcacagggtgactactgtcaccaataatttattgtacattttaaaataactaaaagagtataactggattgtaacacaaagaaagggtaagtgcttgaggtgatggataccccatttactctgatgtgattattacacacagtatacctgtatcaaaatatctcatgtactccataaatatatacacctgctatgtacccacaaacaaatttttaaattcaaatttaaaaaattaaatgtgtgtcatgagaatttctaagaagggcactccaaatcattggtttgccttgctagacaaagtgtaaattattttaacacaatatacagctgggtaaaaggaaaaaaagactgtgacttgtttgccacccacagggctgtcaggaaaggctacaacatttcacttctcaaggagtaagttccttttacagattaaattggaaatacagttacattttatttcatctcaccaatgttgaattaataacctatgtgaaacctttatttagaaatgaacacttcaagcatgcgttaaattagcaactaagtacatagcttataagaccatgaagaatggttatgtttataatgttcatttttaaaaaaaaatattatactttaagttctgggatacatgtgcagaagtgcaggcttgttacatagttatacatgtgccatggtggtttgttgcacccatcaactcatcatctaggttttaagccccacatgcattagctatttgtcctaaagctctccctccccttgccccccacctgccaacaggccccagtgtgtgatgttcccctgcctgtgtccatgtgttctcattgttcaactcccacttatgaatgaaaacttgtggtgtttggttttctgttcctgtgttagtttgctgcgaatgatggttttcagcttcatctgtgtccctgcaaaggacatgaacgcattcttttttatggctgcatagtattccatggtgtgtatgtgccacattttcttcatccagtctatcattgatgggcatttgggttggttccaagtctttgctattgtgaatagtgccacagtaaacatacatgtgcatgtgtctttatagtagaatgatttataatcctttggttatatacccagtaatgggattggtgggtcaaatggtatttctggttctagatcctcgaggaatggccacactgtcttccacaatggttgaactaatttacacacccaccaacagtgtgaaagcattcctatttctccacatcctctccagcacctgttgtttcctgaatttttaatgatcgccattctaactggcgtgagatggtatctcattgtggttttgatttgcacctaatgttcatttttatacttaattattttagaggcaggttgttgctatgttgtccagactggactccagctcctgggctcaactgatcgccctgcttcagcctcttgagtagctgggactataggcatgcaccactgcacctagccttacttaattaaaaaatatctttctagaacatttttagctcattgcttcagaaggtattaatgtgatggttcagatctgtcattcattttttcaagtcattactcgtgtccttcacatttcagaaggattagagagataagaagatcaactttcaagattatgtaagattgatagaaaaagcaagccagtatttccaccatcagcttgagataagattccatattttgacttatacaggtgatagaggcgaatgtttttcaatttgaggtatttgtcagaataggcaagagatgaggacttacactttaaaaaattcttctttaaagacaagtttgagaataaaatcaagctatgattatgtagcctagtagaaataatatttatcatcccttaacttgtaaatgagaaaggtcagtatcattctttctgttgtataaattttgaagctcaaggctcagagcatttgccagactttagtaagggtcatctttaaaccagtgaccgatccagagattcctctccattagaattcctggatgtaaaagaatgtaactggtcttgaccttaagctactcccgacactcgaatgttcaaatgtctttcagacaaactgaaaagttattttccgtactattatataagaatgattattcttttgcattcatagattgaatttaaatttgtcataattgtaacttttgacttatatacctagcctaaataaataaaaatgtttactttaaaaagtccaattagaatcattggcttaactagttgctttcatttaagtattcatacaaaagaaaagaggttttaaggattagtttctttcatgtgctaggcagtctagctgatagctgttgtagtgaaggcaatttctgttagtaattgctggttgtatttgcttacacctttatttaaaggaaacttgtctgttttgacagtctcacattttttgctcattctgaaaattacttgggaaaattacttgagtgcagaaaagttattttctttgtattgtagaaaaacatccttccctcctgaacacaaatattgtagtcctggtgaaagctaactgctcaacttcacttgttggctttgtttcagtaaggttctgccattacaatggaagcttatttcatagtttccactttcacgactgatcctcaataaaagaaaacaaccagttaagcataataaatatttgatttagtaacttgaacatagtcactttaaaaatcagaagcgactctataaggcaagacctttattagaattctctgctgtcctatgcagtaatggaggaagaaacataattatcaaagatctacatcaatgacatatttcagattgtgatttctgacatcagtgtagtaatcatactgggaattggttgtttttatttctagcaggcagaatctgaattttggttttggattaccagaataattgcttctcggccttttggctaagatcaagtgtggattaccagaataatccttcatagagcccagtagtcagtaaaagatttggtttccttaagtatatagtcaaagccattaagtggaaaattgagataataaaagtaggcaatgtagttccgtcatcacatgcaatatgattgtataatattgtgtcaaaatttcaaaatagtttcaaatagtttatgcatacccatgtggcttgaggcaaaagctcctaatattggctctttagggctaacggcaaatgcccatatttaaatgcttgtgtctataggaagtcagtaattgctaaaggtaattctgtttgcagttctaataagataagtgaataacatggtgattaatgttattttaataatagatggagtcatataaacacctaattcttaagttagtgggttgtgtttgttcatgacaaatgggaccccggaggatcaaaattaaagattcaactaaatattttcattcatttccaagaacctagtacattaccctgcccataggcaatcaataaatatatgccaattaattggctttttttttctaaaattgatttccaataattcctaaagaacaaggtcaaggagaataatatgtaggagtcattttaccaataattgataattgagctcagagtgcacaggggtgatctatgaaacgccatcatgatttctgaaaagctttagcaagggttattaaatataacagattatttcattcagtactatcagtctgattgaaaagttaggccttaatgatgtccatagctggtattttgttcctttctatgtgtagcatttccctggttaagatgcctcacaatgttctcaaattagtatctttcagccttctttgttttttggacattgtgtctgttttttgaggaggagtctgcctgccatttgtttcacactttagtagtacctacctataagattgaaaaggaggttgtgccccctacttttctgacactttaacccaccagcattaagctaataacctactggcgtctgccagaagatttgttagtgttaaacccatatgcttctagtgtttggcaatgtgaaatattataccaagtcttatcattcaccggttatcatgaacccctcaaggtgctatggtctcctcctccaataagctcagttgaactccttgccaaccaagagatactgtgacaggattgttcttatttgctgttgctatcagctttgaggagccactgcagcctggagaaagccttagaaaatttcccaaggcaactctgctattcccccctaacacctacgggatttacatacgctatgccattgtattccctatgataatatatgtaaagtcctgtacacattactgacatgctatacgtgttgaataaatgtcagctatttctattattaaatatccattattatgactgagcctctctagtggcccttaggctaaaatgactgttatacctcagtctaggatgctcttactaaacagcagctccttctctgattaaagcaccatgtgttctcaaagttcctatagtgcactatgattactcctactttggtactcatcttgccaaacaatacttgcaacatttatccttcctgtttctctaaccagactgtaaattctgaaaaagcaggaaatagctgtgacttgttcactgtagtatccctagggctttagcatagtgtctacacttttcatgcatgtagtaggtgttcagtaagtgtttattgaattaatgaatgaatgaaaagtatcctagtatcacaggttctgaattattcctacagagaagtccccaaagaagctatgtattctccagttaccctctgaaaccatagggtaagcataatcaacatattttctatgaatagatgcaaagcgttaatattagcaattatgctccaaatactaatctcaggatggatgtaacataataataacactttaatattaattaaaattattttattgcataatattattttaccatcattattcagtatcattactgattggctaaaatctgcttagagtagcagcttcgaaaaggcatttcacctctcaagtaactgtcacccacattcatcaaccctggtagcccctccttagcacatcttaaccctctctcactttttactttgtctacctgttatcaatagtctcaccaaattatatacacaatctaaacttctcttgtttttctttaaccaattagcaagattctgaataaatgtatttttgacctttttatatttactccttctaccatcgtcaagatagcttcctacattatatatttctatcccttcatccatccaaacatttattcactcaacaataatccacagattgtctgatacttgccaaaaacttcctctgccttatctgagcttatcgttaaatgggagaaacagatattgaacagacattgaattaaaagccagtggatactcagggtttccttctttctatgatacggccactcccaaatgaagactaccaggcacagattactgttgcagagcaacagtttgacaatattttagataagggtattaacaaaacaacaagaaaaacctaggaactactatgtagacaagaagaaggtacactagaatgaaatgcatttttaggtggtcactatcaaaatttaagctcttggaattcatttcctggcaatgggaggagcagcctcactcctcaaaagctatggaagagcagaggagtggaaaagcacttgcagagaaatctcctggggatttcttagccagatatttagaaatagggtttaaattcttcaagttggaggattctaacctatgctctaaggatgactgatgaagtacagaaagaaaagcaaagtttaccaaaaaaaatgaggtcacagaatttcattacctgccatcaccccgctatttatgtatgtatgtatgtatgtatgtatgtatgtatttttgagccggagtttcactctgtcacccaggctggagtgcagtggtgcaatcccagctcattgcaacctccgcctcccgggttcaagcgattttcctgcctcagcctcccaagtagctgggattacaggtgagtgccaccacgcccagatgatttctgtatttttagtagagacggggttttactatgttaaccaggctggtcttgaactcctgacctcaagcgatccgcccacctcagcctcccaaagtgttgggattactggcatgagccaccatgcccagcccatcaccccattttgaaaaccaaaagcctaaatcactcaccttgaagcagatttgatgctgactatagacactaattgattgttagtcctgttttggtttatacataggggcagccattactatgctattttattcaggcacgaagtaattgttttatatgaatgcaaacattctaaaatactgccattcattcctcaatttataaacttcttctttaggaaattgtattccttattataggctgggtgaccctttacaaatcttaacttattttatcctcctaacaactttatggagaatgtactatattttccccattttaaagatgaggaaactgaggcatggaggtaacattacttgcccaaagttactaagttagacccgactgggttctaattattgttctgcaacttactgacttaaaaactcaaccagtatgcaaattcaaagcttccttaatacagaatgtaaagtgaagaacaagagtgtacagcacaccaatctgggacgctatttgccattagttcagatttttttaaaggcatgtaatcaccccttatacatttttccttttcccagtgtgccaaaatcagcaagccaagacagttgattgcagtgggcatgtcttaaaaaccagtttccatgaaaggagcgactaaagggcctattgtgcttgttgccttacttttattttgagtccagtatctagtctgttagtttatatacagaagagactatcttgcagggaattcagctaaccctctgcactgctcttaggtcagggccctgaacctttgctcctggctaagccatcccaggtatttgattagatacgttacttctgagttcacttattagcaaggcacactatgatggagtcctgatgtacctacttgccagtgagtagaataaagatacattttgtgtttattgctgttgataaaacacttgtgtaaagtgtaatttataatttaatcacttttaattcaatttttaattaaaaatttaactttttaattttaataattaattactaataattaacttaatcattctttttttctttctccttcactatgcttcctttgaaatcatttccttctctaaacaacattggaagcgtggcactgaagtgatagatttttgtatcccattgtacttaattagcaagttgtggcatgtatttggttaatatttctctttctaaaaagattattatctttgttttggtaaattgaagagaaattgtggtccatggcaaaaagaatgaaccatgaacccatctgtacggtatgtgctcagcctgagatgcccatattctacaaagagcaatttaagcatgagtgatatcaggtgttaagcccccatgaaacatcagagataaatactaggtccctggctaacctgctttcgatgttttactgttcaatctgtaatctgcagtgtattttaattaaatcatcaaaattacagaattttctttggaaagatgtattcttcatttgttgtttggttcaatacaaggagttggcatttctgatatgttgagaagatttcactttcacatattactaggataagtccttgaaatttactagccatcaggatttgctgcttttaatgattaattacctgttggcacacttttcaaaggtattctctttagctgtttcctttcatcttgccctaccttttttgtgaatagcctttcatgtttagctcaaaagagtattcataaaggtttatttcgtttctttgggtagagatgctgatttataattttaatgcagttcgtaacagcagtgaaaattaaagtcctgagaactgtacctcagtagggtcctaaatattttatgacaggtctaattgtttaataattatgcaaagaccttaaaaatttggaataatttgtcccttcactgtaccaggctaccaggattcatctatcccttaatttagtaaatttttatgtcaggaatagagtaccatgtactgttccaaacactggagtacagcaatgagcaaaacataatccttgcccacagggagctcatattatagagagggtagacagactttaaacaaataaagatatagttttctttggagaataaacaagaagggttagaggggtagagagtgcggagagataagggtttctctttcatataggatggtcaggggaagcctctctgttgaggtggtatttgaaggatgagaggggaaggttcaggcggatatctggaggaaaattattcaaggcagaggtgtaagccagttcaaagagtcagaggtggggatatgcttagcatattaaagggacaagcttggaagccagtgtgacatataaaatgaaaaaagaggacaaatgatacataagatcaaagacgtagtagtggtcagatcacagatgatctcataggccaagtcagggactttgtctttgactctgagtgaaatgaaaagctattgggaggtgtagagtagaagaatgacatgatctgctttatattgtaaattaatgttatactacatgtatagtttacatgtatagtggccaactaacagagtgaattagggaatgctatcaaggagtccacaattttccctccaccccatgtggcctcactggctttgctttgttccacagacaaagaatgaacctcagattttaacaaaacattgtggacatttgctctgtaggtcagaatggaattggcaagaaagtataattagctcagcccatcccatctacactgcacaaagaaaataatgagtacactcatttaactcagctatcagcagtgcagcaaaaacaactcccactgaagtgagtcaggagcatcttcataaaccaaggcaagcatattacaccctaaatgatggctcagtggcctcaaggaaataaagtatcttcctaagcacctaatttactaccaggctgtgactcaggctcaggaaaaatcgaatctattattatatattcagaatacagtgagcaactgtggctaaatattgagaatacttaaaagaatggagagttaatattgctaagaaaacaaatgtgtagtctgaaattattttcactgcttatgtgtatgtctgtcttcctgtcactgctgtttacacacccatctctttgcttttttgttggagttgtacacataatttgatgtgcttgcacagagttaaacatccctattctaatggcttcatacctgctaaatttgtctactcctatttccttcaaatgctagaaaattagtgaagtccctggcaactaagtatagtctgcagagcttaccccaaagctatgagatttgaaactctgttagtgtttactcagagtcttcatactatcttttactctggtcacttggcttatggttcccctgttccttcctcctccctatggttttcagcaaatatccagcttctgtaaacattccttcagtagatctgaattgcatagagtataacttcagtgacaccaaagtgtgttttgtagcatgttgtttctgatgattgaagcaatcttcctgtgcagaaaggtgatttaaaaatggagccgccttatacaaaattacagctagataagaggaatgaattctggtgttgtgcagcagtaaagggtgaatatggttaactataatttattatatagtttcaaaaagctagaagagaggatttttgaatggtcacaacacaaagaaatgatgaatgtttaaggtgatggatatgctaattatcctgatatgatcattacaccttgtatacatgtatcgaaacatcactcttatcccattaatatgtacagttattatgtgtaaactaaaaagagaaagaaaaaattgaatcttaatatcttatattggcatagaatgtagtgtattgtttatagttcactatgattaattgactcatatttggctagtcataacatgtacgacttgtatgttcttgtaggaacatgtacgacttgtatgttcttgtaggtactgtcatgatggcaacttgggtcattctgaagtgtgattctgaaagatctggttttaggtttcaacaaaagttatttaaattttaatctgttccttgctctaggataatcacatttttttttagagattggtaagcaattagctgctgccgcttctaatgataatagaatacttaactataacatgaatttaccaaatgaatccttttggaatggaataaatgctcaagcaggttattctagtaggaagagattcatgcaaagtagagttatatcttgtttggccagtgtagactatagaactcagttttggtctgttgtcttcttgctgtaagaatacactttaggatacttcatgagttcaggctgagacctgggaagtgctctttggacaactgtctagagaaggcacatgctattccaaaagtgctaagcaccatggttgtcagaatctagtttaggaaaactagtgcacgtgataggcacttaagaattctttgttgaattgaatgagtaaactcttcattaaatggcatatagaaaaaatggtcttcataagtcagccagaggtgataccacacattctgctaaacaacaaacattatgtgaagatgttgttcagaggagttctgactgtctagggaaatcatgcattgtgattctttacacaaaccactttctttctggaaccagaacttatacctgctttacctagagaacagaatagaatagctaggctcatctgaaaatgttttagttgatataaaccagcacacataattgaatgtcttcttttctgaacaactgacatttgagagtcagtcaaagaacaagtctatgtctcctttccccagtagtgagcttcaaagcagagcaaatggatccatgacagggccgaggagggaagaatcagatgtggagtgcatgcaaccctacccccagagacataacttgggcaggagaggaaaagaatgtatatctggtacaccctgtctcccttacagttatcacctttccatcaactgactgtgtttattttagttggaagtcagcatttaaccagttctgcctgaagcttagtgagggagtttgattctgagaactgtgttctcactgaagggcaatattctctttctcttggggaaggagtgttgtttgtatcctcctgatgttgagggatatagtagccatcatcatgtaatgacataccaaatgtattttatctgagagtttaaaaattagaagcaatccaattgctgatgtgattcatgaataaatgatgcaacttataatgacttggtgataacaatttattgtataccaatcacgtgcactcagaagaacctgtgcatgaaatcaatgtgagcgctaagactaaatgcaaatatattgtggacatttaaagttttagcccccttgattatctttaaggtaatatatacaacatatttgccaatatagatttttcttcaccagccatctggtaaaaattagtatgagataaataatttagcttccttctgttcagatacaacttcattatcctcttccttgatgctgtgaaaagtcttcagaaataatcaatggtaaagtgcatttgcattcctgtcaaagctgagcctggaggtttctgacatgctgacgtttgattctttttctctgtgcgctgtgaaaaggagaggtgcctattatcaactggccccaaagaattgcgtgcatagtggcagccttgcacaagtgcactgcctgctaaatcacagtgtgaggaagcatgacatgacacaactgggatgttcgagaactgcaagtcatttttcaggatttaaaaaaaataatactgcagaacataagaaagagatttaggaggaattagttacatactccttgtgacctaatgattctctctctacccacagagactatcttacccttgaagcacagtaattggtttgtaggagatatttttccattcataagaaaaaaatatctcctacttttcatcctggacttatttctccaatctggcttgagttgaggaatcttatgctagagttgtaggagagcaggtgccagattgtggagggccttgaacgcccggccagggagtttagattttatcctgtaggcagcagagagccattaaaagattttgagcaggaggaatgtaaaaaataggacttgatttggatgcacgcttagtataaaagtgcaatgataagatatattaagggagtgttacggttctgttcacagcatgaatataactgtaggattcatctctactagctgactagttcagtttttatagcatgcaaattttcagagccagctgtaagaggttgatggtaaaagaacaaagtacgaattgatcatgtgaatgtaattgtaaggagggatttttaaatgatcaagatcactggtaacacagaatagtaatcattttaaagggtgactgtagaattatttgttattttgtttgagttatctgaaaccacttctatgctatataattaccttaagttttaagtgctccctgcagggataatttatgcattttgcattctcatgcaaatactttaacagtctacattgttgaaaatagaactgaacattatttcagataggtaatggttgtacaaagcttatgaagtattcatcatttttatatattctcatggtttatattatattactgtgttgtgttttcagctacagtgatacttaggtaacaaatatttgaaaatttaaattgcatgttttgataaagaactgtaatttgccaatttcaaaatttaatgtcatcaaaatccttttaaaatattaatataaaatgttgcagtatttcaggaaatacaaggcaagccaaatttaatttaagctactaggggctcagttatgaattgtagctagatacgtggccaaacactcccgtaaagcattgcatttttaggattcaggcttcaccgcagtggtttctgtagagccataatataagatgataatcataaacagcatcacaggcgatggcagtttagtcgtaaataggaaaccgttgtcttgttcactgcaacatagctacacatgtaagcattatatatcccttgtgaaaatgtgattcactttatgatggtgacattcatatttcaaagtgtcttgttttaatgagctttcacaggatttctttgcaccaatcttgaacttctcaagagtcctggatttccttttttttttttttttttttccccagagatggatgtgcattaagcataggaaaacctccaggaagaaatatgtttactcctctgtttggctcctctatagacactaactttacagaagaactttacttaccttgggcagcctatcggatttcaccctgagctctgagcacagctgggagtttggacagtaaagagatgtcttctccagcaaaggggagacaacttactttccagccttccccgttaaacattcacgggtgagggtggtggatatttctcaaagtccacaggtttatagaattggggaaagcaaatggcccatttttttaactttctgtgttttcactctctgttgtctttctccgctttgtatttctgtgtttcgctctgtctctctcatgtatgtatgcatgtgagtgcacacatacacacacacgaatctgactaaataatttatatatctccttatatgtgttacctgcgtctgtacctgaaaaggcagaagcctaatttcagtaaaggtgctctagggtcatttcctgaatacctctagagtagagttcactggaaataaaaaacccaacatgtgcccaaactcagttgtgagtatttttgcagtagaagagtgaacttttcatgccatgatctaggagaatgttaagtggacagatttatataagataaatggaatgctgctgcccgttgtaatggaaaaagaagcggcctaggggataggctgcctggcttggcttctgctctgtgtcagacctcttcctaccctctggaactcaggatcagttggagctcctggatcttcagtgtcttgcagccccagaaatatcacatgccagtaccagctaccgtaaacagattccagcttcctctagaaggagctgcttccctgcactggattagttctccagcagaaagtgttaatgccaggttccagtgtattagcatctcttgtttcatttctttgactctaaaacaagctctttagagatttttttaaaagtctaccaaaacccattataatcattacttttgttatcattacttttgttaaactgtcccttacctgtcacttgaatgccataactattcaagcagttgtagaaaactttaaatgtaggcactgcttaaacataaaatactgttatatttttcattattgttattagtaatctacattatgaaagtagaactagtaaaacagtggtttggaacaaaagaagtgagataataacattgtagttttgtagcatagtaattaaagtgagatgtgtaaatgtcatctggcctattaatatggaattatttcacaaatccctttattatcatgtggtctcactgatacacattatagtaattctagtattagattcttagaatattttaagcgctaaatcaaaggctcatgcattgtcatccttgaaaaggaatcactactgtaagcatttctcacacatacaattaatgtgtagcattagcccctcacagaaatggaaaggtgcttttcttctctgtttttattgaccaccaccagtttttataccaatttcaagttgcggggtggggagaatactacattttcttatatatcacacaaatggaaagttaaaggaagggaagagatctggtagttgtcgagcatttccacttaagctaactgcttccccatgccttctgtgatcttccgtatgaagcacatgatgctgtccccatcttgcagatgcaggatcagaaaacacacgaattgcctacagtcagaaaacttggaagtggaagaggcaactttgagctgagctcttcaaaagggccagggcacacaaataggagggagggctgagccttcagcaaacgttgaagttgcgcatttagaagggagttggcattacagctgttgtctacccagtgactactctgtgggtgaaaaggtgcacttgcaattgagtttattttaaaaatgacttgttaagggcaccattgctgtgattttctcacctgtgaggtgggaggaactctcctctcaggccagagggaagtaattactgagaggtgccttcaagagtaaagcagattgttatatatttcaaagggggctgtcacagtgcctgggacacagtaggctttcattaaatcctagattagaattaattcttctatttgggtctcaaatgaataaattggctccctccattcagattcgtgacaaatgactgccactagcatcctctcatgtagctcctttcaaggggctgatgagtagaaatgcattcttcataaaaaaggttcctctctttagcacttgttatcctcagcagtcatttgcagatgtaatgtgatgcagcagtttaatagtcctctgcagcaccattctcatccattcaaatccttggtttatagatgaggcctttgcaccttgccctgtgacaccagcttttatgttttgcagcagaaagaatgctatagtgacttccatttgagcagttgctgttggctagcattactttcctacttgttcaagaaagtctcctttcaaagtttttgaagaagcagactcctaattactgtgacacttttcttcagagacaaaccctaccaaatgtaacagagctgctatccaatgtgtgtcaaaagtgtgattctcaaagattcctggccaggtgcggtggctcacacctgtaatcccagcactttgcgaggccaaggcaggtggatcacctgaggtcaggagttcgggaccagcctggccaacatggtaaaaccccgtctctactaaaaaaatacaaaaattagccaggtgtggtggcccttgcctgtaatcccagctacttggaaggctgaggcaggagaatcccttgaacccgggaggtggaggttgcagggagccaagatcatgccattgtactccagcctgggcaacagaacgagactccatctcaaaaaagaaaagaaaaaaaaaatcctgaggtacaagaatataatatgcacccaccttggtatcattttatttttaataggccttgccagagcttttcaattcatctaggaggaaaggacctttgtcttgtgcatgacagttggttggatctctgtgaaaatttttcagagctcctaagctttgaatttttagtcaagtgcttgcaacagctatttaaaaagacacaacctactaagcttgttctcctgataacatgtacttcagaactcatattcttgcagctggatttagatcccactctgaagtcagtacagagaagaggactgccacaaatgagaaagcttcatagtagcagagactatgtatccaataggcacaaattaattacagagaatggctaaaagactagaaggtttgtttttagaaatcatatctgatatttgattcacctttcaaaacacatagatcaacactgccattaaaaaaaccaatatactgaattaatacacataataagcaggttaatagggggttttttagggggttattcaccttagagaagtgttcttcgcttgaaataaaaaattccacagatttctgttaaacagtgagatgccctaataagttttaaaatatacaacagttcacacagtctctctagaacatattttatgtaaaatgaattacaccctctgccacctaattggattgcctaaacaatccgtatccttctgcagggttaaggtcagactaacacagtcttgggccagtcacacagtcttgaagacatatggcctatctctcttctttgtcacgagtctcaacaagctacttccatgtcaaaatgtatttgctgaccagtcttgcaggagagtgaggcgtttggatcatgtaatttttgtatcacgacaaaaataacccatcttagcctctggaagggatgtattgtatttgtttgttctcattctttaacttctagcttatttcagtgtgttttataaaacattgttttggaagaatggagagcctgggtaatccattgtatgacattgctttagagaaatatatgaaaatccagaacaattcagtatagaggactaaatgaactccagggctgaaatatggtcatatctgagtcctagctctgttttcagcagtccattggttgacaggttcctgaatagttttcttatttttgtttgtgaagaactaaggagaaaaagcaacactgtgttgacatattttgtggggccaacataaggtaaattaaaatatctatgaaatatctaggaatatagaaagtcttggtaaagaattcagtgtaaccatatgaggcaaaatagtcccaatgtgcatactcttaattccaatttgcatttctttagaaatcgttgctaattaacctgtgtatttttaagtcattttgtggcatggtatttcatgaagcccttttatttaagcactgcatttctttagtgctatggcttggattactgcagccatttcagcctattgcagacagaaatgaaaaatgaaaggaggcaaaacagttctctgagaaccaagcttgaaggagagtgctgaacacaaagtgtaattcatgtacagtcctaatttttgatagaatttatattcttccatgttaataaaacacatatagccaggccttttttttgtaaattgattccatagtgaaaaagaatcttgaaaagtggatttatttatttggccttgatttctgggcccgtattatcagaagcaatcccacatttcatgtttatggagctttacaatattcagagcttctttcaccctagatcatctcattgcatcctcatacaacaaccagtaagatcagcagaactggtagatttttttcaccattttacaaaaatcggtctaatagaatttaattgaaacacttaactatttgcagacaaaaagaccaggagtatgaggttcttgcctatgtcaggattattaggaatttctttatttttgcttaagtattgttttgcttttgttattctctattcttttcctccttttctccctccctccctccctgcttccctccctcaccctctcccccttttctctatacctcccctccttcccctttctctcatcctttccagttttgaaattgaatttacctctaggccactttcctcctttgatcgcctactttttctgctctcacaggcaagtttctgacttgcctgtatctactttaaaatagtcctctattcattggaaaatgtagtgccacatttaacccttttttggatttacacaagggagcttccaaagtttcttcatatattctatttttaatttatttgtttcactaggtatgtattgataatttactgtatgccagcccttatgttaggagctgccctcaagtatctaatagtccagcagatatttgagtgagcaatccatattctgtttatcgtgaattaataattttgcttagctacagtgcactgggtgagtattgattccctcttccccagtctctcccttcccatgctttgatctcagtaataatgaaattcattcacatcaaatataccctggaagagaacatcaaagccctaaatataataattagtcctggattttgaaatcactggtggaggggaagcctgtatagagaatataggtagttacattgtcacccctatgggcatgatttatgttttaagattctgttgtttcaagttttttaacagagttgaaaatctaattttaatctgcatattaatttcattaggctggggaataattgatgtacacaagtcaaacctgcttaaataacctaacttttaatctggaaaattaattatcatcggaacatggctcagaattagaagagtgacccttgctattggcagtaattgttcaattaattggaatgatcaggctactgaaaatgtgactggaagagaggagaagaagagagaggtgggaatatagaaggaaaaggtagattagttaaaataggtttataaaacctactgaaaagaggaaactgtgtttctaggttcattatgaaacattctttaaatgcctactcataatatctatcaactgtttttctttctgtgttctatggttcttgctttaaaaaatgttacatgtgaattaaacaaaatgtattgagacacattaatctataccaggatgtgtgcacttggcaacactgccatcacaggctttgttcgccaggctgaggacttagtgttcccattttatgtatggacaacttcagtaccctctgttgttctctccagatccaagggaatcagtgcagcccatgtaaaaaaaaaatatgtttttgagagaaatgtgttaaagggaaacatttacagtctgcatggcaatcctcaaagcctcccatcctgctgagatacggacacacatgaaacagtgccaccctatcagttgcactatagctgaaaatacaagagcagggtgaaaaaaaagtatgaaaaacctgttattaaggcctatgtttgccaaattacttatttgcatcaggaaggcatttagtcttggtgtgtatcttttggtattggagatgtgtttaagacgctgaaacaacataaatgttttacagatattttagctctcatcattttggtatggctactgaagatatagctacacaccatctgctgactgacatggtccttacttggctcaattcagggaagccatcatcacagcccactcgtctattaacctggctccagctccgggaggccaaagagatactacactctgtccatactttgccctcggtgccaggggcaagccaggccactattgcttcttctgactgtaacagagaataacaatttatattgctcccaagcctttgttcgggggaaaaaacgttttctggcacacctttgggtcttgcggttatttccatatattcaacataactggttgcactaatgcattctttacttgcctctctaaagtctgtgtggaggtcttaatatgccctgagaagggcagctgatcattaacatctgtggctgtaacaattccccaatatgttatacagatgtggtgtttagggttcaaatgttttattcttgtcagtgatatttcaacctccaaagaattatttcctccttaataatgtgagtacattggtaaaaaggagtattagattttgctcctggatccacctactctctgaatgtagattcctcattccttatccaaaatattatcattatactataatgatactaactgataagaattttttttttttattgagatggagtctcgctatgtcacccaggctggagtgcggtggtgcagtctcggctcactgcagcctctgcctcccaggttcaagtgattctcctgcctcagcctcctgagtagctgggactacaggtgcccaccaccatgcccggctaatttttttttgtatttttggtagagacagggtttcactgtgttagccaggatgctcttgatctcctgacctcaggatccgcctgcctcagcctcccaaagtgctgggattacaggcatgagccaccatgaatttcttaaataaaaggttcagtattcactgagaagaaccaaacattgaactgcaagagaaatagacatgattatacagaggaaagatattagagacagattgattatttcattaactaaaaagttgttatttttctgaaaaaacatagatatgccaaacatacatttcttttaagagaaatcaacacataaaaggtcagaagacttaaagcatcttttattttgtactcatgtcaagtaatttctcagtaactatgcagggaatgcatgacatctttttaactcattcatgcattaacgacaatagcagacatttatccagtgcctgttaaatccagaacacagtgattgctgcctttatttagtgcctctcatgtgtcaagagcgctatggtaccttcttccagggcactagtgagcatcttccagatcagtcaaagtaggttggttccttggcatacatctacttagtctcctctgaacagggatttcgtgggttgggacaaatccaatttctattattcatatgaatcactgcagagacataggggtgaaactgtatccttttggtggacctgcctgtgttgggtgacatgctcacatttttccacatttgataaaaatcaagcctcttctgcctactcaacactggataaaatgacagtgtcatacacagagaacagaacactcctttggttgcttcagcattctttttttggcctcatttttctccctctttactgagtttttgagtccaaatttagtggtgatgactaagaaattgccaggatgtgacagagcattcagttcattgagtccttccttgccatttttcaatagttgtaacaattgccaagattttctcctgatgttataggtgccacgttataggtgccagatactaaattacacttgcagaatctgtccatgcagtgacagcctcattttacatacagctgatttcatgatatggtattaaggaaaatccctgcagactttttactagttgataattctgagtcctagaatttccaatatttaaatctgaatctctgaaattcaaatcacataaacaataatcaagcggtctgccatgtgctaacgtgtcatttttgttgggggaaggtagattggggaaaaaataagacaagttccctaccatctggagctaatcatacagttgtatgagtcacagggccatgctagagatgtagatagagtttatgggagcacagataacaggtgtaatcagttctgattgggagagattatatgtgattctggaaacagtcatatttgagctaggccttggagggttagaggaaagccagtaggtagagaaacaaaggaatgacattctaagcaaaggaaatgaatggcatcagtaaagcgcaaaggcacacatggttctgtggtgaatgacactggaagatgacgctggaaggcatggtagtgactgaattgtggagaatttttaaatgttacatcaagttgtttgttgtttttactataggcaaggtgaaatcatcaaaatttcccaaggaagggaactttgctttaggaaagcaaacctgccagctgaagagaagaaaccagttaggatgttatgacagcagtccagtgaagaggtaataaggcgcaaagtagagcagtggcattgggaatggaaggtgaaggtcatggatcacggactagagggcacaggaatgaaatgaaaggccctctgaagtgttaagtgagcaactgccaggatggtggattccagttactaagacagggaacacaggaaaagtagaggaagtgtggccctgtgcttcaaatattattcttccctgttttctgtattgaaaagctcggctaaaatgataccctctctgtgaatccctccctagtccctcagtcagaattaagtctggctttttctgttttcatacagcacctcctgtaagcctccctttctttccttatggtagcacacattgtatctatgacatttgtgtacatgcttgatacctacaaatatatgataagctgtctgaagccacatattacttacctatgaatatttagcaccgatcaactacataatggatccttagaaaatgtgtattaaatgaatgtatgaatgctgctatcacacaagacattaaatgcagcccatttttgggacctgacttagaatatgcaatgatcccatctcaccattctggagtcagccatacattgtttatgtggctatttggtatcatttgccttgatcatatgcatttttcaccagatatattttcaaaatggtttgattctttatgaaaggaaaatccattctccaatgatgacttttttccgtacagtgatttaattcccaaagaatttcagcaacgttctatgtacttgtcctcatcactaaaggaaatgtggagacttctagtcaaatttcttggtactttcttggctttctctatgttgagaaatcctacaaagaggagttttcacagcccataaatagaacattttggttcctaacatgtgacagttgccttagaagtacattgcttcttgagtaggttgaatttgtgtgaatcctctgaacatctatcgagtgtgcccctaggctgaaataaccccaaaagatacttcagttcgtgcattctgggagccagattgggaagatggggggagattaggcagattactgtgtgaaacactgtttgtagaatcccagaaaaaaggaaaggaaattgcttgagtgcttaaatttcagagaaaagctgccttgcctgaggaatatatccctctttgctgaagtgactgagagggcttcagatgttgctgctcagctagtgtgtattgcttaaaatggtatccaatatgaaaaataaaggaaggtagaaccatggagacattgtttttaaaagactagtgccccagaaagcttgcaatatttgtttgtatacatgtttttggtgatagtaccaagtgtttttcctgataacatctcagcaaattagcaaaaatctgatagtttaattggtgcctctatgacatgtagctcacttagcattttcctaataatcttccactccaagtaggccctttgctactctatggattacttatacattcaaatctactattcatttcatttagcttagaaattatcatttttaatggctgtttattgtacacatagacacgtgtacactcaaacacacaaaaggttttttgttgttgttggtttttttgtttgtttgtttgtttccttgaaatggtctattgagggcaggagcccttcatttgaaaaatccagtctaaagtaaaaatggccaaatgcatgacagaaaaccatattcctgagttcaaagtccactgggctgctctatcgtgtctgctagtaaaattgctgtaaattccttgcttttgtattgatttgcatgtaaatgttactgtaaggcaaggatggggtgaggggggaatttttctttctgtctcaagtcaaggtccaatgatccaaaaaaaatcaatttggtttacctaaaagtaaaaggtaggctttctttgtagcattcttttagaaatataggcagaaagcattgtaacacagatttcagcctgaggcaattgacaaccatagtgtataataactcaagaatccatgaaaattaagtacaaggaccgaatgtttattttctcatattgaaccctgaagggaacaaagctccatgtgtcagttttatgcttgtcttttcaatccttggctcttgtagttgtccaatatatttcacttatgtggcttgttctaatgttcccattacctattacaaagagagctaatcattgatcaatagcactttcacttatgactttttctaaagcatcatgtgaaatgttatatgtagtctgatggtttccaatgatgatagtttatgctattaaaatagagcaccagtcacacgagcttttacaaagtatgtcttaatctcctaaaaggcaataccacatgattctacaggaaattcatagctataaacactgaacttttgtttatttacttttgttgcaggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaaggtacatttgatattgtgggaactatggattatgctactaaatatacttatttatttattaaatttcaatagttttgggggtacaggtggtttttggttacatagacaagctatttagtggtgatttctgaaattttggtgcactcatcacccaagcagtatacactgtacccagtatgtagtgttttatccctcaccccactctcaaccttccccccaaccaagttcccaaagtccattatatcatgcttatgctttatgtcttcatagcttagctcccacttaagtgagaacatacaatatttggctttccattcctgagttacctcacttcgaataatggcgtccagctccatccaagttgctgcaaaagatatcatatcatttctttttatggctgagtagtattccatggtgtatatatataccacatttttttatccactcgttgattgatgggcacttaagttggttccatattttggccattgtgaattgcgctgctataaacatacctgtgcagttgtgtttttcatatgatgacttattttcctttcagtagctagccaggagtgagattgctggatccaatgctacttttagttctttaaggattctccatactgttttccatagtggttgtactgatttacattctcgccagcagtgtaaaagtgttccctttcaccacatccatgccaacatctgttgttttttgacattttaattatagccattcttgcagcagtaaggtggtatctcattgtggttttaatttgcatttccctgatgattagtgatgttgaacatttagaaatagtaatttaaagcagtccttaataatacttttgaaaatgaaacagttgttccacattaagacatttatttaaaaaacttacattttgtaacactcaaaaacatttgctctcctgattttaatttttccatagtgcatgtacatatagtgacactttacttatgtggaagtaacttacatgctaactcaggacagccaagatccccaaattatgctaaaatgttgcctgggcagaaacataggtgttaaaaatgtgtatacacagccgggcacggtggctcacgcctgtaatcccagcactttggggaggccgaggcgggcggatcacgaggtccggagaatggcgtgaacctgggaggcggagcttacagcgagctgagatcgtgccactggactccagcctgggcggcagagtgagactccgtttcaaaaaacaaaagaaaaaaaaaatgtgtgtacacttaacacttaccagaaagctccttgggtcctctctaagggcccaacatattatttcagcaaattttgcttatagttttcccatcattattagcagattaatagcaaattagaaagggtgagggacaagaataggctatggaagatagggaggtaagaaatagtgagatatggtagagaagagacagaaaatgcgggcaaagcagaggaagacttcaaagagattactagcctgaggtaagagtaggggtttagagtagaggcagacactgtgcaattcgaataagcacagcactgtgttttacagcacattttttggagccagactacctaaattcaaggcccaacttcactttttgctaactggatggtcttgaacaggttatttacctgtgtatgcctcaagttcatctgtataatatggataagagtacttataagattctcatagggactaaatgggataatgcatgcaaagaacttagagtagtatctaatgttatgtgttccataactataagctattatgtttatttatagcacaataataaattttaccatttactgtaccaagaattatccaatacttagactcttgaagtgtttcattttaaagtatgatagaaatcagtgttttaaaatattttaaattttaatatttgccttgtacagtatgctatagatcatatttaaacttctaagaggtttattaaatgcattttttattaatcctctcttacataaccatatgtggttgaagttaggcattaaaattctttacacactactacaccaaggctagatttttgcttaatctgaacctgtccactctctactgagtccttgaaagcagtgtttttcatgtctggcttaaggcacagaagcctagtaaccaaaagaaaagttgaggaccagtgtggtaggcccatttttttaatgtattttttttctctttttccttttctgaatttaatttataattgacacaaaaattgtatatatttattatgaacaaggtattttgaaatatgtatacattgtggaatagctaaatcaagctaattaacatatgcattacctcacatacttatcatttaggtgtgtggaatagaacacctacaaactattcttagaaattttcacaattggtatgcccatttgaaggccttttacaccatctttgtgtgcttttcagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaga

SEQ ID NO: 36708 - DNA, 633367 bp, Homo sapiens
cagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaagaggaacttgaagcaagttcaagttcaatgccatgagagcgtagtgtagggggaattacctaagtcctgcaaaaggaacggggagtgcttttcattgttctttagtttcgaagaggtcttgctatcacgatacatcccgtaaattgatttctgaaatctttccaagaggaaaactttttccaattggaaaaaaaagaatttcttcaaatcagagcccatcctgcagagaaaggcttcccaagctgtgtggttcatcctgggactttatggagggtagctgatgcatcaaaaaaaaattatatatatatatatacacacacacacacacacacacacacacacacacatatatatatatataaagttttacagaactttgttttcaacttttaaaacaggatttctaaagaagttatgtggttttttttctttcatggcaatggcgcctccagcctcacctttttcaaacccacatcttatcttcatatcctattttattgtagtgaaatcgtgaaatttctccttttgcttaaatacagaggagacttctatgtcatgtgtactttaaggccacagtgactagatatacactttggaggactttggaagatggctgtatttaatgtaacttaaataacttattctcctcagagcctcttagtgtttatgtatatatagctctcatttctgaaactttggggagtctttgaagagttattttattatcatgaattttacaggaagcacatgtgcagcattgtaagacatactttgtaacacattatttcagcaaacaattctttaagttggaaaacctgtatcaaagtaaaaaaaaaagaaatatttattattcggttttaaatatgaaaatgtttaacctaagagtacaaaatctgtaggttagaagcttttaaaagttttaatgaggctgaatctgcttaagttttgaagtatacttatccttcttccagttaacttctagccaagtcaatagttctgatatttgttcttataatctagcatttttagcagtactattttttaaggagtaaagagatatcccaagctctttctataataataactccctgattaaaattcttggaataaaaatgaccttgcattcactatataacttttttccttctatttttgcttttgcttctctgagaggtaaaatggggccaatatgacttaattaatataatttacgagagtgattttaagagtatctctggccacttatttttaaaaattctacttttaactattaaactttgctcaattacaaggtgtgtttaaacaagacataatactttaataatgttaggcagctgggagaaatgaggggccaggggcaccaatccttatgtccacttggaatggggcagaaactcaaagcatgcagagtaaggatcaagtaaattgttgctaagaattatcctgaacacacacaggatttctcttttttcctctcccttcttatttactctcttttcaaataaggtaatattaactctgatttctatgacccaggcacaagatgaagtgaattcaggaggaagggtttatactaccattctgtcaagataccacttaaatgctacatacaataaggaattttattcaaaatagctacaacatacaatctactataggctgctataatctgcattctagtatatattattgtctttgtcatagaccatttacaatatatctggaggttggctcaaggataaatgacttaaacctgttaatgttgaaagtatgtaaaattcatgaaactttaaaattggatagtgatttatgatttaaaaatgccttatgtacacgatctttattcaccttcagatattattattctcaaaggacaaatttagaacttaggcttccagtagttgtaatttaagtttacataataataactttatttcaacaactaaaacacttccggtattgtttgtgctgaattcccttttttatggttccaaggtttctttccattaattgtttaggccatgttttctttttagtgttgttccattgaagcaagccctctgtgaaaatcacgggatatgagtttgactggagaagggttttcctggctatgatcaacttttctgttttcgattatactagcactgacctttctaggcaagcgctaattgtgtagaagttctatttccccttataattcgataccactttattaagaatttttgacatgaatcaaccatttttagatgttgcagttgagttagaaacataaccagactttttgttttttactttttctttgaaatcttatgtggtttctatagcatactcgattgtagtatgaatagcattgattcagcaagaatgatattccaaggaaattctttagctatatttaaaattgacgaaatagaatgatgcaatcaaaatgattctgcatttcagcaaggcagtgtctaaaatgttttctgatattcttgtgaataatatgtggaaactgaagcataatggcaggtaaattgcaactgattgaaaaatagttcacaaagaatattgcatagtggattaaggtcaatccggaaagaagtctctagcagtgcaacagaggttttcttatactcaactatcttggtaatggcttgatggaaaatgtaaaatccaagcttatcagaactgcatgtggtccaaaattgatagaggtggctaagctggttactaacaagttcagaaattttaaaggtctctatagccttgaccatgaatggcacctacatgaagttgcttttattattcatatccacatgttaaaaaaaaaaagtccatttgtgctcttctggaaattagttacattgtttatatgtttaggaatgaatatgaagacaggaagagaaaggccactctgaattgcagcaagttcgatatgaacatatagtgtaatatggtgacaaaaaaggttggctcacttttacacaaaactcatagaagcacataggtctgttgcttaacacacatttgggtatttcattgacaaatgggtgtagatgcagagaagggagagcagaatggttaagagtctgagaagattttcagaagaggaatgtcccaagtaaaatctttccatctgaacaaggaaagatttagggaaggcaatcataaggactgtcctcaaattttcagaagagtcgttatgttaaagagggactattctaaaggctgaaggtggatccatagaagaacatgacaaacaaccaggtttgaattttataatatggagaaaatagctcctctcctcacttcctccccatgccattttgagttgttcagaaatagctgaattgtgtttgagcaacttgcttctggaaatgaccatgcagtgatcagatgtacagttagtgagggatgctttatgagggaatgcctctactgagaggaagttaagactcatcaactgtctagccatttgtcagttctaagattctaatattatagtctattgcttttagagtgcatacttgcatttaaatttctgaattcttaaaatgtcaagaaaatgttaaatatataaaaatgtgtttttaaatcccttctgggatttaaaataaaaacatgtttgagacaatcctcacacatttttggcaagaatacttagatatttagcatggattttccacatcatcgtcaattgcacagttctaaaacatcttgtgttataacacgcaagaatactttataaattacctgagaaattttcaggggattcatagtggccataaacctggaattaatttttttaaatatttttctttgctgcatatgttaactttttggcttgtttgccatatactgacctaatcatttagtaaaaatgattcataacagataaaatgcatggcatttcaacatattcaaaatatttatatgaacatattcaacactgaatattatagatgtgatagaattaataaaatttatataaattttatattatgttatatttcacatatcaatgtgtacagatttctggtctatcttaagatttttctaccctaggatttcatgcaaactaatgaactgaatctatatcaagggatgctgggggctgggcaaggtggctcactcctgtaatcgcagcactttgggaggcctaggtgggtggatcaccttaggtcaggagttcaagaccagcctgaccaacataacggaaaccgtgtctctactaaaaatacaaaaattagccaggcgtggtggcatgtgcctgtaatcccagctactcaggaggctgaggcaggagaatcacttgaaccctggaggcagaggttgcagtgagccgagatcgtgtcattgcactccagcctgggcaacagagggagactctatctcaaacaaaacaaaacaaaacaaaacaaaaatttaaaaagatttgcaacttatcatctatccagtttgcagtagggccttatttagcatctagaaaccatgtgaaaaagatcaggaagaaattattgtaaataattattgtaaatggttgcacaagtggtttaacttctaatctagaagattcgggtttaggatttgtttacagttgcaacttgagcctcgatagctaaacaggaatttaggcagaagctccgtttcagtaaatgagaaaacaagacagagtttagagaaagataaaagtagattttccaggcttagtatataccaagcagatagaaataaaactaattctaggctttccccattggtaagactgaatttagaggtcagaagttgtgaaggaaattggtggggttgggcctatatgcattggaatgtggtaaatgaatgaatgtttacagtgagtaaagaagataaaaaaattcctgctcttgtggaactaatatttagttgggatggagatgagcagacaggactatgatgaatatatgatgaagcaacaaaagaacacctatattgtataaaatgtagttgatgaaaaatgtcctggacaaacaaatacaacggggtaaggacagtcaggagttctaggaatggagggaggttgatggctattttgttggtaaaggttggtaaaggttgacctctttgagaggatctcactttggcaaacacttgaagatgacgtgggagtgatttgtgcagttatcagggggaagagtactctctgtacagggagcaggcctatgaggatctaagcttggagcatggtgagaaggctcagaggagaaatgggaaactggaacacatagcattgttgaccttaattttaaagattttgcctttttgtctgagtgagatgaggaggcatcggtgagttttaacagagttaaataaatgaataaaatcacaggtttttttgtctcaaatacgcactaatccatgggactagaccaacagtccaagcatagaattattttagatttatctcttgtcccaaacactccactgatagaacacatttaagtgattctacattcaagagcattccacttcaaccatcttatcatggtgaagctcagatgtgtctttgtaacactcttttcttccctttggcaactcagtgctattccattattcaaaatatatcagtacctcagaaacaatttgtgtgcagggaacttccgcagcttttaaaaattttgctccagtgtagttagaaatatgacagatttttaagggtaattttaaatagtatgcactttaaaacaaaaatgaattattcacaatcccacatggacatataggtactttggagttcccttttttattatctatttcaatctcagacgctaaagtttagacacaattgttgaaaatgacatagtgatgtattgatctgatgatttcttttatgatatgaaatttgaaatgctacctgttttacattcagaaacttattctatgttctgtttccatttttgttactgttttaagaatcacttgtaagctttaacaataacgttttggactatagtaatgcaattttggcctaatttaattctgtcatttagaacaaaaaaggtaaaaaaattggatagcttttccttctctctccctctcttctctttctcccttcctttcttccttcctccctttctttattttccttttcccttagtattcttcctgtgaataaaataaggtaattaaaatagataattctaacaaatataacatttaggaagatagtaaggcaaaactttacttaaatcttccttattaaaagccacaggtaattactatctaaagatagtttgagacatattttcagggtgagttaaagctaaagacatttgcttgtcaaagatgtataatatgggtttaaaaatgtttttctcctaagtaatcttgagtgtggatcttaatatgggaactttatgctatttggattttatttggacacgtgacatttacaaaagatcattgaggattgcctattaatgggttattattcataatatcggcctctgtgacatgcctaatctagttcaaacaacaagttaatctatgcaaattcctgatgatgaaaacctcaggagctatttagtgcctggcacttaggaaatgtaccttgtgcaatgttaagtatgtctctgtatgtgtagtccactcaactgacccccgaactgtgtacctccccaaggctcttcatttagctgcgtcttgagtgccagatggtttagattggtataataatatgtagtgcattgtgagcattaacacatttacttacgtagcagagctgtttagtagattaatataattatcctcagtttgtagaaggaaaatatgcccagcaacttgtcaaggacaaacaaaaattccaatgcttattttagaattagaaattaaattacggtcctgctcttgactttgtagatgctaactatcacctcttttggacttttatatatttatctttcataaaataccctgaggaaaaaaaaatccatttctaagttatgttagtctatcatatccagagattcatttggtattatggaagaacaaaaaataaaatgtgtagtcttgaagggtctttttcatttaaatacacacacacacacacacacacacacatgctgcttattactatgtagacatatacacacatgtattacttaaaactatgcattaattcaaatgcattcatcaaattttagtgtttacattcttggaactttgattactggacactaggctataagaaaatattaattgattctttattggcttttctgaagtaactttacagaagttacttcagcaagctagaaacaacggtatttattatactgtataatgaaccctttaagaatagtcaatgtgtaaatgtcagtgaatgaaaagaacaagaaccaaacagatatacctaagaatcagagcaagattaatctcaaaattccttctgaaaagatgaaaaaccttgacatcttcataaaaacatttaaagactttcatttgaagttgaactcagttaagacaaaagtcttccaatctcccagattttgagagggtgtatttgtgtatgtatgtgattgcagcaccagtgcacatgtaccatttacagcctagcactcacaggacctaatttgtatatttagtatgttttctgtttgatttttgttgtcttaaggtattagattttgtttatcaaaatctttgaataagaaaatctaaaaattgaatttctagaaaactctagttgccttgacaaatgattatggaccaaagaataaattataaatgagacaattataatattccatccagtagctatactgttaaaattccaaggtataatccctttcgagttgcttgtaacttagaaggtcctattctatagaagaaatagagttagtagagtttgctgcatcaaatatattttttcaaatgcctacatattatagttgacacaatttcctggctttattgccttctgtgcaattttcaattattggatgaggctgaaagtttgaaagagaatatgaagcagtgcaattgtcatttcagtgagctacctcatctcattggtttgtcgtggtacatatgtaaaacactgaatataaaacatgaaacatctagtaaggcctcaataaatgttcattttcaaaatgcctcaaaaaatgaattaaacctaacaacctaacatgacattctctggctgaaagaaacactcttctccaacatcatgtggtataccaaattcagttgagactgtttgtgaaggaaggaatttgcttatatacttaaacacacaagtatttgaattctaattagaatttgtgctgcagtatttctttattctcaactttatagcttagcctacaataaaaactcttatcaatacgtacctctttatacctttagtttccacatacagtactcttctttggaggtaactgaatcgtagaaaacgtatggacttaggagaaggctagactcggatccatagccaagtcaccactttactaagatcaaaagcctgagtcaacggagttaaattttctattcgtaagataggtttaggttagataataaatgtgaaaatacttgccagctaatcagtaaatactagctcttttcttctttattttatgagcataaaactaaaaaaaaagatttgctttgcatatagcatatcctttttgcttaagaacagcaaaatattctaaaaatttctttgaggagaccctaagagactatagatggcaaactatttatctcattgccaagagattgaataattctgtcgaggttacacagcaagtcagtaacagagataagaagaaacacaagttcctataattagctaacagttatgttagtagctctgtgtgagaagtgatttaaaacaggcaacatgatggaaatttttgcaataatttgtagttattcatacttcaaatgtggtacaataaacgttttttctaggaatctcattgttgaatatgtatttattttgttgataaactattttttaaaaacttctttaatacttataatatgtttagataaatatatggcatatagtaagcacttcataaaggttagttattattcttagtctatgaagtatatgttttcattgacatctgcttgggtagagatgacaatgtggcgtgtttgacacacaatgtaagttaatttcagcatggccttcagtggaaagtctaattggattgcagaaaatctctcaatatagattgtctttatttggactctccctaattactatagtaaaaaaaattcttggaatacattatttaatacaactctggatagggaggattcttagtgtgtctacttgtgtattaaatttttagtgtgtctattttgtattaaatctactattaaaaaaaccaccaaaaaacaaaaccaaaaaacctacttcagaaaatcatatagtactctaacaaatctctagagaaaactgcttttctaaacttgggaacgctggattttgaaaatatttcagacaaaacacttcttaaaggcccgtttaccatcaaaaagtttcaatcttgcctaacacataatgtgcaaatattcattttttcattctgatacattagaaaagtcactggatttgtaattggaattccaaaatataaattttccctctagctcttcctaaagagattaccttaaacatggataagtcacttaactattctgaaattcaattttccatctaaaaaatgacaatgtaatgttcgaatctatttcatggggttgttataagggttaaataaggcagaccatacaaataccattattaatactatttgttattataataaatgacagagttggtcttaggcatcattggttatgaagttttgctccaccccctttctttgttttttttccccagtggctcctaaccatttgttattaattaataatgttatgtattaatatacatatatgtattaataatgttgttaataatgttatgtattaatatacttagttctcctgttttcaaggacccatgacacatagctttcaaacatggcacaaattatttgtttagtaaacatatacatactactgcataagaagaaaatatggtatctgaaagtgtacatcagcttcctacaaacaagtagcaaagagtaagtattcagtgaaattataaaactatcataaaaatagcctaagggctctgaaacattctatgtcaagattcctttttatcctcttaaaaataattgaaactttgatttatggtatatctactatttgattgtattaaaattaaaattgggaaatttaaaaatgtttactaattaatttaaaataccagtaataaaacaattacatgttgacaaaaagaacataactttatgaaaaataattttatatccaaaataaaactcttcaatgtctggcttaatagaagagaactggattctcatttctgcctctgcgttcaaattattacatgttattttagtttaaattattttggtttaagcatattaagaaatatataacaacaaacatagataagctattggaaaaaagaggagtctgtcagtgccttttaagatagctgtaaatattctttgattctataccaaaactcagtaagtggtagttttcaaaagattggctgcagtgtggtatctgaaactgcatcaacgatatttttgtacgcttttatattaaaatctacggatctatcttacacctggaaagaattttacccatgtgtgatgttatagtatcattcatagatcatttggaagatactgatttactagttatgcagatcagccacaacttgacagattttcttataaaatattttaattacattttttatgactattgatctcaccagaaaagtccctaaatattagaagctgttaatctcacaatggtagagacaaatttttcagaatttttattttcatttgtaagtttctgtagttattgacaaattttgttatttttcttgaaatagttactttattcattcttaagaaaatgtttatcaaacaaatgagtcttaaaaaccatagttagatcctttttgtagtacatagggtattccacgaaaaaagtggctagtttagcttgcagctgaaaacaactgtacaaatgcttttcctcaaatcaaccatcatgcttcagtatacagttgatgttaaaaagatgtacccaagatttaataaatttaatcattgttactacttcatcaagtacattcatctgtgaaactagttgtttttttcttctgggagtgtgtggtggtgaaaactaaactgaccactagcatggtttagtacccctgccttgatttgtgctaatgtaccatcagtgtttcccaccactattgcttttgcaccatcagtgcacatgtcaacacaatgaaaaggcagataataattaaatcttgttactaaaaggatttttgaacttgtgtacctatggataatgtattgtggactcccagggattcacagatctttctttgagctctacagggttggactacagttaagttcctcactgcctgcctcttcaccaattctacaaaatctatagccatatgaaggtaaattttgcaatcagaaaaagccaaaaccacttcagtttttacctcaggtctagtctaggagagtgataccatttctttttaagggggaagaaatccagaaaagcttcttctgtggaaaaagcaggaagtgttaaaaccagccagacatacatatagaaatcaaaatctctgccatatcatctgcccttcttaatttcctttcacttgcccaaactatagtagagatagtgtacttacccacagttggacatatgatgttattcctaatagacttaaaaagtgaactcatggcggggcgcggtggctcacgcctgtaatcccagcactttgggaggccggggcgggtggatcacgaggtcaggagatcgagaccatcctggctaacatggtgaaaccctgtctctactaaaaaaaaaaaaaaaaaaaaaaagcaaaaattagccgggcgtggtggcgggcgcttgtagtgccaggtactctggaggctgaggcaggagaatggcgtgaatccgggaggaggagcttgcagtgagccgagattgcgccactgcactccagcttgggcaacagagcgagactccgtgaactcatgagcaaggtttagtacaaaggaaacatactaatatctgtaattctgaatattagcagaagagatttttattccttgctgagctcctgaactcacatcaggaggggtcctttgttcttttcatagaaagaattcctgttggaagcactggatatcgtatttctcaaaatatggaatttccttcatttatttctagcctttgaagttttgtgatttctaaagcatttaaaaggttttgtaatgttgagaacctaaaacgtgattcttttctctgtgcccatctcataccattgtatgtgtgtcatatgatggatctggtttctttttcttatttgttgggagatgtccagagactcaaggatctatcctttgaccaaatttttcactcttcaagggcctcatactgctctgatttcagatgtatagatatattgcttatcaaacactgatgggtctgaacatgagtggtagtaagatatttccagattaagtagacaaattgtgcagaactttttagtatcactatttaaatgactaaatttttgaggtttatgtgtatccagcccaatatgtcctctccttatctagtataatttatctttaaaaattagactggcttggcatatgtcagattttgtatttaacagactttttatatatttctttgttaggaggtgttcaatgttagacaaagtgaacagattactttggaatccatgtcctggtcctgctgaataacatgtcctcaccctccttccatttttttttttttctgccatacacattccagtaacactgaaagagttaattgatgtgtcccatctttattgcttttgtaaatagctatagatacactttatatgtagataatggtatgttttaaaattctgcaaaaatagcttttcaattctctttattctctttctcaagctttgataaaatatttttcattcaacttttagggactgattttctccatagagttcctgatgtggtgctactggagtgatgctgagaaaacattattctaaatgttttttagaaacattttttagaaaacatcattcacccagaatctgaaattttatctttatttatttattcctttggataaaacattgccctcacaggctattcttttctaaaatgtttgctgtgctgttattattcactttaatggaaattaatttatctgctgacctcctttttgacagtttaggactgtattaagttttcagatctgctcggtgagaaatagtgaaataaaactagttaacatctatggaatacctaactatgggccagcactgctgtaagcatgtctcatgccttaatttatcaaaggtagatgctattaatctcatttaacagaagagaaaactgaaatgcaaaatgttaagtaactttccaaaagtaaaacaaccagtgaactggtagagaccaagatttggacctaggtagttctactttgtggcccattcacctacccatggcagcgtgtgacctcaaccctgaaagagtacaaattagtaagtaaagggcttcctttagtgacatacttcagaggtgattttatttcccttttttgtgagatttcctatgaaaagattaacaatttaaacaatatttgccatttagattcagcactatgtcctgatatatcagaagagtctatgaactttttttttttaaagactccttggagatagcaatgaatgaattcttaactgtgtcaggcatgcctgaattttttgagtcatataagagtttgtagcactcctagaattgttaacttaattggtaagaatgtgctttttttctctttgttgttgtatgaagtgttaaaccaaaaataatcaaggcccagggcttttcctggtccattaatggatatatgacaagtgatggcaaaaggatagttacagttattaacttaatcattaattggctcagggtatccccaaaaccgcagttggaactgaagtgctacaaaaatgaccattttgttgttatagcttttcttcacataaggaaataaataagcaaaaagagggagtgtcttatctatttgttgatcaaagatcttgtaattctgcttatggtaactcccagagtagagaatatcatccagttggccccctttatgaacttggattgcaatggaagtcctatcggccagtttactagttaacaggagctgtagtactagagctatgactgcatcagaagtccagcagtgtgggcacaaagcagcgcagcacttttgaagttagacatcgagagtttgagtcctagattcacaccttgctggctgagtgctgttgcaatagtgctgttgagtgagttatttaacttctttaaacctgatcatcctcacctttaagagaatgaaaatagtagtgcctttttaaggattaaatggaattaagtatttaatttgtattcagaagaggatggaatcatcattcaaagactttacaatcagtggtgttttcagcatggacaactggagctttaacttaaaagatctagaaactgggcttgttggccacagttttagtgtgattagaggtggtcatagggtagtcaaagttgccactatcctggttatggatggtaatagaactgcctatttatttgatgtcttcacttagttgtctcctaggtccttcacagcgaacatttgccaggattgaacataggtactctgcatttcctcaactcttttcccatcagcttttcccaactcagaaaatggtaccatcattcaccccttgaatcaaatttgacatctagaagttactattaacttctctctttccttcacctcccagattgaaataatcagcatgtctgtcatccacaccaccagagtttattccataaatatccacatctttttgtccctattgccttctagaccacagcactctttttttgcctatgcaacttcagcagcctcccagctgctctcccttcttttctcttttccattttacaatcaattttccatgcaataggcaaagtgaactctgaaaatagtaaatcagattagatctttcctctgcttaaaacctttcaatgcatttctattataagaataaattctaaattcattagattttaagtctattcatgacagctcttgtatttttctctgatttcaaattattctctttttctgttatttaccagcaacagtaaagactttttttccgtctcaaggcctttgtccttgctgttcctctgtccagagcattgttccattagatccctgatggctgtctccttctcaatattccaatctcatgtcaaatgtcacctcttacagaggcctttccagaggaccactttaaattagcttctgtcaggcactcatctccctgttgtaatttctttgaacaattaaatgtttatcttgaatacccttgtttatttacttttcttctttgttgtttgtctccccagactgttggaatataaattttgttataaaatggccttcatctccagagctgaggagatacataaatattttttattttgaattaacacatggctgtgttcaggctcttctgaatgtaattccatggaggaggtcaaaattggattcctgtatgtagtgaatctgtcccgtttatgattttcagttatataattagttagaagaccaatccaatcatatttcagataaacctcaagagcaattgctatggcagagaactagaagggtatttaatcaactagttccttttccaagatctttagctctttaacagttataaattaataaagtatgttatataatgctaggactttttgtctttcattgtttctgttgctttatctccagcttctagtctgacatatggtaggcactcaaaaattggatgaagaagcagctctttttggacagaccaagagtgttgccttttaaaacattttatgtgtactttttccccctgatccttttatagtatgaatgaatgtttgtataagacataaatttctacaaatactgaaacacagtatggacagatatgagttattattattaatatcacctagataatagataaaatattttagaaagtgaggctaccttaaattatcttgcttcttgagttttttttttcccctctaaggatattccagtaagagttgagcagtatttaagctttggataaggaatgcatatttcttggcttagtcagaacttttctggatggaaggtctttttggatgagaattatactacataagattaaaatgcccatttaagatgtaaattatagggataaaatatagataactcacatggggtgatttgattggcatctgttttcatttttctttgtttctttttagataccaccaaagtccttcctatttcaggcaaaaagatatgttttaaaaaccactcacaaggcctctacaatatgtcagataatgcatgtgcgtgaatgtccttggatgtgtatggtctcttgcttgaagttatcagccagcaaaatggtgaaatacttagaattaatcaaacatctggaggtcaagaaacgcagtacctatattcttctccttactttaagaatgaaactaataaaaaataaggcggagctggcccttcagcaaaggagggatttttattatatgagtgaatttgagagaaagggggacaagaaaagacctttgagatcagggcccaggtctgttttgttactactgtatccttactgcatagcacagtgcctggcacctagcatggtcacagtaaagattgaatgatagaaaaatagaaaaggaagagctaacttttaggaaggaacacttacttcccacttacagttattgaaaaaactatgaagatggttaacatcatgatactgtcggatgtaggcagttacaatttctactcaacgatagaaaaaagaactaaagagaatttaccaggacatgaaagaaaggtgtaagatcatggattcctgaaacaggatgttccaattaaatatttaaatttaagtgaggattgtaggagtttaacagctatttaaaatacgccctgctgctttccttcctaggttctccacaccttcaaagctcatcacttggataagattgcctctttactttttccaaatcaatctggttcatccattttttgcaaaaatgaaaactcccctctttcactaaggtatttgagccatcaagaacaccctcctgtctaggcatggtggctcacagctataatcccagctctttggaaggccaaggcaggaggatggcttgaggccaggagttcaagaccagcttaggcaaaatagtgagatccctgcctctacaaaaataaaatgaaaaaattagctgcgtgtggtggcacatgccagtggtcccagctactcaggaggctgagatgggaagattacttgaacccgggaggtcgaggctgcagtgacccatgatcacaccactgcactttagcctgggcaacagagcaagaccttatctaggaacaataaaaaattcattattcattatttgatccaaaacaaaaacatgttatagactatctatagattcaattttcaaaaatcctatgcttctcatctctaaatattgttataatactgcaattttcaaattagctttcacctttaagaaatgctactttccatattggaatgaataattaatatagaaccaaaatgcatgtctgggatttagaaaatcttgggattctgtttccatccttgcttattttttattaagctaagtcattcattttaagaaatgatcccctttaccccaactatagaggtatatactaccttatatactaccatacttaaaaggttagtgaagaggcatagaaagagtagtgaaacagtgaaaccttctagatgccagatgctatacaaatgtgaagcatatgacaccagcatggtgaaaaaggaagctaattaagaccatcagatagtatttgattttatctctccatagaaatcatgataactatgttacatagttactgaaatttagacattaagtttgtggaatctctctgacagttatattagctaatcactaaacagaaattttaaaagaagtatttaatattaattctcaagtcttaggagaatatttagctaataattctacagttgactgcagagtttattcattatttaattcataatgtcttttcaatcactttactgtttcttgattcatgaagaatacatgccaagtgtattagtctgttctcacactgctgtaaagaactggccaagactgggcaatttacaaagaggtttaattgactcagttccacctggctggggaggcctcaggaaacttacaatcatgacagaagggaaagcaaacacattcttcttcatgatgtcaggaaggagaagtgcagagcgaagtgggggaaaagccccttataaaaccatcagacctcatgagactactcactatcctgagaacagcatgggggaatcactctcatgatctaatcaccttccaggaggtccctcccccaacacatggggattacaatttggattacaattcaagatgagattttgtgaggacactgagccagaccatatcactaagagaataaaaatggacacagaatgccactttcctattccctttaaatatttccagttgaaagtatttccatgacctagtgagttcttagagaattcaatcactattgatgtcccaactggtataataaaagaagaaaacacataattttgagacaaattccacctttctcacactctcagcatataaacacataatcgaagcaagaaaaatgagaaaaaatcaaatatataatatgatgaagaattttacactattcattatgacatgtggggccaaagtgacaaaagtaattggacaaaggtagactcagcaatgaggacttggaagaaatgagctttcagtcccattttaaagtagaagagaaggtagggtatcaaaagtagggtgcgctacgcaaagtggagggtgtttttgttgttgttgtttttagagacagggtctccctctgtcacccatctttgcccactgcagccttgaactactgggctcaagtgatcctcctgcctcagtctccctcagtgctgggattacaaatgtgagctacccaacacccaatgttttcttgattgtaaaagaaaattgatggtttctcatgttcaccagagggaaacatccattcattttatcaatgtgtttaaaataattcttactccttctttcactttaaagtgtttaactcatttttgcattctattcataaatatgaccagtcacaacttagaatatgtatactgtattatttcatattaacacacacattttgttcttctataatagatttgtgtatggtttcatatattagagtgttaaatattgaatttattgtaatttacttagtgaaatactgatgttaacatctagtatgtttatttgagggatataggaggcttacagtgaaatcatcctttcaccaagatttctttgtaagacactgttactggaattgtgctttgtgcattacatttcattgacgtaattttaaacttccattctacttcactacaaatggaatttcattatatctgactccacaataagtgggttccagaatcgttgacatttagtagaattacagatcttagtgtctttgtacattctgtattaaaatgcattatgtgtgctttcaattctgttttaaagaaattgccattgatttacatggttgtatggaagagttttgtttaaatgccattgcctgatttcctggtggcttttattttccttctgaaatcatttacaaatatttcttagggtattggctactgttggtttgaaatgagatacaacttatggattataaatatgtttgtgcaaattttctctagcagtaattctaaaacctttgtggacattaagctgtaattgtagctttctcttgcaagcttctttatcctctgctttattattcccttgtaggaaattaagtattttatataataatgcttagaacatctttctcttttaaagagggaaattaagataaagagcttggcaaatataggatctttcctggattgtatgtttctgagatttggtgacagagcgtctgctgtggaggatggggaaggacggatctgggctgaagaagtagacagagacagtggactttggttttaagaggcctgctgctgggatcttctcacccatccctagcagagctcagaagtaggcatccagctgcaggtaattgtgttttgggctcaaaggagcccttagagtgccagacctaaagaggcaactcccgataagagtttcaatagttttatccattctagaaccgccatttccttaagagtctgaggcccagggaccaacgcccaggacatatatacactttgataggaggaacatttcaaattcatccaggtcaagatcactcactaggtcttgtgcacctcctccgcctcttttctgtctggagttagtaaccacctcaaaagacagctttctgactcgtcattataccacctacagtcttacttttagcttggtttgagggtgtcctgttcattacttacagaaacagatttggagtgtgaatgcccttaacaccagttttaataagcatttttaattctacaataatgtgattcagagaatttttttttcctttgtctctatctccctagatagaaatatgtggaggttggatttcctgctgagtttctttatttttttcctttcttttttttttttttttttttaagatggagtctcaccctgttgcccaggctggagtgcaatggcgtgatcttggctcactgcaacctccgcctcccgggttcaagtgattctcctgcctcagcctcctgagtagctgggattacaggcgagcgccaccatgcctggctaatttattcttgtatttttagtagggatggggtttcactatgttggccaggctggtctcgaactcatgaccttgtgatctgcctgccttggcctcccaaagttctgggattacaggtgtgaaccacagtgcccagccttcctgctgagtttcttagcattattgccaggtcggaacttaggcatagtaacatgaaacatgttctgcatctgaaggccagaatataataagcattgttaatttagttaaaggaaaaggctgctgttgaaggttagacttcttgtgtatgtgtgggagataacagaataacgtctcttttccaagatgcatatggttttcttttgcttatgtgccaattttaatcaatggagaaattaatatgttaaatgaaataattaaccattttataattttagtcggatattggttgaccagtacttatatgatggtataaagttctagaaactggataactttaaaaatctttccatataatgcattatattctgggtcatagtttcctatattataactgctaaacaacataaaccaattttattttcaaaatcaatctttggggtaacttctacttagagccctgacctaataaatgatgtacgtgtttatttctgacacgtattttgataatcatttagattagtcttatttatgtggatatgtgtaataaaatttctttggaaaatatggtttattgagtttaaacctcttacctccatttcactttcctaaattttaactatttttttctgttccattgcaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaaggtataatttcttttttgtttgtttttttcgtttttttattttttatttttatttttttcttttattattatactttaagttttagggtacatgtgcacattgtgcaggttagttacatatgtatacatgtgccatgctggtgcgctgcacccactaactcgtcatctagcattaggtatatctcccaatgctatccctccccactccccccaccccacaacagtccccagagtgtgatgttccccttcctgtgtccatgtgatctcattgttcaattcccacctatgattgagaacatgcggtgtttggttttttattcttgtgatagtttgctgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtccattttggcttttgttgccattgcttttggtgttttagacatgaagtccttacccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagtttccccagcaccatttattaaatagggaatcctttccccattgcttgtttttctcaggtttgtcaaagatcagatagttgtagatatgcagtgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctgtttgtctgttgttggtgtataagaatgcttgtgatttttgcacattgattttgtatcctgagactttgctgaagttgcttatcagcttaaggagattttggactgagacaatggggttttctagatatacaatcatgtcgtctgcaaagagggacaatttgacttcctcttttcctaattgaataccctttatttccttctcctgcctaattgccctggccagaacttccaacactatattgaataggagtggtgagagagggcatccctgtcttgtgccagttttcaaagggaatgcttccagtttttgccaattcagtatgatattcgctgtgggtttgtcatagatagctcttattattttgaaatatgtcccatcaatacctaatttattgagagtttttagcatgaagtgtggttgaattttgtcaacggccttttctgcatctattgagataatcatgtggtttttgtctttggccctgtttatatgctggattacatttactgatttgcgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgtcacaatttcagatcctgttatttgtctattcagagattcaacttcttcctggtttagtcttgggagagtgtatgtgtcgaggaatttatccatttcttctagattttctagtttatttgcgtagaggtgtttatagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctgtctcttgtgggcatttagtgctataaatttccctctacacactgctttgaatgtgtcccagagattctggtatgttgtgtctttgttcttgtcggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctatcaggtccgcttggtgcagagctgagttcaattcctgggtatccttgttgactttctgtctcgttgatctgtctagtgttgacagtggggtattaaagtctcccattattaatgtgtgggagtctaagtctctttgtaggtcactcaggacttgctttatgaatctgggtgctcctgtgttgggtgcgtatatatttaggttagttagctcttcttgttgaattgatccctttaccattatgtaatggccttctttgtctcttttgatctttgttggtttaaaatctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagtctcgatggtctttacattttggcatgattttgcagtggcttgtactggttgttcctttccatgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccgagagatctgctgttagtctgatgggcttcccttccagggtaacccgtgctttctctctggctgcccttaacattttttccttcatttcaactttggtgaatctgacaattatgtgtcttggagttgcttttctcgagaagtatctttgtggccttctctgtatttcctgaatctgaacgttggcctgccttgctagattggggaagttctcctggataatatcctgcagagtgttttccaacttggtttcattctccccgtcactttcaggtacaccaatcagacgtggatttggtcttttcacatagtcccatatttcttggaggctttgctcatttctttttattcttttttctctaaacttcccttcttgcttcatttcattcatttcgtcttccattgctgataccctttcttccagttgatcgcatcggctcctgaggcttctgcattcttcacgtagttctcgagccttggttttcagctccatcagctcctttaagcatttctctgtattggttattctagttatacattcttctaaatttttttcaaagttttcaacttctttgcctttggtttgaatgtcctcccgtagctcagagtaatttgatcatctgaagccttcttctctcagctcgtcaaagtcgttctccgtctagcttcgttctgttgttggtgaggaactgcgttcctttggaggaggagaggcgctctgctttttagagtttccagtttttctgttctgttttttccccatctttgtggttttatctacttttggtctttgatgatggtgatgtacagatgggttcttggtgtggatgtcctttctgtttattagttttccttctaacagacaggaccctcaactgcaggtctgttggagtaccctgccatgtgaggtgtcagtgtgcccctgctggggggtgcctcccagttaggctgctcgggggtcaggggtcagggacccacttgaggaggcagtctgcccgttcttagatctccagctgcgtactgggagaaccactgctctcttcaaagctgtcagacagggacatttaagtctgcagaggttactgctgtctttttgtttgtctgtgccctgcccccagaggtggagcctacaaaggcaggcaggcctccttgagctgtggtgggctacacccagttcgagcttcccggctgctttgtttacctaatcaagcctgggcaatggcagacgcccctcccccagcctcgctgccgccttgcagtttgatctcagactgctgtgctagcaatcagtgagactccgtgggcgtagtaccttcccagccaggtgcaggatataatctcgtggttcgccgttttttaagcccgtcggaaaggcgcagtattcgggtgggagtgaccagattttccaggtgccgcccatcacccctttctttgactaggaaagggaactccctgaccccttgcgcttcccgagtgaggcaatgcctcaccctgcttcggctcacgcacggtgcgcgcacccactgacctgcgcccactgtctggcattccttagtgagatgaacccggtacctcagatggaaaagcagaaatcacctgtcttctgcgtcgctcacgctgggagctgtagaccggagctgttcctattcggccatcttggctcctcccctaaaggtataatttctataaaataaagtttttttacacataagaaatgtatgtgacatttgacaaatatatatatacccatataaccgtcagcccaacaacaacaaaaaatagaacatttctcctttcccagaaggccctcactgtttttttgctgtcttcttccacagccctgaaactcttatctgattagtttcatctgtcttagaatttcctttatatgaaacaccaactaagtacttttttctgtctgccttctttcacccagtctactgtctgtaaaaatcattcatgtttttgcatccatcaatattttgctccttttaatcgctaacattttccgttgaatgaatgtacctccatttttattttattggcctgttgatgacattaagactgtttccagtttttaattatcatgaataaagttgctatatacaagtcatgtacaagcttttttatggacatatgttttcatttgtcatgtttatctgggagtaaaattcctgggttgcatggaaaaaatgttcgtttaattttataatagacaaattgttttctaaatgaaggcatgatcttagtctagtaatgtttatttacttctatcaacatatgtgtttggtaagttaattttttggataatgaatgataccgtaatggatatttttttctcactacttcttcctttctccctctttttacacaattaaaaaactaaagataaaagttggctctatagggaaaggttttattttttacatttctggcaaatttgagatttctataaaattcttcataggtatataaaacagagtaagtatattttgtttaacttttaaagcagggtattattcatttgttagttgtttaaaatctactataattatgggtaaggcagtgatacaaaaggaagaaaagaaaaatcccaatttattcattaaataagaatgtgtcaatgcattttgaatgagaagtcattttaaactccaaatacaaagatgagcaagacgattttttaacctcaggaatggcatagtagggaaaaaagtaagtgtatgtatatcattagattcatacagtcaggctgaatgtggaaagggctttaagaaagttattaaaattgtttttacattctggggaagtagaaacatttccatctaacaggaacagggcagtttcacagaggagttggaatttggactgagttttgaacagaagagaatttcgatgggcagatcaggaaaagagcagttcaggaggagggaatggtgggctgtggagcatgggcgaccagaaaggcagattaagttaaaacagggttgacaaattgggagaacacaggattaagggactggaatttaagtttagatttgctttaataaagaaaaatgttactttgtgatgagagaaaataagctaaaaattaaaaatttaaaaaccaatccactctgagagattaattaaagtgaagatggggtctgctaatgtgttactgaagtgaactgcagagtacagtcactggcattgatgagtctagatgctgtgagaaagatcattagcgcattgacaattctaagtagctggagaccttttaaactttcaacttccatatttttagtaatttttcaaatgtgattaatttagcccatgaaaacacaccccatcattgatataaccaatcattataattatttattcgactggtgtactttgtctctaaatgacacatttctatgaaaaaaagatcagtttcactaactcctcaggcttctggctgtgacttttcataaatgtctgtatgaacgtaagctataactttgcttcattgttgtttagatgacattaataattggttttacttactgactatgggcattttaatacaagattccattttaaaagtgtgtacttgtagcttattgcaacacagtgaccaaagacaccatattcttacttctggaatcaatttgtgggcattgttaacagtatcttcacaactgcactagtcaagcaatcagagctaagctttcaaagcagattagaggaagcttattagcaataaaatatagtcaaaatataccaggcataatcatatttttatgtagtggaattacctcagcacatggagaatctaaattaaatgagtttataattgaggtttgtgtgcaagggaaaagaaaattcgtctgttatggaaacgctctatattttttacattatagccaaagtcttagttaccttttgagggtatctgtaggtgccattaaattcagctatcctcttctgctgtgggtataagcacatggcaaacccaggcaaaaattagaaaaataaaaaggattgtagagaaatggagatataaaaaattaataagagaagaggcaagctaactcccttatccatttttttcctcaaggttattaacagaaattatttccaacataaatgtccataaataattttgaaaatctagaaagaaattgcatttctactttaaaaatagctttctatggctgaaggtttgcttcagttgttttactgtcacaactcccaaaaaccagctggttctgggatgtcgtaacaatttgatacttcaaaccaatggtttgtgctcattggctccctggtgcaaacagggagataaatgctacttaaatagtaggtgaatgtaattttgcactttagaaaatgtctgcatgtttattagagaagtgaatgctgaaatcagcgaacaaaatgtaaagtgagcaactaagaaatacttataagggctcacttgtattatttaactgtgtaatcctctatctcatatatatgtaatactttcttcaagttcattatagctcccgggcccagtacatcctagtccagttccaaccatgtctaattttaaaatagctatgctcacttcaaacgaagatgttgctatagctttattttattttataggcttcaattttaaagttgtatcacctatagataacaaagacagctttcatggacacctcaatttagaagagtcttataggcactttgtgagataaactgtaagtgtatgtgctaatcagataattcttttactagagactttaggtgaagatagcaaatcttctaaaacagactgataattaaactgggttgatcattattgggttcattattatcaaattgaaatatgctttattttgtaatgtttaaaatgtgttcttaaattcagtagaatattaatattatattatacttttccatttttaaatcatattaaaaatagcaaaaatattacttcttcaaaaatgctttatacttcatgtatattactgattttaagtaaaagtacaattaagacaattagccagacctatttatgagtagctctaattggagcagcttgttgctggaccctattcagtggtagagataaggttgagatggctgaatagttcatctaatttgaaatactttggtgtcacatggaccttttcctgaataccatggctatgtactcactatttggccaaatgctgaaaatgaacatatatttgcctccgtcaaaatgttttgtaaatgttcactcagacattgacataaacaaggcagaaaggttaatggataaaaaattctttttctttaaaaaaatacatacacatacgaattttctctcttttagttgctaacctgctttttagattagtccatggttatcttggaagaggtgtgggagaacaaggtgagagctaaggaaggaattctatgcaaagcgtttctgattctcttagtattttgtggaacagcatgagacatgtcttccagttgtgtaggataagtacagcccactgaacactgcttaccagcagtttaccacaagccagttataacatcaaaaacatcggaaccctttcttttcttctatatttgaataatgataaatgccttcatgctgtgtgagcactattgaagtgtgtttctctgcaggtaaacttggcagtgtcttatataactacactcgatgggagtattacttaaacagtgtgaaatacattgtctgataaaaattgtatcacaatttggaatgacgtttatgcaagtggatagtctgccagttattttatagtctaaaaaaatgaacctgtaaggctacagtataaaatccaagtctttatagttgtatatttgtagtgaaaacaaccgtgggggaataatataagcttaatcatttggtgattagtctaccaactattaatgatgagagataacctatctgttctttatttctaaaataagatgtgtaatacagctaattagtcactattttaaaaggaatttaaatatagttttcattgaaattcaaatatttaattgcatgtgtacctaatgcctaattatttacatgttggctgatgttctctattatctaactgctgtgctgttcttaattgctgctagttcatctccgcccatctcccttggtgatgatagtcctgcatttcatggcaattttcaatagcagtttaatggtcttaagtgggtagcataatagccaggtgaacaacaaaaaaaacaaaaacaaaaacaaaaaaactatttggcaaattgggatatgagaattgaggccaaaacttttagtccttgccaattttttttaaaacttcaattatcttgattcatattcccatttgttgggttggtaggcactccaaaataaatataataatcagagagaacaccaactgtaggtactagttttagcaactgaaacaactggcgttaaaatcactgagcttctgttacatgaatacctgagtattatgtggctacttctgaaatggagtatgcagtgctcttataattgggcatttcagttgaacactgcttcagtaaagtaactggcatttcaagtcttccttctgtagtgattgctttgtctttattcaatgattgcttttttaagttagaatctggttgcatagtgctccatggttctttcctatgcagtggtgtttctcagtgttgatgtggagaagccaggagacatcctacaactctgagaagcatttgatgttggcagcagtggctgtgaggttagcccatgaacttagggctagaggtgagtcttaaccttccaattcagcatcttttccatctgaacattcaagtcaaatgggaaacctgttggccctccagctggatctttccactgttttaactggaatgaattggataagttataaggcagatggtaagattggatctgatgggatggagtttggtgaagtggaaacttttaagcattaggtttgagatagctagggagtgttgacctctctttccccctgacattatcctcacatttgtttttattccaccatatctaccttgatccacctgattcttttcatttttttctttcattctctttgtgctggctttctttccttttttaaaatcccatggtatctcatcatctcttcttgtcctcccattctacaaatagaacatgaaattgaagccttttttaaaaaaaaaaaaaactaattacagaattaatatatgtttactatgtacttactacaattagaaactatatataaacaaaaaagagagcttgcccatcaatccacatgcaaaattggttgagtaccttgaagatttgtaatagtatatagagaagaacattatttttcttaactatttaaaagtgtattctgcattctcaattaaaagtcattttatcttttactttttcttttattcctttttaagcaacaaatgaattaaatttcctttgttttatatatgacctattaacctcaatggagaaagaggctccctttgtttgcttcaggacttacatattgttacagttagtccttaggtaaatgaaatgagaagagcttcacatcagcactagttcttccccatggaattttagtttctccacaaccactttactgaatgtgtataattataagaattatttcattttcttacaactttttctctttattttatactctcaccctattatctgtcctttttcttttttttttctttctttctttctttctttctttctttttttttttttttttgagacaggctcttactccgttgcccaggctgaagtgcagtggcaggatcatggcttattgtgcccttgacatctcagtttcaagtgatactcccacttcagcctcttcactagctgggactacaggctcttgccaccccacctggctaatttttctattttttttgtaaagatggtactttgccatgttgctcagactgaactcctgggctcaaacaatcctccccacctcggcctcccatagtgctaggattataggcatgagccactgcacctggcttttatattcttaatatttcttgtttcttctatttattttctttactttaaactcgttgttataaagtggtatgggttaatcaagagtgatggaaagattagctctgtttttctgtgtgtgagtgaaagatttagaagtaagaaaatataattattcttcttcccaaagtaatgatgtttaccaaaacactggtaacattactttaaatttcctaaatttataattcaatttagtaaagtaggacttctgaaatggatttttagatatattggggaaaaacaattcaggatctaaggtaaactttttaggatgtatatatatttgcatgccattcatggttgtgtttatctgaaaacctaatacatttttatcataaaaatctacataattctaaatcatctcaagtgaaattagaattaatataaagaaataaacaaatattggaagttaaaattttcagatttattaggtgttaaactgaatttttcgtcttctactcctatcctcccgtaaacactatctagaaaattgtcacccaacctattgtagaactaaaaacctagtggtcttcctcatcttcattgtcttcattatttccactacacgaaacattcccttgtaacaaatataatattcacagcattgtgcaaaaaatgtacattttaaatttctagtataaaatttgatttgtgactctgagcccccagtttccttagggcaaacaatatgggtgctttcagttaattttagtccaatccagtaatttttcagttacttttccatttaaaacaagtagttcgaggttcagccttctgatcattttcctgatatggaatctgggagcagcagggaacataagtaatgtcacggtgtcaggattgggaggtgtgcattttggatcctgattaaatgtatcaacgtaggtaatatattgtgattgtttcaaatagtggagatcaggaatccttcctggtacaaattcagttccccacagtaacctcaaaattgacttcaaacctactgacttcaaatctgactcatgatgtttctcctctcccatcacttttcactgtgttctgctgatctccatactgtttcctcaatgatgggcccaaaaaatgctggaagttttcttctatttctctctttgagaatcatgaggcactcattgggattgtggttcttggattgtttccctctttgtatgtatttatgtatgagccatatacaatcaactgttctctcaatatcaagaggtagcaattttaaatgttctgtgttttaaactttaatgtataacttacgtcagtcaatcctgataataccactattctcactagtcatcaacatcattatcatcattgtcatcatcatgtaacaattatataatggttaatattggccacaaatcaatcctagttccttaaaatctattagttgagccttatgaaactgccctttttgtcggttcaaatggtgagtagaagcaatttcatatggttcaacttattattacttcaatttccttacaggcttacagccaacacagtgattcaggccaccatcatctcacaactagaaatcatcactgtggccttctaatggatattcttgcttgcaatttagccctcccccatttgtttgttgtacttcagctaggttaagctttataaaacacaatagtattgagctattcctctctctaaaatgctgtcatggcatctgattgaccttagtataaaatccaagctctgttaatgtgatttataagtcatgtagccgtacatcccagttagtctctgacagccctggtttacaactgctgccccagcctaattaatagtggtgttccctttattctcagaagtggactggtttagatgatgaattacatgaccaccttatttataatgtacctcatgctctgccctgtgcagttctctccagcctcatctctcaccactttttaaatcataaaaatgagctgtatccattctgaattcctttggatttatggaatatatcactgtctctttcagttcaaagcctgtgcccataatgttgtcactgcctaaaatatctctctgttaacctgactaatgcataccaattttcatgctcatttttcttttcttttttttttttttgacggagtcctgctctgtcacccaggctggagtgcagtgctgcgatctcagctcactgcaacctccacctcccgggttcaagcgattctccttcctcagcctctagagtagctgggactacaggcgtgtgccaccacgcccagctaatttttgtatttttagtagagacaggatttcaccatgttggccatgttggtctcgatctctcgacctcgcaattcgcccgcctcaggctcccaaagtgctgggattacaggcgtgagccaccgtgccggtccctcatgctccatttttatagtttctccaagaagcactttctgacctctagactagtttgaattttcctatttctgtacccatattggctctattcttcccctaatcaaacccttttcccaattaaccatgtttatatcctagtttatgtgcttccttttagcatgtaccattgtttctctagggccttataagtatttgttatacagacattacatatatatatatattatatatacatgtgtgtatatatatgcatatatatgcacacatgtatatgagagtatgtgtgtgcacatgttgaacaaattcatgagacaaaatacaactttaggttgcttttggactttgacatctgctcttgactttttatgttgagaaagggatgttgagagtatgaagcactatagcaagggagaagaaaagaaagagagaccagaaaagggctgattattgaatatcaagaaaggaacacatagaaaacaagtaagaggctttgaactgacaatttggatggacaactacattccatttctgatcatcgatcctgtctttgcactattgcttgcacttatcttagcaggggcacttaaaaagcctgaaacgcgtatcttgcctgcaatgtacaaacttatcagaacatctcatatagtaacataattttcagtataagtatagataggaattacgtttaaatttgagtaagtattggactaagattatctctccttttttaaaagttggtaagttatgttaaacaaaaacaaaacaatttctaaaatgatgactaaaagtaagggttgtttaaatccattttataagatttacttccagaagatgaaagtgggaagctgaagtggcatatcatttctaagctatttttgtaggttgaattgcatccttcaaaaagaaatgttgaagtcttaaccccaggtaactatgaatgtgaccttatttgcaaatagggtctttgcaaatataattaagttaaggtgatgtcatactggtttagggtggaccctgatccaatatgactggtatcatagaagaggggaggagatacagaaatacagggagaaagctgtgtaaagatggaggcagagatgggagtggtgcatccacaagccaagcaatgccaaggaaagaagcatggacattttttcttactgtgtctagaaggaaccaactaggctgacattttggtttcagagttacagcctcctgaactgtgaaatgaatgtctgttttttttttttttttattattattatactttaagttttagggtacatgtgcacaatgtgccgattagttacatatgtatacatgtgtcatgcttgtgcgctgcacccactaactcgtcatctagcattaggtatatctcccaatgctatcccttccccctccccccaccccacaacagtccccagagtgtgatgttccccttcctgtgtccatgtgttctcattgttcaattcccacctatgagtgagaatatgcggtgtttggttttttgtccttgtgatagtttactgagaatgatgatttccagtttcatccatggccctacaaagcacatgaactcatcattttttatggctgcatagtattccatggtgtatatgtgccacattttcttaatctagtctatctttgttggacatttgggttggttccaagtctttgctattgtgaaaaatgccacaataaacatacctgtgtatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcccctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttgttgatggggttgtttgtttttttcttgtaaatttgtttgagttcattgtagattctggatattagccctttgtcagatgagcaggttgcgaaaattttctcccattttgtcggttgcctgttcactctgctggtagtttcttttgctgtgcagaagctctttagtttaattagatcccatttgtccattttggcttttgttgccattgcttttggtgttttagacatgaagtctttgcccatgcctatgtcctgaatggtaatgcctaggttttcttctagtgtttttatggttttaggtctaacgtttaattctttaatccatcttgaattgatttttgtataaggtgtaaggaagggatccagtttcagctttctacatatggctagccagttttcccagcaccatttattaaatagggaatcctttccgcattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaactctgtgaagaaagtcattggtagcttgatgggaatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttagaatgtctgttgttttaagccacctagtttgtggtcatttattatggcagtcctagaaaactaagatacctaaattaggaaacaaatataactatattaaaaggggatagtatatccaatatatttaatacagaaaggatgaagatatagatagtagaatgatcagaggaataataatttttttcccactgttctcaatatcactgctaattcctataagaacacaattactcaatcactaatctgctgtagtagtctgattgatgctaagccatgctgcaggaatgaataaacccccaaatcttaaaatcttagcattatagaggtttatttctcaatgatgcaatgacaaatacaggtccatctggtgactcagggtcccagttgtcctccgcttatgatgtttccaactcaggaaatgccttttatggttgctatggcagaggaagagaggagtggggagctggcacctaggtcttcagtgcttcagctaggaagtcatagtcatgactctgctccacatttttacaatctaagaatagtcagatgcccctcttaactgcaaggggctgagaagtgtagggaacacaagaatattttttgagagctactatctctgcttacatataatggcagaagaaatatcctcctaaatctattaaaatcatactatgctctcaaagattctagctgctcccttaatttgatattttatccctgctataatttttacaagcttcttttcatatatatatacacacacacacatatgtatttatgtgtgatgtatgtatacatagctattacccaagtctttccattaacatggtgttatatttgtccttaccagaactactgactgctaacaacataaaactcttttccatccaaaatcattcctatttaaacatttattagtgttcaattctaataccattcaactgctcataaaggagaaagaggaagagaaggaagaggaggagaaattttccaggtaagtttatagagtaaaggaaacaacctgccattttgattgttttgagtatcaattaaattatcagttaataattcaagaaaatatatcccaggaaaaaaaaaatcccctgtataataaactaaagcttttttaacatccttcttaatccctcatatgaaaaatttatactcccctcttagatattaataaaagctcaatgtacaggtagctagggtgccccccgtcttccctgctggatttgtaggtcctgctcatgcagaggggttatttcccagcatgtggatgctctatttgactccactgtaggccaaccaccccttctcatcaatcatgttgcaattattttttacacaattacgtcttcttttagagaagagaattatttaaccagaaataacatcaacaagccttttacagaatatacatgcttaagtttcacaccatattgttgagatattttaagtgtttaaaaaatagtatgtgaatatatttcggttgtaaaaaattcaaaggaagctttatacccattaggatggctgccataattttaaaaatggaaggtagaaattggtgaggatgtgaaggaattagaagccttatgcattgttgatgggaatataaaatggtgtgacaatcatggaaaacagtatggagggtcctcaaaacattacaaatagaattacaataggatccaacaattccacttctgggaatatgccccaaataattaaaagcagggtcctgaaaagatatttatacatctctgtcatagtagcattatttacaatggccaaaaggtgggagaaacctggctgttgacagacgaatagataaataaaatgttgtgcatgtatacgatggaacattattccgtctgtaaaagagaggaaattctgacacatgctaccatatgaatggaccttgaggacattctgctaagtgaaatataccagtcacaaaaagacaaatgctgttatgattctacttacctagagtagtcagaatcatagagacagaaagtataatggtgattactagcggctgcagggagagaggaatagggagttattatttaatgagtaccgagtttcagttttgcaagatgaaaagcattctggatgtgaatggtgttgatggttgcacaacaatgtgaaggtactaatactactgaactgtatacttaaaaatggttacaatgatgaattttatgttatgtgtattttacaatactttaaaataattcaaaagtaacatcctcactcccagtgctctatacagagaaaaccaatgtctttattctttagttctgcgtttacatagacacaaattctcacatagcaatatatggtttattctttgattcatttttttttcacataaatgctatcttaatgcatatcttgttctgcatgttcaacaatgtctcagtcttgccatgagaaacggagcagggaaacttcctgggcctaaactgaataggccattttattctcttctctgccacattctttgtggttctgtctccactggactgggactctccattggtcctttaccaatgagccattctattctcatgaaatattcatgagaatgtttcaccagatctaggatttctacatattacttctaacatttccatatttctttgcctaaaattttccattctatttgaaagttgtgtgccttttttctttttctttttatcacctacatggggaggtagagtgttggctttcaaaggtgaaattgcatctttccacaactctgagttttctgagttttgagtctgttcttgacttcttttaaaaaaaaactctttggtcatggtggcaatagaggttagagtatgaataccaactcctctcgtttaggcctctgttctttagatatggtcattttaccgcttcaaggatcagaacatatcatatcccaaatttataatccccagaggtaactcagatatgtataattctttaataacaatctgatttgttctcaatatttaaagtgaacccaagatgaagagttggaaaggaaatttttaaaactctaatgctttagtaggctctcaaactgctgacagctcaagtgttctgtctctttggcaacatataaaaatccagaataacagttaaatattccacagctaactattatttaatactaatattatgtcttggttaatggaagacaccatagaccacattttgaatatttgtgctcctttttaatattggtaatcctccttctgagataaattcaggaaatctgacctttctcctcagcccttttgaaataaagaccacttttccaattaggaatatctaatgtagtgttaaagctcagagttgaaaagatgttttagtattcatcagatataacgttgtagtattattggtaacattgtgaaacaaattccagtacacttcagctctgctaacaaagatgaaatagagaataaagtaggtgtatgctgaatcttattaaggttgacatccagtttgaatacattcatcctctaaggtatagttttgggtataaaccatcgagcaagcacaaaacagtgaagctgagagctgcagaacatagagatctggtggattctaaaggactgagaatgatcgatggctactgaaatgaagtgtgaaatggtatccatagctgatatttgtctttaactgataaaatggctaaagcatttcctggtcaacacaccactctccctcctctcttctcattcctctagaacagtggccttcaaactcttttcttgataacaaatgcacttaaattggagaatatctctctttctaacacacacataacaaaaatgtcatgagatgtcttaaatacttagacattttacattcagtgtactccaatatttctattttatattcttttttaaatactggttttgacctattaaatggacttcaagaaatttttcagtctcatctaggcacacagatttaaatattacttctatgttagtgacctcttctgtgagtaagctccgtctctaactttctatctcctttggatatccttattcgcatattccttccagaacgtacaacttaacgtggcttaaacttaacagctaaacattctccctctgaagtatcccattctttccacagtcctcacccacctccatcaagttattttcctcctgtttccaaatttctgctgagggtcccatcagtcttccaggtgtaaaccattagattcctactagatccctatctttcttcccgttactatatcagtgagcaaggtcttgattctatttcgttttttgtcacaattaattattattaatagaaaataaacacttattccagtttcaaagttgttataattgaagttgctaattttaaaaaatgaattttaaataatcacttaataatccttctttgactaagacaatgaaatgtggctttaaaaaaagtaatcagcaccatttgcttataggtctttcagaatttgttcttaaagtttctggaactttcctctctgtaaagtacaggaaatactgagctacactggaaagcctctctgggacaggcaatggggagttaagcagtcatcataaaggaatcaatgtacattcagcatagtgacttggactacacaacaattccttctcctctacggtagctcaagagagacatgcttctaagcacagaggtatgagaagtctcagactgttatttgctgttagaattggtctccccatctaataacagtaaatctctggcacagatgctattggtccttaatgtcctgtgattttaggaaatagtttggatttagtttaatttattcagaaatcaaacatgtttaattaggttcactgctctggcagagtaagggtatgctggtttagtatctttataatatatatataatgagtaggtaaatcatagtcttaaatcatacttagaatactatattatttaaaccaatatctatttcaacaaaatgtttataaataaaaacagctgatgaaactaaatccaaaggtatgacaaagacgactcagctctatgttgcttaaagaactttaaaaagcatgtgcccataaagccgttcaaggagagggaaggaggtccccttctccttattcttacgatagaattcctattggggctgtgccagaaatgagcacttctaagtatttcagagaagtccaaagtgttaaaaagtcttttatgcaaaagaacgtctttctgaatcagtgaatagtaatgctcatcagaattttctaataacacaaaaacaaagccaagtccatacatttgatcagttgtcaaagtaatgggaggtggactattatgtcaaccttagtcagagctcctgctggcttctttgtatacactgttcaccaatttgagtaaagtggactttgtgagagaatagtgtttgatggccaggacctcttttgggcatttcttcctaagtggaatacacaacagataagggagtagaggaggtaatacagggaagctactcattccagctcagaaggagcagaaggagttagatgaagcccatatatgcattcaagaagccaatggtatcctctagctgtggatagtggctaatgtggtcatccagaatccacactgtggaccgcagcagcgttttcccgtacagatccaaaaactctggatagggatttacaggatccaatggccggtagataaaatgaatggggatagttacagaggcaagagctcccacccagcgccttctgagcttcttcctctgattgatgtactgtaagagaccgtcaatggctaagttcccgtcattgatgcggatccctgcccacatgtcccacagctcactctcacagagccaagtacacggcccaaagactggggtgagacctcgagagaatacaaagaagttcatcagtcatgtgaggatgagtgatagcacacctccatctttgagtagcttttggagaaggagtggacggtgagtctcaggaaagatacctccatttgacagacagactctttatggtatgccgaccagatcgattctgcttgtacctgtagagaaactcctgagcgacaattatctccatagtcatgagacttgatcctgcagttctggagccccagatgccgcaaaagcgcttccacgatgctgacctgctcaaatatggaatagtgatgcggtctcggtttgtcactgaagccaacgccaagaaatcaagggcaatcacccgatgaaacctcaaggtcagaccttcccaattcttgtaccaatcgtagctggatattggaaaacgtgtaaaaccacaactgtctcctgacttccaaccacacccacagagtcttggtagaagatacgcagtcccttgtaagtgaaaaacttgcctgaagacttccacgagtgaagatcaggtgacagctgagtgtatgggatgtgcaggtacgcagcaagcaggagcgcggcccacagccccacctggacccaccactccctcatcctgcggaggcgatctttgcgcacggcggcgttatcccacgctgccagcctcggcgttgcagagcacggggcgccgtggcgcccgcagccctgcagggccggccggcagcggggtctcaatcagcagcccacagcccgcacagggcggcgccgcgcccggcagctacagccactctgacgtgcacggcggcactgcgtttgctaggcgcgactgccacaagggaagtgcccgggtgtgctggttgccgtggcctctatttctaaagtatttcttatattttcctatttcttttcattcctactgcttacaccctcattgactgaactattgcaaccgcctcttgaggtgactgaaatattcatagatattgcagttattctccttttgggcatatagtaggattacatttgctcacccctgaaattaggcatagacaccgtcaatgaaatgtgaacagaactgacatgctttactcttagattgaatacgagttttacaagccagtgcataattcgccatgctatagagacagatgatcttccagatggatgcctgagtgtagaatatatagatcagttccccccacccttcacacatgggcccaaaatgtacacggagcaggagcaagaaatacacgtccttgctatctttgttagtttaatccacagagactttggagtctgcagttatacagcatcctagcctgtcctgactgatatgatcccttaactgatttttctactcaaagtctcttctccctccgattattctacatcactatcatattaatctttctgaaatagaactctaattatataaattccttatgaaaatctttgaatatttccctgttatcttcactggctttcaagaccatcacagtgtgcatctcaacttccttttaaaacacccacggtttccctacgtgtacacacacactttctaacacgttcgcttttctgttcctatgattctaagatgctctctgctagtcctgtctaagtgctacctattcttaagtaacagttcaaatgccagtatctctatgaggctttttctggatctctgcaaaaaaaaagggacaagaaacaccttcctcccaaaggaacaaagaatggcaattacttataagtaagccagattttagcaattggaccatttttgtcttaaatataactaacctgtctctatagcttacaaggtattcataaattcttcaaacaaaagaaatttatcataaaggatacaggtaaaagttctgtgaaattgtttaaaaaataactaaataaatgaattcccaaatgattttgagtctttattgtagttcttatcacactttgcagtggccatttctagcacttttcaggcaataaatggtcttctttcacttccatattattgaaaattcttttgcataatgcctagcaaatatcttaatgttgaatatctgaatgaatgaatgaatgaatgaacgaatgaaattaaggttgcattttattttaaaactaccgtttttttcttcagaaatcacaacgaggcaaatgttgccaataaaatagttattaagttaaaaaacataaatatctgagaaatgaactgagaaaaggagaaatccttacaggacatgaatggtacaggagaatagtacatatcaaagggtgaactctgggtcacagcttgtgggatcaggcaagaacatgtctagtcatagtctttcaaataatcttattaaaaattattttttctaagatccacttttactcttttctctgactaattttatttagctttcaagcatttctttgtggcttcagttttgacttcagtttttaaacaatttaaacaaataaaaattacattacagaattgttacttttaaactcttactttccacggggactgttattgtaaaatctgttcttattcttttaatttaactccattattttgttttaaatgtaatgattgttcattatatttttctccaactgctttaaaagcaccaatccttctttgctgtatatgtatcaaagtccataaatattctttgacattatcctagccttgaataataaaaggaaaaaaacctctcacaactttttattctacaaaataatattaaaatatgcccctatttttactgtaaatgtaatcttcacagcaacagtcaagagaacaagactgagtcattcttcatcacacattgcaagggctatgtctcctctgttgtgaggagaatattgccctgcagcaatattctcacaagtggagctctgggtcattgactgcacttttgctaataagaaatcttcagtaggagtgactgggccttgtgcaaatctctccagtagtttcttccactagtgacgcattagagcctcagaatcaatcactcaacaagtgtttactgaaagcttactgatacccagaccttaaactgttaccaaacagaatgccagatatgggatataattccagcctgaagagtttatgctcaagacaagacttacatatattacagagaagcgtaacagagcaaatgattaagttctaagtttcactgtacaccctaaaaaaaaggagaaattgatatggaacatgaatagtataggaaaatggtccttaggaaggccagacatgagagggtgagctctaggtgaccacctgtaggatcaggaaagaacatatctagtcctggagttaagatttctattttttctagatttatagaggtataattgacaattaaaaattgtgtatattctagatatgcatgacgatttaatatacatatacattgtgaaatgattaccacaaccaaattaattaatacgtgtatcacctcacatagttatcactttgtgtgtgcgtgtttgtttatgcatggaggacatttaagatctgtgtttggaaaattccaaataaacagtacaatattattaactatagttactattctgtacattagatccctagaacttattcatcttataactgaaactgtgtaccctttgacccaaacctctcatttaccccaattcctggcaaccaccattcattccaccattctactctctgcttctatgagttcaactttttagattccacatgtgagtgagatcatactgtatttgtttttctatgtgtggcttatctcacctagcacaatgcccttcaggcttatccatgtcattgcaaatagcaggatttccttctcttttatggctgaataatattcctctatctccctctctccctctctttctgtgtgtgtgtgtgtgtgtgtgtgtgtgtgtgtgtctgtgtgtctgtgtatgtgtgtatactatatttactttatccattcattcactgatggatacttaggccatttatttatcttgactgttgtgaatgatgctgctatgaacatgtggatgcagatatctccttgagatactgatatcaccttttaaaatatatagctagaaatgggattgctgggtcatattgtagtactattttcatttttggaagaatctctatgcttaatgctgttttccatagtggctatgcctatttacattcccaccaaaagtgtagaagggtttctttttctctgtttcctcaccaacatgtgttatcttttgtcttttatataatagccatgctaataggtatgaggtgatatctcactgtggttttgatttgtatttccctgatgattaatgatgttgaacactttttaatatacctgttggccatttgtatgtctctttttggaaacatgtctattttttagatatgtttaggtcctttgtccattttgaaattggcttattttgtgttttcttgctattgagttgtatgaattccttatatattttgaatattaactcctgatcatatatatggtttgccaatatattatcccataccacaacttgcctttttattttgttgattgtatcctctgctgtagaagtttttagtttgctgcagttacacttctttgtttttgctttcattgcctgtgcttcgggtgtcgtaccccaaaaatcatgaccaagactgatggcaaggagccttttctttatatttattttagaagctttatggtttcaggtcatacatttcagtcttgaatccattttcagttgatttttgtatatggaataagataaacatccaaaatcattcttttgcatgtggatatctagtttccccaatacagtttattgaaaagactatttgttccccattgtgtagttttaatggcctagtcaaagattagttggccatatatttgtgggtttatttctgggctattccgtttcattggtctatatgtctgtttttatagcactatcacactgttttgattaccatggctttgtatatagtttgaaatcaggacccatggtgcttctggctttgtccttctttcttaagattgctttggatattttgggtcatttgtgatttcatatgaattttaattattaaaattcttattcttttttttagaactgttttttctacattttctttctttttttctttcttttttttctgaggtggaatttccctcttttcgctcaaggtggagtgcaatggtgcaatctcagctcactgcaacctccgtctcctgggttcaagtgattctcctgcctcagcctcctgagtagctgagattacaggtgcacaccaccatgcccagccaattttattttttgtatttcttagtagagatggggttttgctatgttggacaggctggtctcaaactcctgacctcaggtaatctgcccacctcagcctcccaaagtgctgggattacaggcataagccactacacccggccattttttctacattttctaaaaaattgccattgaaatgttgagtgactgcattgactctgtagatcattttgggtaatgtggacattttaacaatattagttcttccaattcatgaacacagaaagtctttccatttatttgtgttgtcttccatttctttcttcaatgtcttatagttttcagtgtacagatctttcacctccttggttaaatttattcgtatatatttcattatttttgacgctattgctttggtttcttattattattatactttgagttctagggtacttgtgcacaatgtgcaggtttgttacataggtatacatgtgccatgttggtttgccgcacccgtcaactcatcatttacattaggtatttatcctaatgctatccctcccccagccccacaccccccccaacagaccccaatgtgtaatgttcccctccctgtgtccatgtgttctcattgttcaactcccacttatgagtgagaacacacactgtttggttttctgtccttgtgatattttgctgagaatgttggtttccagcttcatccatgtccctgcaaaggacataaactcatcttttttatgactctgtagtattccatggtgtatatgtgccacattttctttatccagtctattattgatggacatttgggttggttccaagtctttgctattgtgaatagtgctgcagtaaacatacatgtacatgtgtctttatagtagcatgatttataatcctttgggtacttaattcttttttggataatttgttgttaatatagatgcacgactgattttcatatgttgatttcatatcctgcaactttattgaatttctttattagcttctaatagcactttagatggagtttagggtttccttcatataagatcatgtcatctgcaaacagagacaatttaccttcttcctttccaatttagatgaatgttatatctttttcttgccgaattgctctgactaggactcatagtactatgttgattgggagtggtaagactgggcacctgataaggttaggctttatgtccccacccaaatctcatcttcagttgtaaccctcatcatccccataatccccaaatgtcaaaggaaaccagatgaaggtaattgaatcatggaggccagtttccccgatgcttttcttgtgatagtgagtgagttctcatgagctctgatagttttataaggggctcttcccccttcgcttggcacttcttcttcctgctgccttgtgaggaaggtaccttgcttccccttggccttctgccacggttgtaagcttcctgaggtctccccagccgtgctgaactgtgattcaattaaaactttttcctttataaatcacccagtttcgggcagttctttatagccttgtgaaaacgactaatacagcacccttatcttattcctaatctcagaaaagctttcaacttttcactattcagtatgacatcagctgtagacttgtcatatatgtcctttattatgttcagatacatttttctatacctaatttgttgggagcttttatcatgacaggatgttgaattttttcaaatgctttttctacatctgagatgataatatgatttttattctttattctgtgaaagtggtatacagtagtccccctttatgcatgggggatacattccaggacccccagagtatgtctgaaactgcagattgtactgacacctacatatagtatgctttttattctatgtatatacctatgaaaaagtttaatttatgttaggcacagcaagagattaacaacaatagagcaattataacaatttactataataagagttatgtgaatgttgtctctctcactccccctcaaaatatcttattgtattatactcatctttctccttgtgatgatgtgagatgataaaaggccaccatgattagatgaaatatggtgaacgacataggcattgtaacataaagttaggttattattgattttctgatgatgcatcagaaggaagaccatctgctttgagcgacccttgattattgagctatgacaatgttgatggttggatgccaggtgcatatgatatcaatgtccaacaggtcggttgtgatacagtttggataccctagaaaaaggaatggttcatctcctgggtgggaggaaacaggacagtgtaagatttaatcctgctactcaaaatgcacaattcaaaacttatgaattgtttttctgaaattttccacttaatattttcagaccatgattgagtacaggtaactgaaaccatggaaagtgaaacaaagcataagtgagaatactatatcacatttatcgactcatgtatgttgaattatccatttattccaaggataaatccctcttaatcatggtgaatgttccttttgatatgccgttgaatttgatttgctagtatttttttgaggatttttatatctgtgttcttcagagatattggcctgtaattttctttatttgtagtgtccttatctgggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtctagcctttatcaacttcttgtaggttattgtatttattggtgtataattgttcatagcagtctctatgatccttttttatttctgttgcaatgtctcctctttaatttataattttatttagttgaatcctcattccttttttcttagtttggctgaaggtttgtcaattttgtttatctttaaaaaaacaattcttacttatattgatcttttctattctctttctagtcacaatttcatttatttatgctctaatatgtattattcccttcccttttctatctttgtcttagttttttttttcctatttccttgaggtataaagttaagttgttcattttagatctttttttttaatataggcatttatcaatgtaaacttctctcttagaacgtcttttgctgcatcccagaagttttggtgtgttgtattgttattttcatttgtctcaagatacttttgatttctctttggatttcttctttgacccattggtcattttggagtgtgttgcttactttccatatatctgtgctgggattaatatttctgactttttagccaggctgcctgtattctaattacaacttcaccacttacaaggtatttagctttaggtaagccatttaaactctcagtgcctcagtccccttatctgtaaaaatgagtaatacagtgatattaataataataatgagagtatctacctccctgactgattgtgaagatgaaatgaaatagtcagtagaaagtagttagaatagttcacagcatacagtatttattatttttatgattaactaatgttttatgaggtccttagagtgctagacactgtttgcatgaattattttatatgatctcaccacaaccttataaaaaagtttttattgtccgatgttttagacggcgtagttataggagttagtttcagccaccagttgtatatagagaagctgctaggcaaacataagatttttttaaatctagcacaaggacctgaactttaccacatctgtctcccctgttgactatcaattcaatgcctaggtcccatgagggaagggtcaaagcatttgatgttaaaatgtacttctcagaggatgtccttcggagaagtattctttctcttacttatgttttgttaatttttgcttggttttgattgtagacatcagtttgtaatcagaaatgaagggaaggtcctgggagtaccaacatttaagagtgaccaaaagaatggaagccagcaaaagggatagaattctatcatcttgactcccaaacctactccatgttgatagtcttaatcttagttaatgatccctgctgcttgatccaaaaacctaacaatgacttcactcatttccctccttctgcactgttgttacctcttcagggacaaaatttcaatactttccacttagactttcactactgacttctaactcatctttttgctttctcttatttggaacagttattcagcttaccctaagtccagagtgaatttccaaaaaatcaaaggttctgcaacttttcatttctcttcaattccaactcaggttcacacgtttatcacctagtgtagaagggctttcctccacagttttgcttggcaaactccttttcatccttcaagactcaacaaaattgttgccttttcatgaaaaaggatactcttccatccttctgatattaataattttttgttcttgtgtccatgatagactttgtcataatgtattacagtttatcctggaggaaagcaccacaagaccaagagtttcctttttttttttcatcccaatgcttgatacatagtagccatttgataagtacatgttgaatgaaagcatgaatttataacatatataccttcacctgacttggagtttcataaggaatgcaacagcttccaattcatttactttctttttgcttaacaaagtatctgacacatagtacaaaagttaaatattataaataaaagattaattgcacagatatttttaaaggagacagaaaagatttgaatatccaggaattccacccaacgatgaaagacctataggcggttacaagtaggtaagcagagtccaaaatgtagggtcattttcaatggcagagaggaataggagagtcaataagaagcaaatgctcaaggagcttgagtagagacgggaataggcatctctttattatcttattggctgatttatacttcttgtaaaataattagcttaagctaattatctaagaaacaagaatctctcctaggcagattcagttgcctttcctggttctccctgagtgctctgagtaagccccaccattgccttctagaaaaactttctttcttctttcttgcccactcccatctgatcccttcacggcatccagaatgatgatccaaaagtttgggtccaaatgtgatgcaaaagtttacagtggtctaccatggttcctttacaaaaaaagaccaaaaatgttctgccattcttgctcatcatgattttgcctcagtttttcaagttatgttttgttcataatggatttttttttgtttgttttctgaatgtgttctgttccttctactgccttaaaaagccctcatcactgagtcttcctactacttccctcacctccacttaccctactgaattttcaaactgcaagtcaaatattacttccttaggggaatctcatcagactgtctccctagaccaccacaccccacccaacaactagatcacatccctttattaggggtactatgttttcagtataattgcaattataattattgacccattgaatgagttgattcatgtcccttccttctttattataagctttaagagggcaaaaactatttctgtttttcttaccatctttccctctttagtgcttccacattgtctggtacattgcagacatctaataaatatttgtcggaaggaataaatattagtgagagaataaatgggtaatgcattcatgagtgaataaagattatatcatatttttgtggtaaatattttgtttaccttcaatgactgaaacaaagagttccatatcctgaaatatgacctgaaagccatggaatgaaaggtttgataaagctggacgtggtagctcacacctgtgatcccagcatttctagagaccagggtgagagaatcgcttgagctcagaagttcaaggccagcctgggtagcacaataccttgtctctacaaaaaaagaaacaaaattagttgagcatggtagtacacacctgtagtcccacctactccaaaggctgaagtgggaggattgcatgagcccaggagttccaggctgcagcgtgctgagatcatgccactgtgctccaggctgggtgacagagcaagagcctgtcccccccaaaatttttttaaataagaaagttttaataagcagaatattagtttaattatgaatgagaagagatgtatagcatttgtaggggtacagaaccatgtattccataaaggaagaagttaagagcaatgatgtggaataagcatggggcttttaagaacttgtctgaaaagaggatattctttggtcaatagttgaaaaaataaaataagccttgctggagtggagcaagtcaatggaaagccttcacagttaggtggagcatttacactaaatgactttatttcgaacattcaacaaacactgactgattgtctattggttacccgccatataatgttaggtgctggggaaatagaagtaagtagaatgaggtgggggaggttcactgtggctcttggaaaggaaaatacataatcaaagtttgtgttagaagggtcaatctgaaggcttttgaaaaatggatctgggatagggaggatgtttgttgaatgaatgaatcaatcaatccaattaattcaataaactaatcatgattttagtgagtattctatgaaccctcacttagtttgattaccttgactgtgacatttaactttgtatttcactacttctttgcttctcttacattcagttaaaaatatttttaaaatacaattttcaaggttcagaaacaaaaaaaataaatgacattctggaaaaaatagatgtgctcagaactaaaaaataaaaataatggagatggtaaatatataagtgagaaatatgatgatgattttcattaacaagatacaccattaaatatattctcacgtgatccaaagtaatttcgttctctgtgcccagcgagttggtatctactgatggtggtttttcaaatgcaccgtgcagttagacgtcatcactgagacctcaataatagacctccatcactgagaagttcagaggtagaagatgcagggggacaatgttggcctgcattaatcttagcttgaaaagaggatctttagataacactatctaaatttagctgtgttcaaaatgctccaccacagaagagcagcaaaaagcaatctcattaaaacaagctcagaaaacaattccaagatatatgagtaaaagcaaactaaacaacggaagcacaaatagtatgaccttctcttgacttctacttgcacagctctacttattcaagctctgtttcggacattaagcttttttcatagccataactttcgtgttttttccatcatcctgtctattatatttccccttttatcttttattgagttcttttaggagaaacttgaaaaaaaaatctctataaatggaggttttttactcaagagcttttaaaataacagtacatcaccagatcatttttaaaaagtgttctattgtagttaagtgaatatttattgaaatttttctcgtcttcccattgaagactacagaaatctctttcttccagttgagctcaaaaggaaaagcaaaaaaagatggacagaagccagaaatgctgaataaattagtgtcctttttatttactttttaaaaactatgaattggctcatttaaatagattctaaaagtatttgtatgtgggtctgaacactgttgtcatggagattaaaacatttttgttgttgttgtgtacagtggagatggcagttttcttctagttgatgcttctgtagaataaaaaaaaaagtttagctgagaaaggtaggtcttaatggaattgttaatatgtagtcttattttggatgacattttaaaatcacttacgtatttaatctgtggattgtagagcatgctgggaagttatcaattccattggtacctgcctcagttgcagttcagccttaagtacttaccaaagggagctcatttggggtggcaggggtaaccgaaaagtgtgggagctgaggtattgtttgagagcctgtgggcagtgtgactgctccaatcgtagtttcagtgaggaagagcaccatctgtgcaagattttctcagatgtcctctataagactttcattgtcatcagttctatgtgctctcaaatcattgctttttcttctttattttgcacataagctataagctattttttaagacatataggttttatttctgtgtgatcaaaaactatgtctcgggcaacttctactttttggaattaacaattattttctttgtggtcttgtgtgtgtgtgtatatatataaacacatacgcacaagaagactgtctctctgtttgtatatatacatacacgcacatataaatacacagagagagtgtgtgtgtatatatacacagagagagagagagagagagagagagagagagagagagtcagtcttgctctgttaaccagctggggtgctgtggtgcaattatggctcactggagcctccacctcccagactcaagcaattctcatgcctcagccttctgagtggctgggactcccagcattcaccaccacacccagttagttattgtactttttttttttttgaagagacagggttttgctgtgttgcccaagctgatcttgaactcctggacctccagcaattctcctggcttggcttctcaatatgctgaaattataggcgtaagccaccttgcctgaccatcgtccatatatttttgaaaatgacctaggaacaatgagactttttgaagttttttccgtttgctaacttatcagagaaaactagtggaaataatatcaaaaagaaatcatcaaatgctacccatggataatgtacaagaaaactcagcaaaattatttggcacagatgaagaagacaagaaaaatgtctgctttgtgagaataccatagtaggtccttcagacaggaggtactttattaagaaggagcaattctcattaataaagatttagagagatcacttataagatgtatttatggcagcaagctcatttggtacatgtatgtatgagggaatcaagatctgaaaagattttcatcggttagagtgatacgtctgttatgatgcaattaattgtgatatactgtctactggagatttgttctccaaaacctgacaatctagtactttgtaggaactaatgtgtataatcttagggggcttagtggacagaaagttcattagccgttggtactgtgataggggaaaaagcaaatgggaccttaaacaatatgaatagacatggtttctcaaagaatagtctatggttcacctgagcacacatcacaaaggatgctgacaatgcacagttaaggtaccccacctagattaaatgaattaattttggacttgggtttagatatttacatttttatcaggacttcttatgttcaccccaaagtttgcaaaatgctcatctaaaataagaaagatgataggcctgatccatcttctgtttactaggttaaatctggaaaatataaacctcaggtgccagacttcagagggatatagaaaaacaattactttttgcattagtccattcttgcattgctaaaatcctaaagactggataatttctaaagaaaagatgattaaggcgggatgcagtggctcacgcctgtaatcccaggattttgggaggccgaggtgagcagaccacgatgtcaggagttcaagaccagcctggccaacatggtgaaacctcgtctctgctaaaagtagaaaaaaaaaaaaaagaagaaagaaagaaaagacgattaagtggttctagattctacaggctgtacaggaagcacaacagcatctgcctctggggaggcctcaggaagcttccaatcatggcagaaggttaaggaggagcaggcatgccacactgcataaacaggagcaagagagagtgggaaggtgctacatactttaaaatgacctcatgagaactcactgtcatgaggacagttccaagggggatggtgctaaaccacttatgagaaatcagcccctattctccaatcatctcccaccaggcccctcccctaacattggagattacatttcaatacgagatttgggtaggatcacacatcctatatcacttttggagaaagagtggaggtagctctgaaggtttgttacatcacagcatttgaggaatggctggggtgatggcaaatatcatacagaagagcaggcgtagacaagatataccagttgttttcaaatatctgagaaaatatcagtaagaagaagtatagtcatgagtgtgcctcacttgcctaaacattttgattaaaaatgcattttagtagatttaattatgcctttttcctctggtgaccatctgttaaaaatttttaaaaccttgacctatgaaaaaatttgtcagtaagatgcatttgttgtaccaaacttctcagttctggactttttaatcagtgtagttgccatcggactcacccaccagcttgcctgctaatccatctgatctgtgtcactcaaatacagcaggcagtgaagaacagctgctttttcttatttcattctccttctatctgtcataaaatccaggtaccaataactagggataagtgttttaccaagagcagttatttcaatagcttgaacttaaataccagattaattttcacagaataaaaataatgtttagtataagttttaataatggcatgtagatgaaatatttggacttggtgacttttaagttgtggttgctttttaaatgacttctctgtttgaggactttgtgtatacacatttcctatcacatttgtggtaggaagattctaagatgaccctcaagattcacaacctctggggtacacatcctatatgatcccctcctgttgagtgtgattggagcctgtgaatatgatgggacatcattcccatgattaggtaacattttacaacaaagtagaagatataattcggatataactcaggtggctaaattagttttcttcaagctactcaaaaggaagattattctgagggcacccaacttaatcaagtgaactcctaaaagagtgtctagttctcagagagcttttcctgctcttgaagaagcaaataatcatgtgagaaggccacacagcaagaggcttaggaggcctctagaagctgagagcagcactggattgataatcagcaagaaagcacagctgagctaacatggagactgcagcctctctaggtcgacaggaactgattatcaatgaatgttgttttaagtcactacgtttgtgataatttattatacagtaataaaaaccaaatacaaaagattaaaaagaaatctaagttgaagatatcttaaaccgaattgcatttaatacacctaacctactgaacatcatagtttagcctagcctacctttaacatactcagaacactcacattagcccacagttggacaaaattacctggcaacacagtacactgtggaatattgttggttcaccctcatgaacatgtggtggactgggatcctcagcttgctgcccctgcccagcatcacagagagaaatgtgcttcatatcactagcctggaaaaatatcaaaattcaaaatttgaagtatgatttatattgactatgtattgctttggcactatcacaaaatcgaaaaatacgaagttcaaccgtcataaattgatgactatctgtaccaccaaatagcccattactcaaatcctcaactttttctcttcaatgtatgtgacctctatttatatagtcaatacttcttgatttgaaaaaggattggatgataatagaagtgaaaagtttgaatgattatactcatttttctttttctttatctataaaccagcgcccagttggaacatttccatattttagttctaaggttgtaaattgctgaaagtttaggttttcttattgatgattctctgctaacatttgataagtaggtcccattgaatatcacaattaatctatttaagaaggttgagagatatactgttaaaccaaagggaaaatggtaaatgaaattacaatttatatttttcccctaattcatgggcattgaatattaacttagtggtctgcacttgtagcttgttaattgtttgacatctagctgaaaagtaaagtgttatatcacagatagcttttctaattgcaaacacatcaccctgtttattcattggttcactaagccttaattaggtatctatcctgtaccaaatggtatgccaggggtgaggatacaaagatagaatagaactttttagtacaatgtgaagaaagaaacataaagaaataagactgctgaagtattttaactaccaggtttgcacgttgacttctttatgcttcatttggattttctgaggctttaacgttttccgtttttaagactaagctcaagggtcaactctttcatgaaaattaattgctatttatgtttccatctataagaagagtgaaataaacaatgaaatctaatgacactgaaaagtgctttcaatgtactgttgagtgggaaaagccacatttttaacttgtatattcagtgtgatcccaattttataattttactctcaatccatatatgtgaatataatacataggaaagaggttggaagtaattcaatcatgaggttaacaagttttatctcagatgagattgtgtgtgatttttaaaaattatatttattctacctaataagcatttattacttttataacctgagagataaacattattgaaaaagaagagcatggatttaaagcgaggatgtgagactgtggctgttacatatttttttggtttggaccttggttaagaaggcaaagagggatagagattgtgggacatagagggagacgcaggcctgaggacagttacagtgttataaagggagaggcttaagtatcattataatatgagcagaaattgcaaagagtgagaagctaaaatggaagggagacgataaatagctcagcaaggtttttagggaagcagaaatgactcagatttgaaatataggtgacagaattagccttaaggaggagaaagaaaagatcttttgagactataagaaaggaggtgagagttgatgtagccataaaaaatacagagatgaaagggtggggagttaaaagagcctgtgtatgtagcctaaattcttgctatgaactagaaagccaggtcattagccgaaattgacaatgggataggggtggtcttggggaggttaaggctagaaaaatccaagcaaagcaggtaacaagaggacttgattccagactgtgaacagatttgaggcagggtcagaaagccaccctgaaatttcagtgctataaacctgtagtgggaactctataggaatactaatttctcccttcatcaacaaagatattatactggtcctgtgaagaggcttagtcacttcccagtttatgtatttcaagattatattcctaaaacacagaagtttttcagtttgttccctaacctgaccccagtctacctgtttccatccaagactatcactaccacttctaaaccacctccagccacacaaaaaacacacactatgcttgagtcattccaaattacacaccttcctctaaacattagtgtgaaattaggacatttgggaaatgtgattgatatgatttgcatgtttgcccccttcaaatcgcatgttgaaatggtattcccagtattggacgtggggactggtgggaggtgattggatcatggggacagatccctcatgaatggtgtagcaccatccccttggtgataagtgagttctcccttagttcccatgagatctggttgtttaaaagaaattgggatctccccctgctctctcttgctcccactccctccatgtgacatgtgtgctccagctttatcttctgccatgactggaagcttcctgaggccctcaccagaatcagatgtctgcaccatggttcctgtacagcctgcagaacagagaaccaattaaatatcttttctttataaattacccagcctcagatgtttcttaaaagcagtgcaaaaaatggcttaacactgtgatatttggtattttctagtccattagtgcacatccccccgatgtaggataaatatggtatgaatatttgaatatttttatgagtaataattaagcttattgaattatcacaactccagtgagataagtctaattttaatatcattagaaaggtgaagaagacaagaccagcgagggctactaatttctcaaggacacgctcatcctcatgtgagagctggaactcaaaaccagaccttgactttgtcaaaatgcacttttggttcccaatctgatattaggtgcagattcttctcttctttaaccaagggccaaataatacagccacccaccccaccctgccccagctctccttttagaaccaaactgttgctctctcactttagtgaggtggaaggaagactatttcaaattgactgatgaattaaccctatcgaaggtcagaaaaatgttagataacttaagggggaaaaaaagaaaataaatatcaaaatgtggaaatgtttgaaaaagaaagacaagaaggataggggaaaatagagaagaatagagagagaaaggaagaaagaaaggaggagagaagggaaggaaggagaatgtttgatgagcttatgaaggatgtctctttgcaactgagtgtgaatttagatgggattacataacatgaaacaaaatgaaaagaagaaaaaacagatacattcagtgatttaaaaatggggtaattctttctgtttttatttcacaagtcttttgtaacttattttagagttttaaaactttgtagacatatttaaaatgttcaattttcactaaaacaatcacatttttaaacataagggcatatatttggtgtgacaacctaacatttgccaccaagtgttaaagatgaaccagttttaattttaactagacgatttgaaacttttttgatatacttgagaatttgggactaccaaaaaacccctaaatatgatcctttatattttttattacttctaaaatattttgattctaaacaaatatatgtaaatactatgtggagaatttagatactaaaaatttaagtcaaatattgtttaagtacttacaatatgcccgggactgtacatgatgctaaaagtagccagatgcaatggttactgacttcgagtggcatctttttgaaacagagggcagaaatgaataaatctgagataacatgatgtgagcttgttccatactggagaatggggcactcagagaaaagagtgtgtgcaactgcaggtggggagaagctttgggtttggcactccaggaagatatgttcaaagcagaagggtaaagggcactgattgttcaagaaaagtgagtagtctggaaagggtcattatttcagaagcaacataccaagaaggaggcaggaaaagagaagacaaaacagcagcatggaagatgggtgaggagccaggccacgtgggtagaacttgagtatcataatatttctccatctaaattctactaggactagaagtcttatggacattttatttactctacaaagtgcccacgtcagtgacagataaagagtcaacatctgggagtagcttaggtgggttccacatggcccaggattgaacctctttctctcccttcttagctgtttgacctcagtcaagttatgtcacctctcatgcctctgttttcttgtctgtaaattgggaataataaggtaataataagtattgtgaggattatatatacatgtatataataatacatcatatataacattaatatttattaacacacatatataatctgcacatatgtttattatgtatgcccatatatatattacattatatattcatgtatacatatacatgtaaggtgcttaacagagtccctggtaccaaataagcactgaatcaacattaactattattatttggtttatctgaaacattcaaatggtatagcactaaggccatgtaaaaatatcatgtatttcaattattgaaactttttcacatttttgggtatccaggatagagaaggggaggaaggatctagtcacataatatttgagagtcagcaaattctttcaacaataatgtgattgtatttgtctgtgtgagatttctatgatggtcattttcatggagccagtcaagcattgactttgaaattaggcagatatgaatttgaaaagtagttttccctccactagccgtttgaccttgtacaagtgactttaactcattttttattattaaaaaaatagggattttttctttgtaagatttttcaagaggattcaatgtggtaacaggtataagtgcctgttagagggcctgtcatagataaatcctcaatgaagggtaactgttactaaaaggaagatataaggagagatatgacactacttccaaataaaaaccctggttcaatattggagcatggggaccccctttaagagaagcatcctcccagcataatgtccaaaatgaaaatatttcatttgtaagcataagaaaggggtcattttaagtgaaatgaccgacttatcaagccagtccactgaactgtagcttggagtctgagttacaaagtaatctatagtgatctgagggagtaatacaaactccaagttaatgactgtagaataaattctactgatatttgcagtctagtgtcatcaaggctaattctcctttaaagaggcaaaagcttcttattgtccccaaaactgttgatatagtatgtaactcagcatgtcacagaaatgttgtttatccactttggctattttgtttaaaaaaaacttttctaccctttttatttatttatttttaaatttctatatttcataagtaaaccaagcctcaacactcggcatttcaggccaggtatggtggctcacacaggtgtgtggtaatcacagcactttgggaggcttgtgcaggaggatcgcttgaggccaggagttcgaggctaacctgtgcaacatggggagaccctgcctctagagaaaatgaaaaataattaggcaggcatagtggcacatgtctgtagtccctgatactcgagaggctgaggtgggagaattgcttgagtccaggagtttgaggctgcagtgagccatgatcttgccactgtgctccagcctgggcaatggagcaagaccctgtcttgaaaaaagaaaacaaaaacaaaccatttcaaattcaaacatatttttctgaattaaaaaagaaaaaatactctctttaagtatatgaaaaagcaaatatctttcctagagtatattacattttaacagctcttgaaaattcagttaagtggtctagtgcttgtggtaatctggatgttagctaacaagaataaaaattaattccatacgttatcaacagcaaagaattttggagcagctaccataaataagaaactgctttagatgctggagatctaaatttggtaagatataatttcagccctcaaggatctagtttgttaagaaacataggcatcataacaaataaatgttcttgaattcaaaaaaaattaaagcttgattgttcagaaagcaatttcatctatatttaggagatgtttacaggtgttatattttataatgcagatctgagttcactttttgtacaagtagaagagtcacacttttatattaatagtgataatattattaacactgttggatttcttccatgtactgtcctagatattttacttattcctagaattttatagaataggtcattttgcttatgttagccttcagttgcaggtgatagaaatccaaattgagcatctattgacacctctattgatctgtccagggaagtacagaggagacctgccttagccatctgttgaccagaggaccaatcacatcaacaggactctcccctctctcttctaagctttcctctttgttgtctttattttcactagggttttctctgtaaggtgcctaaaatggctactagtagctacaggtttaggacctggtccttagcagtttaaatcggaggaggaaaaatacctcctgttcttaaagtccctattaatctctgttggccttgcatgggtgatgggcccaaccatgtaggaacacagggcagcttaggtcacatttccataaatatcagagaagtggtattgcctgatatgtatttcatagctagcaaatgacaactggaattgaagtccatgcttcttccgagtgatcactgtccctctaattgagtacctttcaattgaacctgtttcctggcgttactttaattttgtgtgaaaaactatcttcttgattttaagtaaaagcaatgaaaaaaggccctctaacattttctgctcacaaaaaaattagctttacagatagtagacttcatcagtagatacagtctttaaggaagaaaaacatagtttgtataaaatattactataccctttactatgtaatgtctcctggattctataataattggtgggctgtgtggtctgcttgccatcttccaagatgtgccccttattgaaaaaacaaaaacaaaacctatgtctgtagtatgtatatttgtgcatttaaatgtttgtgcccatggacttgtgtgtgtgtgtgtgtgtgtgtgtgtgaatgtatgtctatatatatatgtatggtgtttgtgtgagaggcaaagagaagagaaaaaagaatgacgttagcttatcaatatattataataaaattgtgttgactagtttctttatcgttctcttccaaactgataaaaggacaatttttggtgtgcggtttaaaagaaatgaacttttccccctatactgagggcaattttaaaagaaggtagtttctcaggtgtttctagtcaaaatgacaaacctacaaagtacatttgcattattttatgtatactttactgatagagtcctttaaatgttgagttcaagctaatttttcttaatcttcaaaaagtttagggatcaaattgtatcctgcagatttttgttatgctaaatttcatttcatctcttcttctttagttctacagagaagttaggtcaagattgtttgaaagtagacttgagtccagaaacttgtctcttcgaccagtggattatctaccaatttgaaaaaatatagcatgcatgtggaagaaaatgttacttttgcatgtcagcatgttgtcattattattagaagaacacatctttcaaagaaaggaaacataaactccataatgctgtctgatattattcttgaagacggctatcattttagctgttataaaacaggaaggaacatcatggagcattagattataatatctatagtcccactagcacaccattaaataaagtgaaggtatgaatatttaaattagaatttgttttttatactatattatgtcaggaagaaattgcaagctctggaaattctttgtgtcttaggaaaatgagattctattttttatagctctttaaaaaaaatacctgcatcagcagacaattggtaacagtcatcatatttggtgttatttagcatttctcaaaaacatggcagttgtttttatgtgggtgtggcatgttggcatttttacattatcgattccttgattcaatttctactctgtgctgacctgtcatatgggataaatctaactacagcaaagctctgttattcttcagtacagtacaacagataagtaagccagatataatacatttgggtgaaaaaactacaaaatcatagagggggatctttttaagagcttttaaaacaatcttttggtttaaggcagagaagtattctacaatgaaacactagattgcataagataagcctgtgcctgttccaacttaattttctttgttactctaagaactccccatatatatgtaaatttcagcagtgttaatgggctttctttggtatgtcagaagaagaatgtaatttgtgaactagataaatctataaggcacaggtgtgagcaaaaaaaaaaataataagaatcactcctcacaaggaaatactaaataacaattattattgagatgtttcatgcattttttttatccatagtagtaagtactactatctctataaagaggaaaaattcaatccaacagtcattaaagttgttctattaaatgtagtgataaatcttcagtttgtatttttaatataagatctgagggataatcaaagcaaaggcttatgtggatagggcatttattacataccaggaaatgtcctgaactctttacacatgattcattaattttctgaattacacttgtagataggaactattgttatcctcattttatagacaaagacacagagatagaggttaagtatctttactggggccacacagctaggaattggcagaaccaggatttaggcactaaaatctgtttatttaaccactagcctacatggccattggaaatgaattatacagagatgaaaagttttcgttatagattccctcgttgaaactcaaaaacagaaggcaaaatatgtaaaagaactcaaaactgagaatatttttaaaaatagaataaaatgtcatagaaaaaaatcacatttaagagtttctttcttctattacttttaccattgcagttatgggcgtttggatacagtttgggtttaataaaacccccaagtttggtttttattaaaataagtcaatctatcattggtcaatacatcacatttatctctcttttctagtagtgtcaaatctgaggagcaaatatatagctactatacaaaaatcaaagatttaaaagttttagcattgcattgagctattaatcattgtaaaaacattttaaatgcctccattttttagatgatagctacacattaaagatggggtgtaggtagggtggttgatcagtgtatctaaatagactatagtatgcaaaaacattcagtaaaaaatgttccttgagcaagaagaaaaaataaagacagctgatcaaaacacatgaatttatatgactcagtaattcttacattatcataaatttcgctaccacttttatgaaagcaattcacacaattcacaatgtgaggagcaattaccatcaaagatacataataatatgccatgtggtatatggagccacaggatgaagatggcaggttttcttgggccatcaattttactcaagggcattttaaaataatattttaatattaaaggaagcatatgatactgtagaataaaatttatttgcatttttaaaatctccaacctgactcttctgtgaaatttcagagctgtggctgttaaattggaactatgccaccagaccctggggtatgtctatttattcttctctgcctttagggaatttttttaaaaagttcaagaagccgtgagataatgcagccttcatagttattctgtttgtagattggtagtaaatttttgatacttattatgaatccaagagtggaggtgaaacatagcactggatatttttatatgtgttggtctatgtcaatcaaataggagagataaaatgatagtcttgttagtgaaagaaaatagggacaattaatgtataataaacttaaagttacatgatatgacagcatagaattaaaaatatgtctgtctagtaatttttttctccttcgcaattattgctttcttcataggcttttcctattgttctctgtcaagacactgcagtctgttttaatcattatcatctactgcttctattttacttgttatgtcatacaaattcatgtttggttctccactaatactgtttcaagaggtcacgaagaaggtatttttttttttaaaggaacaccaaaatcgaatgatggtatgatggattttatgtgtgactgagcttgtgtggagtgaagaaaaattcaaaataaattcctctctgagacacactgcatggaaatatcaaagcagtgcaattctttcataaattaaaggttatactctcattctgttttgggtccatccagaagatgataatgtttcgagagcagcagtttctcaggacactcttctgtgtttcactatggtaccaagaaatttgccagggaaagaaatgatttgcctttattctgtcaatattatcaaattaagaatgtttttccaaaaattcttttaaattattgagtgtttattatgagtatttatgatgtgcaaggtgctaggctaattgctggttgtatataaaggtatttggactccagtactattctatttttattttgtagtctgtgtgaatttataaaccactaaatcttacaggtttaatactcaaaactcctcttgtcttcaatatacctaccatagactgtaagggattatttcgagtagtcagttggggtttgatatggtgttaattctttatgcatttacatcattctatcaatttcaagtgtgttcttttattctttttcttttttctttaatttttccaggctgaaatagttatcttttaaagtctgttctacagcagctgctccaccccagtcattgcctttagctttctctagattgccattaggccttcttgaagtcgtgcttattacagatatgtgaggagtgctttttttagggggggaaggggagaaacagatgtagaataatccttttttgttgttgtttttaacacccttttctatgatggccagtgtttcactgatgatcttgttggctgtctccgtggctggatgagttgtctcgaagagcagtttacactcagtagtgaccaggtccttgagagctcttagctcatcatcctttaagtatagtttggagtattcttcccaggctgtactacttcatgcatttttttttttttttttttttttgcctattgtatttagagtttttcctgaaatgaatttctcactatgtatttgactatcaagaagagttgtatcatctgcaagtttgaggtttcacttgaaaatcctattagcccatacagggaataattcattccagtaggttcttaatagcccttccctgttccctgtttctaatccatttattgctctttaaagattaccatgtactcctttttcttattataaaatattgcatattcatattaaaatctggaaaattcatagaagcagaaataagtaatctaatgaatcaaaaacaatgtcaagtagtgtttcttaatcattacaattatttatgaattttggttttaatttttcaacatttggtctacttgatgtgtggcacacattgttctatgaaatccaaacagtgttattgtaaagtctctgggcttcttagagcaaaagttttaaaaccatcatttatatgtttaatatatttttatctatttctagatttattttaaaggcagtaaaataatctaacaggctcctgggtacccatggtgtttattatattatgaagaaataaaatattactcatacagtcgaaaccctacaattaaattcctttccctcccttcagagggaacctattataatgtgtgatttgtgatcatgaatgatttcaactagtttttctgatatttatatttattctgcaccttcaccctcatcatcatccttacaataggctttatcttttggaaatacatataatattgatgtgctctggttttaatcatcacctgcctcttgcctcagcaagctctaggttgtattttaaaggagattaaatatattttcactgaatttaattgtatctaagtaatacctttcgaagagtcaaataatacagaaaagctcataacaaaaagttgcaattcttccatccctccttcactctcagagacatgactgatctatctcagctgtttcttctagcatttacccccggatttaaaaataatatatttaaacaactataacttaatttaaacattttagacattatctcttcctttcctagtatggaagacaaagattgagcactctcatctgaccctcacacatttctgcctacatcctgcaacatatacttaaaataaatatataatgctaacattgttaaaaccatataaatattactcacagctgagctctgtggtgcactgtgtctctcttttcttttttgtacatcgttgcctggcattaataattgctttgttttgaaaaattagtcttagtttactacatacattttactaattttaaactacactttctgacagaattattaaactcccttcagtatgtttcatcacatttggaaatctattaattgatgatttttgttattatttgtgtttcattgttaagaaaaccatcctgatgcttttctctcccacatttttgtagcttccttagaaagagtgaagaaaaggtaaatgtttttaataaattatgtgtctgaagatgccttaattcccccctcttttagatatcagctggctctagaattctaggtagaaagcatctcttctcagaattttgaagatattgcttcatggctctcaattcttcactcaccttactctatgaaccccagggtctttacatcccttgaggactgaagtgtgtttccacttcaggtgctttgcactggctggtcttctatctggaatgcttctccccaagatatcttctggctaactctcttttcttcttagaaaactgctaagatttaccattcccaatgagccgcctcttgtccttttatttatttttgcaaactgcccctgcccactgccattcctggtctccctaaacaagtcttagtatttcttccctttctcttttcatgttgaaatacactatatagtttacttatgtattaggtaaactttttattgcctctctctgtactccccaagctacttcttgacccttgaaaaaatgtagattccatgatcgtataaaatttttattactttaaaaacttttctaaattaataaattataaaaaattaatatattcaaagcaactagatgtatgcctaaacacctagaaaagtgcctggcgcatgttagaaattagaaagtatttcttatgaacagttttatgatttttcacattgaagttgaagagtcttgccaatttcccctatcttatatatgtgatcagatttttgcctctgtaaacttttaggattttatcttgaccccaaatgttctgtagtttgatcacaatatgacctgtgctatgaattttttgacccgggaaattcatacacctaacttaaggattttaatttttcattattaattatttaacaatgtgttatttatctatggaactcttctttgttagatattgaatttcatggattaatcccctagctttttgtctttggtttattttgattactctttttttttttttccttttttttttttgagacaaagtctcgctcttgtcccccaggctggagtgcaatggcatgatcttggctcactgcagcctctgcctcccaggttccagcgattctccggccttggccccaccccgcccccgccgacccccatgagtagctgggatttcaggtgcctgccaccaaacccggctaatttttgtatttttagtagagatggggtttcaccatgtgggccaggctggtctggaacgcctgacctcgggtgatccacccgcctggtcctcccaaagtgctgggattacaggcgtgagccaccacgcccagccgatttctcttttcttttatttccttttctttatattctattgtttcccctggggagacctcctcacctttatcttacaacattttaaatattaccataatttaataattcttttgtgctttgagtagtcttttaaaaattaatatctcatcctgttcttgttttgtgcatgccatatgttttgctagttctccgagaatattgactcatttttgaagtttttaatattatttttgcctttgtttcctctgttttgttttctttcatgggagatacaaaatttctgggaaaattttgctgtccaataatgtttagctgagacactaaaattgttaaatctctgtatgtcacgaaagcatgttaactcaaatatgaacaaggtatcatttcattggaagactcccaaatatcctctcggtaggctatttttatggacaggtattttccaatctttgtctgctagcatttttgttgagaacggagtatgagctaaggatgagaataatcacactctacaatatgtagattttcactttttcatttttagtatgaattcttatcctcacccctcatccttcactgcatggtaattggacactttcttattaaatttccctagagaattgtattagggttctgtagagggacagaactaatatgatatatatatatatatatatatatatatatatatatatatatatatatattagtttattaagtattaacttatacgactgcatatatatacatatatatatgtatatatcatgggagtttattaagtgttaacttactcgatcacaaggtcccacaataggctgtctgcaagctgaggagcaaggagagccagtctgggtcccaaaactgaagaacttggagtctgatgtttgaggacaggaagcatccagcaagggagaaagatgtagactgggaggctatgccagtctctccttttcacattttctgcctgctttatatttgctggcggctgattagattgtgcccaccagattaagggtgggtctgcctttcccagcccactgactcaaatgttaatttcctttggcaacaccctcacagatacacccacgatcaatactttgtattcttcaatccaatcaagttgacacttgtattaaccatcacaagaataaattcccagtggtctcttgccaggtcagcaatgggatagtaacgaggtttatagggttggcagggggatctggatacctaactaagattttgcagcctcaacacttactctagccttgtaaattatttggtacttaaaatttcagagacattctggggatcagcagctcaaataacacttcttgctgtggtttgctcctccccttggcagacacatcctatccccagcttcctctgctctgggctagtaccactcactccatccactttccttccatcctatattaatttgttgacacttcttttctgatgtcatcctctggaccatatatatatatatatatatatatatatatatatatatatatatatacacacatacacacacacatacacatatttatgacttaactcttattttagaagatttgtaggttataatagcatttaagtgtgtgtgttcatggtcaggtttaaccaaagtcctaggcctgagtatttcaatgtgaagaacaaacagaatatgatattactttcatacctctatttttgatagtctgtgattctgagccctatctatgctttcagtcaaattaccaatggtatgaaactctttaattttgtgtgtctcacgtttagagggtagcttaagaggttctttaactgcatgactattgtgaggaggatacttatgagttgttcttcatttccatggggacaaggacaatgaaaatacagtataatacattcagagtgttattagaagttaggtagtaccttttaattgttaaacaataaagtaataacattgctcattaggcatgtgcttatgaagacaaaaaggcctgatttactgatttagtgatttagtccaaggctttgacatccatatgatgtggacctctgggtactaaagaagtctataaatcccaatcacaactgtgattaattacaaatatcttatgcatgtatttctttagctaaagacagaggtagaatcaaataaaaattactccaagtttactggctctatttctcttcatttgaaaacagaattttctcaaaaggcaaaggaaaagtttgtcatccacatctcttattaatgaaagtgtaacaatcatatactcacatttctccttctgaataaaacaaactactgatgagagataaagataattatttttagtacctctgttgtcttttaaatattccttttttggaaaagcaaaacaagacatgattatattgggagaagaatggtgacccaagaactagatggccttcttctggtacggttctttcactatctggtgtatctctgaagtgtgatcaaaggtaactgatcataactagataatcgttaaagcccctatcctccctccctttctgtatttttacctttcttcccttattgatactaagaccttgatactaagttgttcacaactggcccacattctaggttgaaatgatggtgcatgttggagacaaatgtacaaataaataccatatggttatattactactgtgaaaatgtatgtagaaaatgctggggtaatatggactattttcttaataatctaatttcttacctagtagacagtcaacatttccaatcatggaaatgaactagtgtccacataactgaaatccttcacatctggctatctttaggccctaaattatgtgaaattcactgagtattttccacagagttgtttactgttgtaaaatcttaaatcaaaatgttacatcaaaggaagagttgcatcaaaagaacctcagcaaaacctcaaaacaaccaaacactccacttgtctgtttaaattattagcaaaagcagctctgttatcccagcttctaagctaaccagactcatcattttggcctttcatgtatgcttttcctatggccaaaacgtccacaaattactaataaatgctgacaaggagagaggttaaaaccaggaagccatgccttttagctgacaaaacattcattgaaatgctatctgggtgaagcactgagaaattaatcatctgaatagtctaaattatagtacatgaagaatgcaacttgctagggagacataccttcagcattattcgaggttaatttaaaccaacatgtaaatgtttgtatgcttcatgtgtggtatcccaaaaggttgtgttttctcttttgatctttgaatatgctgatcgcctttcatgaacagtggcattcaatgcactttgaaaaaaacacagtctttttctttgaaggtaagttgtaagaaagagaaatcattaaagcctggagtgcagaattgttgtcgactgaaatggtatcaagtgagttgaatgcctcatattttaaaaatgggcatgatctctattattactaacaaaaaaatctgcattttatgtgatatctgacatgggaaagggatgcttgatgagtagccaatgatgttgaactggctgtattttccgactgacttgtttttcttatgaaggcagcattttagtaaaattgtgtttgtctttctttctgataggctctaattgaagtttgaaggttcattacacaatgcctgggaatatgttgtcaaatacaattcacctctcccacagtgaatattggcatgattttataggacagggtactctagagctcagctgtcataatatttggctccaatttcattcataatggacagaatatctacaatgttttgaatccctactttcaaatgtcagcacactggaacaaatattaaagaatgggtttgaatctaagtagatgagtatttccttgaagcaacatgttatagcctaaatgttgtttccttcaattatgtttaaacaatgtaaccttaaatgtttcacagatgtatcacttgaaatccaaaacacatactactcatcaaagtcatctttatttaagcttaggaagaaaaatagaaatctgaaatgtttgctcttagtccacacacacttctcatctggcaggacatttctgaatttatttgggaaattgaatatatgtcaggtaggtttgggttgctgggtaaatgagtgtacttcagtgtcaggactgtttttattaacagattttataaactggcttggtagtttccagttctgtggcaagaacaatctatcataataaacctgtaacataaaagtacagaatacattcctgtttcaagagtctgtaagaggagtcccctcatgaacagtttatatgagaggattataaaatgaagttcagcagtagcacaagcaactgcagtgaatggtgtgttgttaaggttctttaaatcatgaaaaaaatatactttcaaggatttattaatcttactccaaatatatatattttggtaaatagcaattggaaagaagggtttgtatttcttagaagcactgagctgaccaatatattggaaaactaagtaaagcaggccagtgatctctattctgagtgaaatattttgctctgtttgacatctgggtgcaatgatggctatgtcagtgtcactttatttttctcttgtgcaagtttgataaaactctttaaatactaatgtgtattttagaaaacacaaattctgttatattccaggaggaaggaaattgccttaggatatgaatcagatttgataacatgaactatcttatttaattattctaaattgaaaacatcatgaaagataattgggatttttccatttttattttcctcttgtttcttgcttatttgaatcattcgttttattcttctttctacttaggctaagctctcaaaaggaaaggagatgtaattcaatgtatgtaagtttctaagtgtaggtatttttcaacaaacacataaacaatcatcgatgacattattacttatgtcacataaaaactgtgtttaaacagattaaaaatattttctggagagttttatttattttacaatgtttacaagtgaattgtcaagatgtctcccaatattatttcctttccagacagcaatctttaaatcctgcttgagtcatcttttattccagttttcctttttttgagtgtaaaggcaataaattataacaataaaagacttatactctttgtcccatagtttctcttttctgttgaaatatagcttgctctttggaatattaacatgtaaaccagaggtttttttttttttttttttttgaacaatctgactattctaaaacactttttaggatatcactaattgtcaataaggaattgagatccacagataaacttatcaggaacagaaaattgttttgaatacatttttaatatttaaatagtcacagatcaaaactaaatttttttttaaagattctgttgaataggtaggacttcacattggattcaacctggtatttaaaatgcaaatactttttgatttctctttttgctaagtaatattctaagagattagccatacattttaaaatgttgtgactgtttttgtgtttcatgtttgtataaatgtagagattagacacttgtttaagatccttaaagatctgaggtaaattatttttgggaaatacaaatttctttctgtaatttctaccttctgtgaacaacttcttgaagactgttctgttgctcttggtttatacgcaggtcccttaaaataacaaaataaaaaataagaaacaatacataaggacaaagactggaaataaaagaaaaataatttaaactcaagggattttcttgggtaaggcctcagagaatgttccagctgttcttaagaaagacattgtatataaaggccacatttagctgaatagactgaaaaattcttattatttgagaaatgattcaattgttgtctcaatgctaaatattcataaaaactatccattcattaatcctttttaaactgaagtaattagaaaaagcaggtcaatgtgcaaagaaatgggcttttcttcatcaaatggttaattctttattaaatggttattctttaaaatgagcaaagatgagctcagcaaataaggtacttgtaataatgaaagtactatatgcaggaatactggctttttgtttttaatctgcaattagttaattaaatttcattgtagatgtattgcataaaatacatttgaaaggcaccattcttcctcataatacagctagtgaaggtccaaatttcagtgactcaagtgtaggtgggaaaaagtcctcacaaactttacgcaaattgttagaaaagcttatgtaaacatgactactatgaatacagaccagggatgtgccccagagtcaatgagttcaattcacttgctgccacaatgctttcaggcctaggctctttgcagacagagagcagcatcagggaatgattattacctgtgcccagcagggtttgttcaactgctaatggtcaaggtagattcaagccctctatcattcccagagacatacaaaatcaaatactgacttaaagagaaatataaatgaaataagttctaaaaggaaaagaaaacaaagaaatgtcttttacaaggcactaaagaaagacacaagggaacattcatatagattattttattaaatatttattgagcaaaatatttgtgccaggcactgttagattggcctcatgagctttgcatgggcacccacttgctatacatcaggcttggaaacatactcctgaccagcatttatgctagacatgatttatgtctcatactgtgctaagggggtgactaaaatctatattgaccaatacttgatgagtatatttgacagatgtttaaaagttaaccctgctcaaaaatgtaacgggatctttactaatcaggatcataggtttgcatgggttcctaggaggaaaagaatgagtgggaccagtttatacaccaagcatcaaaggactccattctcaccctagggaaacacggattttactgctcaggggatgatgaaaattggattccgacttttacacctcagattatttctattaattacacctcagattatttctattacacctcagattattatctcagattattatctattacacctcagattatttctattattcagtcttagccgaagattcccagccccaggtccatcgttgctcaagggtaagatcacagacctagtgcctgcattatttcccttctgtgcaaatcgtgagggccaattttgctctctaaaaatttgcattaaacagaccaatcactagattccttctacagatcaaaatgcatttattcaatcaaacaaaagggaatccatgtgaggcaactaaggaagggctttccctccagtctggtgagcagtggctgtggctctgctggctctattttgtgaggtctttataaatgaccacaattaagctgtagatgtactcatgccctagatgtaaccatccgttctggggaatatggcttgataaacccattggtgtctaacacttattcatgtcactcattcattcattcatttattcaaacaaatatttttgagctcttatgaggtgccaggcactgttctaagcaatgggaaaacaggagtaaacaagtccccattcttatgatgtttttattttagaggggataggaagaaggagaaaaagccaatgaataaggaaagaaataaatcaacaagataatttcatataatgctaaggatgggaagaaatgaaaacaggtgttggaatagatcatggggtgggagttaattgaaggggtagtcaagaaaggccctgctaaagaagtgttgggttggttagagcccagcaagggacttttcagctctggagatgcttgtagagaaatgcagaggtcctaatatgggaatgaacatctcatgtagggtatagcttctcatgtttgaggaacagaaacaaggccctaaaggctctaatattgtgagccaggataagggcagccagggtaagggcagatgacatctggagacaggtaggggccaggtaggaccttgtactgtgtacgtaggaccttgtacatgtaggagtcagatcacgtgggaccttgtgcttcgtttgaattttattctaaatgttgggaattgattagatgattttaaaaataatactttcttaatactgtgtcactctgcctactctctgagaaacagatcataaggagacaagggttggaggcaagcaatgcttctacagaagactttggtaggttcggtttctataatttccaagctctgcaggagaccactacagcttcctcctcagttactcttatttacttatgggcccaaacccctgagcagttaaaatctggcatcaataacactatcaattctggctaacaccttggccagtgagaagggttaatataacaggagggaagatgacagacggaaaaccatttcttttacctcttttttggtctccacaggttgacaataacatgttgtaataatcacatgtatgcaatttaccagaagttttgaaatcttagattaccactaacattccaatttctaaagacagtggacatgaattcctgcagctctctgagaatagattttagctgttaatattatattacaacttcctacatagttgtaaaaatttaggttaatgattcctgtgaatttatttttatttttttgaaatggggtctcactctgttgcccaggctggagtgtagtggtgtgatctcagctcattgcaactttgcctcccaggctcaagcgatcctcctgcctcagccacgagagtagctgggattacagattcacgccactacacccagcaaacttttgtatttttagtagatatgaggtttcaccatgttgtccaggctgttctcaaactcctgagctcaagtgatccacccacctagacctcccaaagtgctgggactacaggcatgagccacctgtgaatttaaagtaaattaatattatgtacacagaagttacaataaaaatgcttctatttggataaaacaaaaaaattaaaactactgtaaaagtgaaagatactacatactttaggaacaactggtatttgtatgcaagtgggcctaaatctaatgttgtgtgaagatcaaagccaagtacaattgtagctcatgttgcagttatttcgaggtctcaaaagggataacaacaaaaatctataatagaaaacagaatctgggttaaaatcagtggaaataatttttatttcagaattaaataaattgagtgaaatgaagtatctggctcttggaggaaaatatggtatcttattctttaaatgtctttaaatttataagtcataagctgcaagtcagtagcatcattatgttgatgaattacccagtttaattcttataaaaattgaaattatcttctgaactctaagtcatattttagccacaggtatttttttgttttgtttaatcaataattcctgaaagaatgaaacttattcgacttttattacgtgacaaggtttaaaaaaatttgcttgaataaaacattatggagtctgaattcaaagcataaaggcagaaagtaaagtatgaagatctttcaaacgtctgtcacttttaataattttgttctatgttatatgacctacgaatgttaagagtctgtaagagtttcttcagctgcatttgattttaccaacaccttgtgggtacagttaagaagatgacttatttgaggctttataactgaaattggatatggttcaaacgttcaacagatataaacatattttaattaagaataaatatttttataagattgctgaaatgacttctctcaaaaatttatgccggaacatcaacaaataaatttgcattacaaaatagaaaattcaattgtggaaaatcatattctaacttattctgatgaagtagttcccttgtcaggaagctttttcttaaagtgtgttttatgatttgtgatagaattaccatcactaagtcgatcattgcccattggttagtctacatgtactgccttttagtgacatgagttcaattctaattaagaatgagaatagcctataactatgaacacagatagctacatgtgtctctagtgagaggtactagtcctctttgacatttctcttaaagcggaatttatttggggtagtgatggttttactggtagccataggggaagataagaaaagggggccaagatattcatttctactgctggcatgtggaatgctcttttcctgctccatgccagtctctcacttgatttagaaagatttgtgcgtccttagctttgaccatcaagaagagtccatctcctttgccttcctgtgcctggtacctgaaagacctagtgaagactgaaagaaaagtttttattttcttacatagtgaaagcactttgaagcattttgttacacatatctataatttaacatgataattatattgatcatttacaattctacacattattttagcaagtaatgaacgttcttaagtgcctagtgttgtcataggtataaatcaagtaggatacctgccctcaagaaagtgtataattttatgcgtagagataagagatgagtactttcgcagaaacaaatgaataattatataccaacatggagaacttaagctcataggtgaatgtgggaatatggaggagaatgaaaatcattgccaggtgagtgatcaaagagtgcattctagaaaaggtggtacctgtacaggggtttggaggatgcattggtattaaataagagagaaattagagggaagacacatcttccaggcagagtgtctagaagcagagccagcagcagattttagtgtaagcaatttattgaaaaagtcctctcagaagatatctatgagatggtaagaaaagctgaaaaaggtaggggagaaagtggacaaagatgtgatctctaaagttgagcctcagactgatacatggcatggtctggagggaaaattgcaccacagaaagaggtaccccttaaggaacaggatgccaggattttacccctcatatctgtcagttatcggctacaagtccaaggggcagggggaagtgcaagtgatgtatcttgctggaagtctcagggtcaggaggctctcattcaaagaggcaggtctctggaatgatgcagctgcaagccattagcagccaacccttgcctcagctgagagatgggtaccaggatgaaaggcctggtaaagggttatggctgtgccaccagtggaatttcctacactgggaatatacatgctaggtgcatagaatgttaggtgtgagaggggagaccagcctgttggaaagtattcattaatgcatatttgtcaagaattctagctggtaacactttattaaacattagatattgctattttatgtgctttgaagcaattacactgtttgaaaaaccttattttgtaaaaaaaaatctgttctattcactgtctcacagatttaggacagtttattaattaagaacactagatttcaagtcaaacagacctgaccttaaaccttgaccttgttctttgctgtataaatggttttgtatgagttacttaaccacactgagcctcaaattcccatcagttatatgtggattataatgtctgcctcatgcttgttgtgaacattcaatgtaatcattcatatgaagaagcaatgaacacagggtctggtgcacataaatgttcaacaaatgatagacattacttccttctggatgagcaaaaccttgatgctttcagtagaaggtatttggaactatggttgaatcttttctgggggtattgatgggactagagtcaggatgaggtggatgaaatgccaggtactttcatctgtatgacttgagagtgtatgcatcaaattttgcaccctcgagcacctctctcacctccacattgaaaaaaatacatgccagattaaaaaaaatgaaattggaaaggatggtttgtagaactgttagagcatccataaaactcattacaaagtaaaatatattagtaataaaatgattttagtaatacctcgggaaccactctaattccaaatcatctctctgtctcttgtaatggctttccaatattctttgaaaaatattgaggttattttagttatgatattggtactttgatttggtttaaatatccttttattcttgagatatacaatttcaactgaatggcaactatgacagagttgaaaatgtacagaaaaataaattatagattagacaacgtattaatttaaaagcagttgcaagcaagttactatattgcaatgaaaaaaaagttcctaaaattggtaattcaactattgctgtcctaatagctgaagtcatttttatgtatggcaatcctaaatcaaagccatcataagatgctgcagacctcttaatagcttggctccagtgataatgagcccaggacattagagctcatttgagagcaggattcataattttttttactgtgcaattttcctacctctggctttgtctcaaagacatagccacacatggagaaggacactgataataagagagtttgacattctttataatttttcttttgccaggatccttataatccttgaatcaaaatgattgaagcagttatttttaaaaatagaagctagatttaaaatgtattattttgtgcctcttttgacattattttgtttagagcacctttaaaaactctactggtgattaaaatattgaaactataacagtatttttggcatgatttttaaatacttctttcagctatatacttctctaacttattggcttattatttgatttaattgtccttaggcagtgttaattatgagagtttgccgagtttcttcttgggaatttgagaataaaggatgcgggaaagaggaggtgggtggaggatggatataaactgttttttcaatgtactgaaggcatttcagattaccagaagaatcacagagacaagggaccatttagccatagggttaaacctgtcactttacctaccccacaaataagtaactatggcaactcactgaaagtgcttagctaccatgggagtggatggagttcgtgctttgtggggacaatgctgtgggacctctatgcccccatccataagggaccctgggaattgccttctagcagagaggccaactcacatttcaaataagtatttttccctcctcaactgcttttctaagctttgcacattaacactgacctagtgcaccatttaaaagtcctaaatatatcacacagtcgccagcccaatcaaggtgagtggtcagacaccagcatgctgtgcacagtatgctagttggccttagagtaatacagggtacaccatttatgtccagttaaccaggtgaccctctagttgctttattaagcacaggcttgactgtcaaacaggtcacaaggaggacaaaaagtgtccttgcatcgtatgaaaagagttgcttgaaatcacagaataccctctattaattgctaaaatccaatttccacctgaagacatgcctccatgactcgtgagaaaaatcaattatttaggtaaataggatctgcaactcaaacactcagacctattagagtatctagcagcatgccaggagatagactgagctgcaagataaatatggaaccatcttgtggaatataaatttcagttaaaggttttaaggagtatataataaggaaagcattgttttatattaaaatgtattcaattatattatgggatggaactgaaagttcacatgcagttttcagatgtgtcccccaaagttaatatatttcctgggtactcattcacactcttctgccaatagtattaatgctttgggaaatgtttgagaagtgttgttccagtggaaatgagcctgtgggttcactgattcatttatccattcattcatttattccttcatacagtatatagctttcaagccacttttatggactattttattaactttgaatatcaaaaccaataaaatagactttgtgtctgctttgtgacacaatttaatgagtaacaattttttttttttttttgagaaggagtctcactctgttgcccaggctggagtgcagtggcacgatcttggttcactgcaagctccgcctcacgggttcacgccattctcctgcctcggcctccggagtagctgggactacaggcgcccaccaccatgcccagctaatttttttgtatttttagtagagacgaggtttcactgtgttagccaggatggtcttgatctcctgacctcgtgatccgcctgcctctgcctcccaaagtgctgggattacaggcctgagccatcgcgcctggccatgagtaacaatttttaaaataaaaataaatagcaaatgatgagtaaagtacaacaataaatcaaacaaaatgctattaggaccatatggcagaaaaacaacagaatcttagaagagttagggaagacttcccaaaggaagtggcaattaacctgagatttttaaagatgagcaggagaatttcaggcaaataaaacttgcagtggggttgggagtaggtggatggaccatgatattccaggtgaataattgagcactttagcttgggaggagggccctaaatgagaaagtatatgacctatttcaggaactgaaagaaatttggaatgcttggaatataaagtgtggggcaaatgatggaggacaaagaggcagcagggataatatagtttggctgtgtctccacccagatctcatcttgaattgcagttcccacaattcccaagggtcatgggagggacctggagggaggcaattcaatcataggggcaggtctttcccatgcttttctcatgatagtgaataagtctcacgagatctgatgattttataaaggagagttcccctgcacatgccctcttgcctgccaccatgtaagacgtgactttgctcttcaagtactttctgccatgattgtgaggcctccccagccatgtggaattgtgagtcaattaaacctctttcctttataaattaccctgtcttgggtatttctttattagcagcatgagaatggattaatacaaggcattagagggaaagagtggggagaggtaaagttgaaagacaagcaagaagcagatcatgaaacgctttgtgagccttgttagtgagtttcagggaaatccctctaactgcaatgtggaaaatgaattggaaaagtcagaagaggaaaattcattaaaaggatgtgaagtaattaaagggatttaggataatggcctgaactaagatggtggcagtgggaatgaataatatgaatggactgacaggattttttttgtattttgactcagcaggtgttggtagcattagatatagagagtggggaggaagaaggctctaggcatgatgctcagattgctgatttggttaaaggaagcagagaaagatacatctggagaggaaacaagaatccccactttttgttttgttttttccagttcctgatagatagccatgctcaagtgtcccagtggcagttgagtatttagagtcaaagctcaggggagaactctagctggtgataatgatttgggaattttggcataaaaatactcatttgaacccagggaaatgggaggtaacatccaggataagcttgtagaaggaagagactgtgtagtaggaacacagggaaagatatcaacaccagagaggaagagatgctttgcttgagggtgtactctacatttaaatttttctctttgagagaagaatcatgacaataagaaatttgatttattccatatttcagattgttttgaaagtggtatgtcactaatgaaaggagtgtgaagtgaatactgttgacattcctgagaaatgtatctggggggccttaaaatctgtaaatatcataaatatcatacgaatcctaagaaattctgggatttaaggatgagtgggagacttaggttcttggttctgtgttgtaagtcattctccaagtgtagcaggaccatagcactgatgaaaatgatttatacagtagtcttatgatccaatgcccatgtatgaacaaaggttactgttcctgtcttctaaattggggttcccagtgtaatacaggaagactactgtgtgctagtaaacagaaagcacaatccacatttgaccatattttcctcgttggatgtgtttatggatatattttattctgcttttatctttctgagattaatgccttatctggccttttttcctatgagtacctttggttataaagaacttcgcattgctacattatcaattttcagcctctcttttttatttttaatttctttgccacctcttcttaatacataatgctctttcttccttcgttcctccccctctctgtttcttccttcctcctttctttcttgctttcttctttcttttctttattctttctttttttttttttttcaaggtcttgacgtgttgcccaggctggagtgcagtagtgaaatcatggctcactgcagcctcaacctcctgggctcaagcaatccttccacctccgcacccccaagcagctgggactacaggcaagggccaccatgcccaactaatttatttttgtttttcatagagatgaggtctcactatgttgcccaggctgctctcaaactcctgggccaagtgatccttctgcctcagcctttcaaagtgctgggattacagacatgagccacctcacccaaacttttctttttttttgagagattcttaaactagattgtacttacgataaatgttgactgattcattaccttcaacagtgctttcagcctctgatggttcagagaaatgattgtgtatactttatatttcacctgaatcaggtttcggttgagacaataattttctgagtatgtctccacttcacaaaattaatttattttcaacttttctctagttttaccactgttttgataaataatcttacagtggaggaagacttattgaaacaatttcatcacttttttttctcttgtttgcctcagagtatggttgattcattctctccctaggttggagccattgcagaatcaatattttacttttaactgactccaaaatatatacattctagctaagtactttcagcactatgagttgtccttcttttaaagagaaatttttttaaaatgatatcattaaaaacaagccattccatgatttattgtataagagaagataagtacggagttgtaaacctgcaatagaataataccctggatatccaccttcactgatgagtttaactgactcattcttacctgttaaccaaatgcttttgagagtcaaaggcagggtctgagaggaattatcaatgaatatttgtaatgaatcattgaggtcgcttgtgaatagttgaaacttccaatattaaggctgtgtaggccaagaatctagttatcctttcagaaatttttttttctgaccacctactctgtgccttaagcaaaagtacctgcccttctttctttcttttttttttttttttttgagagcatggtgtggtctcggctcactgcaacattcgcctcccgggttcaagcgattcacttgcctcagcctcctgagtagctgggattacaggcgcctgccaccaagctgggctaatttttgtatttttagtagagacaaggtttcaccatgttggccagactggtcttgaactcttgacctcatgatctgcatgcctgagcctcccaaagtgctgggattacaagcgtgagccaccatgcccggtcagtacctgcccttctctaaaggcacttgcttgcagtctttggaggagataagctttgatcaactcatcaacctaatggcaagtatcatttgacttgagaaaagataagaaacagggttctcaatagtgtgatctacaagatagacagcagtcagtagacgcttgcttctctgaggaagtgactcttggaagaattagtaagagctaggtgggcaaattcgggtaagacagaaggttgagaaagatgttttcagagaaggctccacaggaacatagttcctctcctgctgtattatggagagaacatggagccttcagagatataaaaatgtcattgtggctggaatgcaaagatgaagggaaagagtttgaattgaggaagggatcagagcatgcaaggatttaaagattactttaagaatttggtgcattatactcattaaatgatgtttgccacttgggtcaacaaacattctgtaaaggcttagatagtaagtattataaatattgcaggtgatatggtctctgttgcaattactcaactctgctgttgtaagggagaagcagatataaacaatatgtatgtgtgagtagatgtttccataaagctttatttacagaaacaagccatgacagtatctggcatatctcctgatcagataaatcctcatgttgctgccttatttcccaatgtctccgtttgaactagtgcagggatattttggagactttagcaatgcctagtcagcaagcatcagtgtactttagacattgaaaatcgggttaggaaaaaaaaaatatggactgctttgattttcctttgaagtaatgtcacaagaagaaaacagcaagctggttcatttgccaaggaaggaagagcatgaaagacaaaatgaaatgccagtaactaggtactagaggaaaggagtgctaagaaaatgttcaaaagggatcttgaaaagcaaagatcacttggtagatgaacttgttcaaagtgttcgctaactcacctcttgcaagaacaaactatcttgcaaggctctactgcaacatgtctgatacacagcacctgcagtcaacagactctgtagttgcaaagtattgagttttgtgctcaagctatagaagttaatggactgtcataacattgttcagatgaaacccagcaaagcttaacagactaaggtggattttgcctccccttttaatccagtgctaatttctttgagtaatctcagaaaacttttttatgctaaagtgattcatttataaagttcttgtcaaaacaaccagtgtatttaaaatattttggaattataatacaggacacaaatgaaagaagatatttatactaggcagatgggctaggttatgctgcaataatgaacaaccccaaaatcttagtggttgcaaacaacaaacttttttctcccactcacaatacaggttcatcatagtcagcagggggctccaggaatcataattgctgatatagccacctgacagatcagtaacctcagtgtagctggtggccatgagaaaaggcgataatcatctttcatatcaaatattagaacaatgcaagagaaatatggtgattttactctctatatcaatatcacacacactaacacttggtgtgcattttagaatatcttgctggttcccagtaaatatgtcaactttttgcactatataccgcttgaaatgtcaatactgcacaaatacgcgtagtctgctgacagtaacctgccaggttctagacttccatattgattactgttagcaaaatgtgtaggtgaaatttttgtagggtacgcacgtgaccattcacagaaggcaagaggttctctttggaatttaattttctgtgtgaaaaataaatcacttttttgtgtgtgtggaacatttctcatggaataatgggtcatattaggttaagtttaggaaactgatgtttattgagctgtgcacatatctgctaaaggaatttcacatctataaataaataagcttatttttccatggtgtcagagagataatgagactttcatataaaactatttttgccagctgaaatatcatgattgttattctaatatttcctccacaaagacttagtgaactgcatgtccattttagaaagtaggagtagatattttaattttttcttgcttcttgagaactactatcaacaataaaaaaagctttgattttaacgtgtatatcttaagatttcttttgatcaatactaatgaaaataaacctgaaacgcgaatcattggacaaatgtgagatttttcctttaatttatacattaattgatgtaagatagtatttagaaagtttcaatcctttccagttacaattgtaattgtcacttacctcaaactaaacaaacggactctttcccatatttttctacttggtgaaggacattctaatcatctagatgcctaagtcagaaacctaggcatcatcccttcattctttctgttcctcacagtcacacttaattaattgaacgattttcggtccctacatacttcctgatttcctcccctgtgccctactgcttctctccctaactcagataatgatttctcgactatcctattttaagatcaggctattttgtctccttgcaatgatctctctataacctagtaatatcaagccctaatgaaaagtctttggtcggcttctgtcacccaggataaacgtgaaactcctgagagttggatctacttcctttcagcatctcacccttgcctgcacttctagcctccactctcaaaactctttcacacatcatttgaacctgagacattaaaaatgccttccagggcttggtgcagtggcacacacctgtaatcccagcactttgggaggccaaggccagcagatcacttgagctcaggagttcgagaccagcctgggcaatatgcgaaaccccatctctaccaaaaaaaaaaaaaaaaaaaaaaattgctgggcttggtggttgagcctgtcgtcccagctactcaggaggctgaggtgggaggatcccttgagttcagaagttcaaggctgcagtgagcagagattgagccactgcactccagcataggtgacagagccagagcctgtctcaaaaagaaaataataataataatactgccttccagttcctccaaaataacatgtctttccttggtaaatactcttcttactgctttcagcagacattcaacccacaggtcccaggtcgttgactcattctcatctcttaattgctagccaggcctttgggaagccgttctctagttcctactcagttaggcacccaacctctctgctctcatagcacataggctgtccctctaacatagcatgagtcacacgctttccaaactggtgtttacctgcttgtcttctttactgcattgctccttgaggtagcaaggatgtcttctttattagcttttttatactgagaaaattttaaaatacaggaaaagaaacatgataaaatatatacccacattcctaactcatagaaataactgttgacattttgtcatgttttcttttcttactagagaaagaaaatgagataaaactaacctgcatttctatcctacttttctgcctgtcttagaggcaaacaccaacacaggtttgttgtcaatttccttcccattaaaaatacttttacatacctactgtgtatctatagccaacagatcttatatttatgtggtgtttgcgtttttccaattttagaaatggtttcctacctttcttaacctacgacttctgacaattttatttcaaaattatgccaatatgtatagatctcaaaaacataacattgagtgaatatgccaataggtagaatgtcatgtaaagtttaatttttgtcaattttatgagtgaaaattgtatatcactgttgtttttatttacctttttttaccagtttttttccagttttgttttattattattttattttattttattatactttaagttttagggtacatgtgcacaatgtgcaggttagttacatatgtatacatgtgcctgctggtgtgctgcacccattaactcgtcatttagcattaggtatatctcctaatgctatccctcccccctccccccaccccaccccacaacagtccccagagtgtgatgttccccttcttgtgtccatgtgttctcattgttcaattcccacctatgagtgagaacatgcggtgtttggttttttgtccttgtgatagtttactgagaatgatgatttccagtatcgtccatgtccctacaaaggacaggaactcatcatttttttatggctgcatagtattccatggtgtatatgtgccacattttcttaatccagtctatcattgttgtacatttgggttggttccaagtctttgctattgtgaatagtgccgcaataaacatacgtgtgcatgtgtctttatagcagcatgatttatagtcctttgggtacatacccagtaatgggatggctgggtcaaagggtatttctagttctagatccctgaggaatcgccacactgacttccacaatggttgaactagtttacagtcccaccaacagtgtaaaagtgttcctatttctccatatcctctccagcccctgttgtttcctgactttttaatgattgccattctaactggtgtgagatggtatctcattgtggttttggtttgcatttctctgatggccagtgatggtgagcattttttcatgtgttttttggctgcataaatgtcttctttgatgaataatgagatttaactttttcccattgaccattcacatgttcccaactctgaatttctagtaaattcatgtttttccagagaatgaaagagtgaatggccactgtcttgaggaaatgggagtattctagatgcatagtcaggcagtgtgattagtatagtgcaagaatggtaggaaaggatggagaggacaatgggaaaacaccttgctaaaaagtttggattttgtcttctagtgatagaaatgtactgatggtccctgacatgggtaacagctgctttagagctgaatttcaagaatcagcttgtgaacaatgctttggagattaagacagtaggaaggagaagatttgaagcagtaaagtgatttagaaaactatttcaatggaccagacaagaaatggtaatggcctgaaatgagtggagggagtggaaatgaagtcacatggctgcagttgccatttattggagaaactgaatttcagggatttggatcaggtcaaggtatgttatgcacataaaccaaatattaatgatatttatttagtgtgcaccagtgatatttgttttttccttcgctaaactgaagattaaggcaatcagaacctagtaaacattgctgaattcaccattgtatcccccagtgctaatacacaaaaagtatacaatgaattctactacctacctttcgcagtgtggctatccttgcaaatttcaccctttcccttcctttcagtcattcttgtttccccatgctccatagatcatttagccaccacatctttttgtgttattttgttttctgcaatgatgctggtataattcagaactactagcaaaatctcatctctagcttcatgtgatattttcctgcttataaactacccatattcttgctgtgctatagtcaatatgtgtaactcttctgaggcctcctcattcattgcagatgtttgcaaacttacctctcttcttaagggcccattcgtatgtacttaaataggaagatcatcagagacaagtatccacatgtgaactcccttagctactgttcttttctctaaatttctctttttctctgttcaaaaaatttccaactttcaactttgtggacacttctggaaaaaaagaaagtcgtgtcttaccaattttgcagaattgaattacaagtttctcatactaagacatttttctatggaagaaacaaggttcttttgtagagatgagaatttaaatgatttttttttttttttgcaatgggaagagagatttctcactagtcttactggttttcatctgactttatagtttaaaattgatagccattttgatggcaacacacatggtttagttaaattttactccgtcctcagttttcctgagggagtgtcagctactgtgttttctttacaaaacaacataaattccatgtatccaccctgggaatcacttcactgcgttgaatctggataggaaataaagattcatgaatatttcacaatttactaggaaccatcactttcttgctcttccgtgtggattttctactaattagttacttggtatgtctaagatacgttatttttattatacaaagactgtatcactttttattcctttgatataaatcataatacagtgtctgataagtacagctttttaaaaactcttttcatagactgtcttattctttttagatttatgcccatgatgtgcatggtcctgaatgtggaatgggtctctctgaagaaaagtgggtcagatggttgcttgtgcatattggaaagaaactgatagcttcctggtctcttttgaagggtgctgttgtaaaatacagattagtcaaggtttacagtgctgttactagcctgaacacttcaaaccaccatgcagtttaaaactattcagtgcttatggcaaaattcaggtcttttgatgttggggcaggagtagacattttattggaatgtaaggcaaaaatagagatgaaaacattgaatcatttttggtggggggattgacttaccttaataataattttttatacctttaaatccagaaatgtcaagaaaatgacacacaagaacaaaacaaaagaaaaattcagtttagagcctgcttaaaaatctgacattgatcttccaatgccttaaaaatgtttttattatgaaaaaatttgaacatataaaaaatggaagatatggtataaggaaccctcaagtacacattacttgcttcaataattatcacccatcaactaattttttttttcatctgtaaccctaccaactgttctcctttcccactggaatattttgaagcaaatcatcatatcatataatctgtaatctgcaaatatttaagtatgcatatctaaaagttagaattctttttaaaatcataatctcagtataatgacacactaaaaaatgaacaataattatttcatcccatcaaatattgacaagctattattcttttactatatattggctagaattttatgtaaagaaaagcttttcaccattgactcttatttacctacaggtagaattcaaacaggaaagcagatcaaatacttgattctttctttttatttcccagtttttagaaaaaatgagttggtttactagtatcctttaatgataaccagtttgctttttgtatctctatgaactcatagattttaaatatatttgatatgtttcgattcattgcagttatgattcttttcaataatcaaattgtctcatctttggttggtaagagtgtcttcaacttggctttctagtcctttaaactcagttttccttaatgattctcatgcttttcagtgttaagatgtggtaggattgttttgcatatttcctgtcctggttttagaaacagtcatttcttggaggagccctggttccttatagtgaaaaagggtatttcaagaccacaggtcggtagggctgttcactgttaatatgtaggttgtttctaggtcttttcagtggatcaggtgggaaatatatatttcaaatagagaaaatacattatagtttattctgacatgcccatttaggaatatgaggcttatagttaaattcattaatttcatatttgtatcttttttctcatccactgaaagttttgattcctaataacttatttgctctatcatagctctctatatatcatttcataataataatagaaatattatcatatacaacatagtggctgaaatgactttgaaagatttcttagccacgattttatatttataaagcatcccactaggcatctacaatcaaattacctttttttaaaaaaaaatcacttgaaaaaattattttatggttaagccaccaaacaacttcatttgcttcatttgactttttgcctgaaagtattttaaatatttgttttataatgatgtaaaaacttttacatagtttcaaggtcaaatttgcaaaataagttatattcagagactagactctctagatccattcatcctgttttcttcctcactaatgtgtaaccattttatttagggttatctttccatttgttagaaatattatatatataaatagtttgtttaaacagtccgcttaagaatatttttctagtcttttgctgctacaaataatcttgcaatcagttgttttgtgcacgtgtcttttgctttttgtcattgcatctttaggatagtttgtttttttttttttgttttttttttttttttgaggcagagtctctctctgtcacccaggctggagtgcagtggcaggatctcagctcactgtaaactcttgcttcccaggttcaagtgagtcttctgcttcagcctccctagtagctaagactacaggcgtgtgccccacacctggcttttctttttttcgcatttttggtagagacgggtttcaccattttggcgaggctggtctcaaagtcctgaccttgggatccaaccgcctcggcctcccaaactgctgggattacagttgtgagctaccgtgccctgccaggatagatttctaaaagtgtgattactcagtcaaaaggtaaaagtagataaatttattagatgttgtcaaattcttctttgggagtaatgccattttccaatcctaagatcagcatgtgagaatgtgttctgtttccataggttctccaacaaattatattgccaaactttatgttccaaagctttgtggggatatgtctggtagttgattggggcagagaaaatgagaaaaacttagtatgaagaaaagagtcttaggcttgaaattaagacacaggtttaattcttgaccattgctgatcacttgtttcaccttagacaagtcagccaacttttttcatctgctccacagatctgtggtaaggattaaatgagatgacatccatgaaacatatgacagaataccttgccatagtggctactcagcatgtaagttttttgtttgtttctttgagacagagtctccctctgtcaccaggctggagtgcagtggcgagatctctgctcactgcaacctctgcctgctggattcaagtgattctcctcccaaatagctgggattacaggcatccggcaccaggcccagctaattttttgtatttttagtagagacggggtttcaccatgttggccaggctggtctcgaactcctgacctcgggtaatctgctcgtcttggcctcccaaagtgctgggattataggcatgaaccactgtgcccggcctagcatgtagtttttaaaaggcaaagcaattgaaatttgtaaagcatttggatatctacaaaagttatttgacgagaacatacaaggggacatctcttatggactggtaattttaggattgtctacttgatgttaactaaatatccttcctaatgccaaaccaacacatggggtaagaataagtgatgctggactaaaaaaaaaatttgatttctctatcaaatgtacttttaggtaaaaaaaaatatgcaaagtataaaatatttgtatgggcaaatgttttactaagggtgtttgggttattttctattgaacaaaacctgctaaaccagcataagatgcactgaactaaagtgcagcagagatgctactgtcagcaagagaaggattcaaagagaggaagcccaatccgagcattacctggacaattaaacagtcagttattgggattttcacaattcttagcttttttaactttcacaattcttagcttttttaactttgagttttaaaaatcatgatggagagaaatttagttcttaacttttattttctgggcttgatgaagattgaatttcatcagagatgagctaaacaaattaaaactgaagcatttaatttagaaaactcaaatttcttcagcctaaaattgttcatttaaacaagtttgttagattctcaaattaataggatactgaataaatatgaaattattctttcctggaaagttaaatggaaaaacaggacagaatcgctattttataactaatacatattaagtcaagaaatagtaaaggattatttgtcttcaagaaaacatcctgtaaagaatggcaatgttggtggtatatagatgtaaaatgcttaaaaagaatgattatctagaagatgttatacatgttataattatctttaagtctgccttctctaattctgtaagttaaacacaaatattgatactttaatttttaaaatatttttaaaagtagctgaaaatggggctccatccttcaaagttctaacaatacaatttatagtaaagaatatgtatgagaaacatttgttcttagaagttcagaaaaatcaaatatataatatgaagatagaataatgtagagaagttaaagaggagaaaggggtgactgattctgaatcaagtgagttttagcttcttttaagtgaaatcatgcatgctcctcacatatgctaatgtataaaacatcaatttatagaatagtatttgaattacctgcctaggctttgcaagcctagacctttgaatttgcattcaaattcttgatgtacattttctagctgggggactagaaagcaagacactttcctttcagtaccttgggctccccatctattaagtggagatcattaaaatctgccttgcaccgctgtcctaaggatttgagataaagcatacaaagggcttggcacatagtaggtgctcctaaatggtaactttattcttcacatcaggctttgcttatacttataaaagccagttttgtagataatttgctgaatagaactaagaatagttataaatattgggttagtttatttgagctgctatgataacataccataaactggatggattataagcaaagataatttatttctcacagtctggaggctgggaagtccaagaccacagcagtggcaaattcagtgtccagtgagtacctgctttcctgtttatagacagcacgttttttttctgtagcctcgcatgatgaaagggagcaagagggacctctttcagacgctggtcacctccctaaagccccacctcctgatatcctcacattggagattaggtttcaacatatgaattttagggggacacaaacattcataacatagaaaatacatattattttaaaatgctttcttattctttattatgaccactattaaaaccaaacagaaaactgtagaactagccaaggtatcttacagagatatgtttcagaggagtgtttattagattctgttgtatacactatttgtttagctttttctgttttttaggtcctcggcctatgctattacagaaagaatattactctcttttgtatttactattggtttcctgagggaagcaattattttaattattgattatttatggtttaatggggaaccattgtattctaactcacaggaataaaacaataacaaataggatgcatgcaaaatatctcataaatgtgtacctaacaaataaaacatacatcttcaaatacgaatatgcatttagagcctggcttgctgtctgaggtcttaacttgttctgtgcttcaactccctattataatggatgctacacatggaagctcttgggtcaccattggaggtaatagcgccctatagagttttgtgtctgggaagaagtggactttgtagttaggcgattaaatatttaccagcttgccttaagccaagtacatgttaaaggactattttgtattattattttgtttttaaataggcccctttctctcatatttatcttgccttaattagggagtttattgtttattaaaaagctttaatctgaactactttcattgtgtgggtgtgtgtgtgtgctgtttgaaacaaatgaactaaaaatgtttttaattgagctgcaagtgaagacttgtcaatacataaattatacagtattatatatctctatatatgcataaagaggatattttaatcagcacatgtccctgtatttaaaagttaaaagaaccgctctacagagctaagaatacaggtattttaattttttaaatgattataacgggggaaattccactgttgtttctttagtgtttgatgagggattgtaatctaatcagtttaaacgactataaacacagcgatgatcatttaagttggattttgattcgaaaagtaagttcttggaatttagggtattgcacaatctgtcccatacaggggaaaaaaaaatcacctacttgtgatttttactaatttttttccgtgagaatagaatcctgctgggaagcttattttattctcttagatttgcttcctcctttttttccccctccggagaacgatgactggtttacaaatagcaatttatatcaactgacacagtcctttttccttatactgttgatctcagaactgttctgcagtcctgaagtatgaaacactattgccattttttggtacagccagtgctctaaaaaatgtaaatggatgaaagcgattcaatctattatggaagcagaaacatcttcctatttgctttacaaatttttccgagtaaaatgcagtcaggtttgtaacattgcataaaaacttgttttagaattctttacactaaattaaagatgataaagcaatctgcttttcatactaaacagtgaagtgaaaagcattattttaaagaaatatttctgttttgttagtgtacgaaattctgtaatagtggctaacttctttaggaacctttttaggtgaaacttatgattgactatgaaatctattctaggacaaaataaaatgagaatagaattatatgtctaattaaatgatatatctaggcaaactaaccattcaagttttaatttttatgaaaactttctatgtgcccctgacatctgtacatgtgtttaatttccagtgagctcaaaatacttcaagtgatctcatttgagtattaactagggaaatacattcacagtccagcaattttcttttatgtctacattattttaaatcatagcatagattttccactgtgctttatgaccagaacacatttatttgcaaagtattttcacttaccttatattgtagtatgtagtataggacaattgatacggtcaactgtttaaaacgtcagatgcaatgatagagccttagcatttatagatgtagcattcacagttgcaactctttcagtttcagacatttgtgaggaatctcataggtgtgtaatatggtttgaaatttgtgaggacagcaattcgtgctctgactctagtcattggcggccagtgagcaagcgcaactgatcacccagtatcaacttcacaatgtggtttccactaatcggcaccttatattaatttttatgaaataataaaaaccttatttcatagcaggagcgggtacccaaaaagtagttaaatggctaatcctttacagtttttatgtttttggaaatttgtgatctcaagactatccctcaagaatgtcaaggttttgctgaagttaaagacatttgttattctgtggtcagattatttcagtagttgagatgtagtctcacattaagggagaaatctgcaaactagaaatggtttgcaaatggcaaggcaaagcattcaaataactgttacatgtgataaaaatctcttttgggtttcaggatgacaaggtacagggcccagggactggcatttaaagagaactcctatacacacacttaaattcaacaaaaaagtctgtattctataatatccaattaccttaattgtgtagtggggaaaatgaagagttgaatttctggttagctagactagggtaggaagacaccagctctttgtttgttttgtgctttgacatttcaattttcccgcttggctttgtccttctgtcttcccttgacattgatgattttgttgtaggtacgtcacctccttgaatctactgatatgaagagaaagctataactaaagttaagacaatgttaaagtaaggtccaattctcagttatctacagggctatccaaaagaaaaatggaaatttcatttaaaatagctgcatcttttaagtaggaatattttgggctattatatgccagactcatcactggtgctatttaatttctcctcccatcaatgagagctctccctgagacacattgtgagatctttctgaggatgaaatcacttaaccccagcaacgccactgattattttcagctacaacaaccacacttctatgcacacacatcaatcacgccaaaaaacattctgactaaaaagctcaaaagaaaataattaagcattctcttttccatatgaagatattactgaccagcagaaagtggaaaaatgtatacataatgtttatagatactgacttaacaatgagtgaacagttgcgtctcacaaatttcagcagcgttgtcttgacagtggatcatggtgcttctgtgttgctaggcaacccgaggggatggaaaatttaaactcaaatttacttatgtatgttagattttagacatattatattgagagtgtattacacatgtcattacaggctagttgtacatttctattctgtcttttatgtgagtttctcagtatatacatgaaagacactctgcctgtatccttgctcctctatttttgaaaattaacatagtcctaatatgcatttttatggttgacagtcgtggtatatgagagaaaatatgtagcctttgatgtaaaaagattgtttttaaaaaaacataaactttacaatatatgcttgtgtgtgtcagtcagagggggaggtggagagaggcagtgtttctgaaacaagagatctatgaaagaagggaacagtctgttagttccacctggttcttctcatttaattactataattaatatatgcagaagaaaaattaatagggttcttaaatccagggagatattaaatgtcaaaaatgtggatatttgaattaaagactaatcaacttgaacaatacattataatgttaaagaactggtagcatattaatttcaagtgagagttttaaacttgataactgcagtggttttgtgaatccaattttaagagttaaatgttgtgtcaatgccatgaatcagagaatagatatttataacaaaagatctgtatgaaatgatgcataatagatggtgatggctgaagctgctgaaaattgatggtctaaatcaaaaggatggattaggaatctttgcggaattattacagacctgtagttttgtgagaaaagcagagaatgtcaaggtcttttacttcaaggaggatttgaagtatttgggggtatacattattgcattagcttagtcagtttacagctagctagacagtgcaaacttgtgaaggaggatgttttcagtatatcacactaggatcatggcaccagtcctgaagaaatagggggaacttttgatctccatcataccatatacacacctatgtgtgggaatgctaatgggatagaatctgatacagttagggtctgaaacactacgagttcttatggtactttgattcaatatttagttgagtaattcttgttcacttatttgtattatcctcattagattgaacctgtataggtttatctttgaaactaaagattaaattgaatttaagttctactgtattttttatcaagattatttttaaaatagcttgtatcacaggaatcctgagtacatacctaatactatcctctactgtatagaaatttagtaataatgaaaaagtatactcctggatttggttttctgggcagagaaaattaaaaactttaagcaggtatcatgtagaataacatactcaacagatattattttgtgggtgacaatttttatagacattatatgtcagatgaaatagctaattaacattaattctattatatttaacataacaccctatatacctcggtgaataaagaagatttctaaaggatgagtttaagaggtattgataaggaccagatatttagtaaagaaatcccatgattccctagatttgtgactcttcagtgacacatttaattagttaatgctttgtgaatcccagaattctttgtatatactgtgatataccatatttttgtcatagtaacaacaatttaattctgattctcctatagatgaatctctgcgttctatctttcatgctactttgaattcggtttttaaaactgaatttaaatatcacagtacttatcatatgatattcaacaacctgactgttttccattttattttattttatcaacttttattttagaatcagggagtacatgtgcaggtatatatcacacaagatatattgtgtgatgctgaggtttggagtacaaatgaatctgtcattcaggtagtgggtatagtacctgataggcagttttgttttgagacaaagtctcactctgtaacccaggctggagtgcagtggcacgatctcggctcactgcaacctccacctcctgggttcaagcacttctcctgcttcagcctccatagtagctgggattacaggtgcctgccaccacgcctggataacttttttgtatttttagtagagacagggtttcgccgtgttggccgggctggtcttgaactcctgacctcaggtgatccgcctgccttggccttccaaagtgctgggattacaggcatgaaccaccgcacctggccccagtaggtggtttaaaccctttctccttctctctctcccctctgttgtattgcccagtgtctgttgttcccacttttatgaccttatatttttcttctttaaatcagtaattttttatgttgttaaaatcaatttttgcagagattagaatgtatttggcctaatttctcattcttaagtaaaacaaaataaggacataatttatagacttgacatatactgattttttggtatagatcactaaataagtactgaacttttttctttaggacgtttagagtttttgacaggtatatagtcaagccctgctctcttttacttcctttttattctctctgatgatttgtatatgaattcattctttattgatagtatcaacatgacaaaacatacaaggcctttgtcctaatggatcttataaatctaatgcaggaggcagacagtaactaaacaatataattgtatatgcggtaagtgctatgaaggaattaaacaaggtgacacaacagaaagtagttgtgtcgggcaattttagataaaatggcgagtgaatgctgtgcatggaggtgacatcttgccagagacaggagaatgagaaagagtttggcatgtgaagatcggggaaatgagcacatggggcagagggagggaaatgtgaaaaggcatgatggtggggagtgtttgaggggtgagagaaactatcatcagagtaacaggcaacctacagaatgggagaaaatttttgcaatctatccatctgacaaagggctaatacccagaatctacaaggaacataaacaaattcacaagaaaaagcaaccccatcgaaaagtgggcaaaggatatgaacagacacttctcaaaagaagacatttatgtggccaacaaacatatgaaaaaaagctcaccatcactggtaattagagaaatgcaaatcaaaacgacaatgagataccaactcatgccagttagaatggcgatcattaaaatgtcaggaaacaacagatgctggagaggatgtggagaaataggaatgcttttacactgttagtgtgaatgtaaattagttcagacattctggaagacagtgtggtgattcctcaaggatctagaaccggaaataccatttgacccagccatcccattactgggtatttatccaaaggattataaatcattctactataaagacacatgcacacgtatgtttactgcagcactattcacaatagcaaagacttggaaccaacccaaatgcctatcaatgatagactggataaagaaaatgtggcacatatacaccatggaacactaggcagccgtgaaaaaggatgagttcatgtcctttgcagggacatggatgaagctggaaaccatcattctcagcaaactaacagaggaacagaaaaccaaacactgcatgttctcactcataagtgggtgttgaacagtgagaacatatggacggacacagggaggagaacatcacacactggggcctgttgggggaggggtgggaggcaaggggagggatagcattaggagaaatacctaatgtagatgatgggttgatggctgcagcaaaccaccatggcacatgtattcctatgtaacaaacctgcacattttgcacatgtatcccagaacttaaagtagaaagaaagaaagagaaaagaagaaagaaagaaacaaagagagagagagaaagaaagagaaagaaagaaagaaagaacgaaagaaagaaagagagagagagaaaggaagagagggagggagggaggggatggccaatgtgactagagtgaagtaagagaggggaagaatagtattagtcaaagttgaaattgaagacacaaactggctattcaagactttatgcctgtgatgtggccaggcatggtggctcacacctgtaattccagcactttcggaggctgaggcaggtggatcacttgaggtcaggggttccagaccagcctggcaaacatggtgaaaccctgtctctaccaaaaatgcaaaaattggccaggcatggtggcacatgcctatactcccagctactcgggaggctgaggtaggagaatcacttgaacctggaaggcagaggctgcagtgagccaagattgcaccattgcactccagcctggccaacagagcgagactctgtctcaaaagaaaaaaaaagtttatacctgtaatgagatgagaagttcagattttccagtgtgtgttgtataaatgaaggacccaattttctcagacagaagataaaaggagttgaggttcgtaacgaggtgattttaaggatggatcatagaatcatcaagccaggaaggagagagtgaaatcaaggagaaggtgatggataggagaaaggaccctgagttattataacagagtccaagagtcagagagctgcacagatggggtgggatatgccaggtcaaggaaagggccatgggagtgggtgcctgatgcggagaggaggaaaagaggtcagcgaggaggtaaagagcctgggcacagtcatgttggtagattttacagttacataaggagaggtaggaaggaagatggcgaaccagaaagtaagtcattaataatggctggaaggtggttttatgagggatgtggattttcagagagaaagagaaaactgattaagaagtagcatcaaagaggagcaaagttgatgcacaacctatctctagatcttgaaggtcttatagaatattgtttctaagtcagaagtatgatgacagggggaggagccaagatggccgaataggaacagctccgctctacagctcccagtgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagtacgcagctggagatctgagaatgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatgaaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcatcatgacaggatcaaattcacacataacaatattaactttaaatataaatggactaaattctgcaattaaaagacacaaactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgacaaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaaacattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaataaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtacaaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataataaaaaaaaaaaaaaaaaaaaaaaagaagtatgatgacaaatggtcattttccttaaaataaaatcatatatcactacttactgacttgcacctatatgtacttctgggaaatttagccagcatgtatttccacaatacagggatagtttttgttctgtggactgctaaatgatcacagcctaatgtattgccttctcagtaaacacacgttgacttaaatcagttgggtaaattgtaaactcaattccttactttgactttagtttgcaaattaagaatagtgtacttttcttattttcaggccttatttataattcctaatgctatacactattatgttacagcttgcacttgtattttgacactttctaattattgtcaaattataaatactactaattaatatatccttgattcttcataatattctattaaccagcacttaacacctttttcataaaacacttttcaggatatatatatagttagggcttgttgacactatttcatcttgatttcaatttatgcaatccgaattttcaagtaaaacctcatggaattatcagattcatcactaactttcaaaacttttataacacatctgctgagttttcagacattcattctggaaagaaaaaacatgctggaaagaaaaattttacttactctaatgtgttttattttaaataaaaagtcctataggttatgattttactgtcctctttttttttctgaaaaacattaaggtttctttcccaaagcttattagttaattgtcagtttttatgtaagcccatgaggttagacctatataaggcagtaatttttaattctccctctcttcccacccttccttttcttccctatctcctttattttcttccttcttctttattagtttttaaatatgcatatctctttttataggagaaaggatggataatgattgcagcattctctgaccactctaatatctcaccctagaaattttaataaatgatttactaacattctcatcaggctttttattataaaataatatcaaagaaaacctgctttttaaaaaaatatcttgatacttgtattttaccaaattcatgggtatagataactttttgatttctcattactttcaagtatcttcttcatgtaaaattttaatcaaatttcagatcccatgcttaacacataaaaattaataaattgatgttgagggactatcacattattttatactgaaaagttgttcaattattctaaagttctatatattaatccaaagccgtctctacttgggggaaaaatgtgtgtgtgtgtgtgtatgtgtgtgtataattttttggatctatctatctatgaggatgactgccttattacaagtttcagtacaatttatatatatggattatatctacatatatattttttggttatatatatttttatatatataaacgcttggccattttgtctatttacctatctacctataaacttcagcattttttgtttgggtaattaatattttgaagttttctctcttgttttccttcttgtttggaatgatctgtttgagactgtgtttttaacaaaagtatatgtaagtttgatatacttaaccttatttttcgctaaacaacaacaagaaagaccccctaattttgaaaagtgtccatcaatatcactgtttggcagtttatcataaagattcaatcagtatacagtaaatctataattgaataaataatgttagaagcaaatatcacaggctaggatcagcttaagaaatctccaaaatgtgagcctacataattgagaccaagtgacatttcatttggtgttaacatatactatgtaaaaatggtattatattttcagtgttttaatggaaattttaacatgctttctgatagtttaatatcttttaacttgtgccaatagattgttttagcaagaaatgagtgataatcttaattttattttcttttacccgattcaaacattcttgccttgatcttagaggctggagaataggcagcatgacctctcatctcttccgttctttcctcagccttagtgaagggtgtcccattcacccatttatccacaccatgagccatactgtggatcatccactcagccaccaactcctgcaggtgctgcctctttccaattttacagccactgccttcattcagaatctaaatatttctgcccttgatttctgaactgcctctgcagttagtcttctgctgccctctcctcattcctttcatctgtcattcctgcttaatactctcctagggctctccatcgtgtccagtataaaatcgtactgaaacttgtaatcaggaagacatcccctttgtaatcagatctccatcaccagtccaacttggtctttgacctcttctcactgacattttatgctcctgtcatgctggactctgcagttgctgggcagtgtacccgcatgctttcctgcaggctatcccatctgactctcttctcctaaacctcaccatatttgcatgggtaacatgtcctcaccttttaagaatttcctgaagctctccctgacatcctgattcctgaacaaccacccctttgtgctcacaaaggtctttgtagttacattatttatcatacagtgtttccactgaaagtttaagtgcctgttccccatcgtggctcctgagtagctatgcagagggcgtaggggaagcaatctggtgaaactgggccaaggagacttgtctctaagctacattggcagagcaatgttttacttagattatatctatttaagatggatttagggaggctcagggagattattggagagaggggaaatatgagagaccctaagcacctcttggcagcactgctgtgtttcctctactgtggagtgagctcctggaaaacagggactctgtctgtcatctgtgtgtttcctgagcaccacatagtgtgtgccagatagattgtatgcctgctacatagtaggctcttaataaataagaagtgaattgaggattctagatgctattcatcttcccatattaaattgctttcaaaatgtaaatcctctgtggcactgaagtctatttaaaatatgctcttctgccaaataaaatgtctcctccaggtgatttgaggaagacatgtgggctcaaataagattaaaccaaaccattgtcatgtacatgtaaatattgcatgagtaactagtcttacattttcttcactaatggggatttattctaaggaacttttttgttcagtattttctgatgaaggaatagtcagaaatatcaaaatccttcttactccattttaggctgccatttttttcctaagagctgttatacattgagcatacctaaattgcctttctgaaatacaggaacacactgtattgtcagtaaaatggtctgtgttgattagtttgtctttggggtgtacttgattcatcagatgatggagatcctgctggcgtttcatgcaacctgctatggtatgtgggctttattggcttcccagcagcgacactgacacaaattgtcagattttatgggcagttttaaacctaatgaaatacatccttgagaagcttccttcaccattttagtagctgtacaatttgaaagaaaaaagtcaatgtacaccacacagggtagttcactattgaaatcatggaggacaatgacaacacgcttattttgctcttgaacatgctgtcattaactgcacaatgggatactgatgctgcctcagaggctggtattaatctttgtgccaaaccttgcagaaactctgtgtgcatttactgacgtaagcattgctctccatctctttgatcttaagattactcctttggggatagaaggtaatataaggctgctgaacttaaaaaaaaaatgctcaaagtgagtgaaggtaagagatgttcattttcttccagtactgaaaattaagagtacagacccacatgctattatacaagagaaagtagtcctatgactgctggataatttacatacattatctaatttatcataaccctgggagagtggaaatattgctattcttattttactagtgagagactaagtgatttgctggtttttgatcccgggtctacatgaatacaaagctacatctttaattagttctctatagggtctcaaagcagtcattttactaaatttttgatctttattaaacatagatgcaaaagtaataataatatttccacaaataaagggatgttaaccaaaattaatgttcaagaatcctttcagtgtttctctacctctttaaatattccagaaatggtgatacagtcaggagcaatatattgccaggaactttggcaggacgagagattactttttggatagaatcagttgcaggaattttccaaacgattcacacagcatcaacttaatcttctggaaaacattttagggaccacaaatacatattgtacccaggatgtagtgtacttactgcagtgtggtctatgatttttcttggcatgcataattcaaagacccagatagaaatgactgattttagcacttctaacaataaaacaaaagctcttctacaagagaatatcttcattcatgttaaacatatcaatatctcaagtaagtatgatgaattttgagatagggatcatgccattggggtctcatctggtggtcatggggaaatggtcctctttcttggatatctttggagagtatactatttgactctttagtcaaactgaggatcagtattttaaaagtctataaaatacttaagccatcttgtagaaataaatagtcttcccacccagaccataatctctgaaataattattaggaattttctttttctttcaaacactttggaattataatttagattctttaaaaactgagttttatgactgttttttcaaaaaagcttcaaaattttggcaaatgttgcatttttttttccaattaggataagtaattcaaaaagtcacaacatgcttcagccaaaaatccattgtgaaaatagaaattagaaatgatctttcaaaaaattaagaaatcattttttgaaaaagtgtggagtcattaattaagtgtttgaccttttgtgccttctcaaatgtccattttcaaaaagacagatgcagttagaaggaaaagactatgaatgtaggttcagggccagaggacaaaaactgttgaaattgccttgatatagattcatagattgcaaatgagcactttttaaaatttaaacccttgaatatggtatctcaggcacagagtgagttctttatatatacaaaatgtgattcttaccgcctaccagctgtcttccgatttcaccagatgaccttccctataagtttgacacgtaactcataaaatgcatggctctggagaacaattatcatgacgggagtatgctttcttgattatatggcaggatcctctttcccacctctgcttttgaaggatattaaaggtgagattaaaaatgctccagttgttctgcttgtctgattgtaacagtgaaggagacaaaattgattctagcttatggctcagtgtttcaatgttattctgcagcacttgtttgccagcagctgttagggattattgcaggtttctttgtcaggaacagtgtggcaacaataataaatcagatttagactggctactgaaggggtttgtttaaaagatttaaaaatctcttcagagtcaaagatgttaattctacctggtgaaccagaatgatcctgcatatatcttgggacagacttatattttctaaatctgggtaatgatcatacatgcactgaaaagaagaccatcttctcccagaaatatacaacactgaaagattctctaccaaacatgcatgaaaagatagcaaaggtacaatatttctttaatttgtttctttcctctttcgtttaggtgaaatagaggatacagctctgatcattagaatttcatatggcaaacgctcacacacatagtggatttgaggaaatcaattttcactaatctagaaaattctctcctcaagagaaaagggatttaaaaactttcatgatgtatttaaattcaacatatcttttgcctactttaaatagggaaaaggtgactctaaggtcataacgtgaaattgactttacccttcctggtatagaatggcatttcacattgagaaaaactagggagaagcactgaagaattaatgggcagtggggagagaaatgtagttcattactttattatttgtcgtggtaacacatactttatacaatctatcactcctacttgtccaaatatgtgtttctcctgaggtaaaatttcaaaaattctagatgatgttttggaggttctgtagagaaggtgaatggtatagagctaaagcaaatcttgtatgatttttttatttaatatgtttacttcctatacctatgtctttactgtgtatacatatacacccatatccctatatattcgcgtgttcacttttgatttcaaattttatttgtgaaaaaagcagatttattcttttttttctttgagatggagtctcgctctgtcaccccctggctggagtgcagtggcttgatcttggctcactgcaacctcagcctcccaggttcaagtaattctcctgcctcagcctcccgagtagctgggactagatttattcttaatcccatttatccatgtggagaatatgtcaccctgctcatttcactttgcaaaccgacttactattctttgtacctctctccttctctttttgctctgtcactaatagagctttcagctactaagacacacaggagtcctttctagagagtaactgaaattaaccacatacatcattttggtggcaaacctcacagccaccagtcatttatagtaccaagtccctgctctttgggtaacagtggataagaaatgctacacaagctccttatgtggagaaaagactgttctcctatttggaagccttgtgcccatatccatgccctttgcacatttatcaaataaccgtgacttgtcctttatgttttttcaagcatttgtatcattaggcaaggctctgcctaatggaagagatttactcttactctgtgcccaggtggctcgtccatctctgggtattttcaagcattggaggtggcaatagtgtgcttagcctcaagactgagcaaagaaatgaactttccagagattactcttaaaatatcccattctgagagcacatgtttctcttagtactgtttactccggactttcagggtcagtaggcaagcttttcaacaaatttggtttcttttaaaaactatttttggtagttttgttaaatgtgtctggtaattcattttaagtggaaaagggatggagataaagggtaggtagaattgtaaatgtcctaagcctcttttatcatcctatgtttttgataagttttatctggtaacagacaaacattgtagaagcaagaaggggtttaatgttgttaaataaagaaaatgtattaaaagagaaaaacgaggcactgggctcttctactcttgtttatattcttcacccttgtgttccttctactcaggactccattgtaaatgctcaggattaatttttttgtcatttgatgcagttctatactgtaccttgtctttctgcaaagcaaagataatattgtagtttaaaacttggctatccaccaccatgagggaatatgcttctcttatttttctgcagaaacatttaaaatttcttcagctatattttgtacttacctgaattttaaaaatagaatatagataatacatttccctatttttgtgactcactcactgttattaatagttatttttctaatttgaatattatgctttgttaagttatttagaaccacttaccccatctgtaaataaccccgaactcctatactgtcatcacctttgtttcttctaacatgttgtaatgtaaaatcaaaattattaagttataattatttatgatataagaagtattctgtggataaagtatacatttattttggatatttagaataatttttgtttgtttttggcataattcctttttcttgactatttacaggaaatagctagttataggttttacctaagtctcattcaagctaatggattatgcaaataaagtttgctcactgaaggacaagaatattctgtatcttttttctggttcttcaaggtgatagttcataaagaatatgttccattgacaaagttagttatgttttttagcttattaaactaatttaaggacaaagaagagaaaataattttcaaacccactgtgcttggccctcactaattatgtttttgcctgtgagatacggattttggaggctgtatttgcaataagtgacacatacacaatttataaatgataaaatataaaatatttgtcttaaatagggagatgctgtaatgtctctttcccctcttcaacgtatcatattacagtgattcctcaatgagcagctgaatttccacctgttcttgacgtattacctatcaccatcaggctatgttatgaaactcacttttagagataaagcaaattgtccaaatgtcaccaattattgaatctaaatgtgggcatacaggttttatttgaagcagtctttcagcttttctatatgattacatttttatttaaaaattttgaataggctgggtgtggtggctcacgcctgtaatcccagcactttgggaggctgaggcgggcggatcacgaggtcaggagatcgagaccatcctggctaccacggtgaaaccccgtctctactaaaaatccaaaaaaaattagcccggcgtggtggcgggcgcctgtagtcccagctactcgggaggctgaggcaggagaatggcgggaacccgggaggcggagcctgcagggagccgagatcgcgccactgcagtccggcctgggcgaaagagagagactccatctcaaaaaaaaaaaaattttttttgaataaatagaataatgtgatagcaaatggctagacagctattaaggtggtcaaggaaaacccactaaaagaaaccagcatagtattttgtatgagcatagaaggtgtgggttagagaaatccaatgtctctattttagaaagaaatgtcatcaaggtggacagggaccagaacatgtagcactttgtaagccacgaaaggcattttcattttattcttgtagattttaagtagagatgcagctttcttctcacatattttagaaatatttatttggttaccatatagagccagttctcatatagagaatttattctctatatgagaatagagaataaatttggtgcaagaaataaatatcgggtgcaagatctaaaataggaagacaggttatgaggctgttggatccccattataatggcagcttggatgagataggtttcatgaaaatgggaaaaagcagacatgtgtgggatgttttaggcagctggaatcaatagtacttattaatggcccagaggtctgggtagtaaaggaaagaggagaaactttagataaggcagttagagaaggaaaatcaaggatagattctagatttttgtcttgagcaactgcatggatggtgatgtcattgaatgtgatggaatagatcgggaggggtgcaagatttttcatggagggaaggccagagaagaaacagttctgctatagccatactgaattttaggcaccttttagacatctaaatagaactattgatttaatatttggatatgtaagtctcatctgtatgccatctgttctggctatcttacattcggatcctgtgtattttttacactggcctggaaaagctggcaaaacctagaactgcatttgtcccctctgcgtttataccatttcagttgacaggtctaattttaagttccaccttttcataattgattattcatttgtacacaagtatttgttgagtaccagaaatagcatttagtcatttcaagctttagtttttcatcatcctattctccagatttcagcagcatcagaagccatataaacactgccttcggatggcccttagatggccaccaagatcccctagttacattttctgtgtacaaagcagaagaaagatgtccttcattctgtacacagtgtgctacactgtggtttagtttattattaaagagcataattaaaagaaaaaatatgctatttaggtttggattactaattttaagtttaaatgcctttatatcatatttctttgaagctagacatgtattcaaacctcagctcccccaataattagatatttgaacatggtggaaatagtgaacctatcatctttaaaacaaaggatataaaatctaatagagtggataacatgattataataaagatataaagattataaaatattaaaagttcaatattgtcattagactctaatcaataatgagtatatcacgtattatattttgacatgaagaactatttagccttagagctttgaaatataactaagaaatctattaaaataaattaaatagaatatattccaaagtaactaatgttttcccatattaactcagaataactttgtctgaaattaaactgaatatatatcatttatagatacaagcatagagtttaaattcaggtaatcttatttggatgtacaaaccgtgaatagagacattaaggaaaagtagtcataattaattatatcgaatcttcagagttcacaccattcctcttcctaaaaacacatacaggtttaggctgatcaagatatcaatgtctgctctgagatcatcaaagtaatgcgtccattctaagaagcactagtggcatatatgatcacggtagaagagcaagaaaaggagccctcacttagaaccccataagacaggaaagatacagcatcaacctctcctctccagtttatctgtgttatggattgtaagagtgttttgaaataatattttacttagtaaagtaatatccacaagcatttcaccatgaaaaacattaaacattttaagtatataatatgaaatataccatctctgatgattatttttattgaccatattcttgccaactctaaggtactctaacactagaattttaaacttgttatatttgttactttggtacgaatgtcaaagaaaggtattacctgtaagtattagagcattcctcattgttcctaaacaaagaatttctttttatgtagtctgcactaggaattggaaatgatgcacataaaatacagctttttaatctgtgagattgtttatgcatcttaggtttgcttagttttgcaaatgcgtgcatttaaaatcaccatttgtattttgaactcttctggcttttaactgtagtggaaatttggattgaagacaatggaaaccgtgaggtacaatatataaacttgcatccaaccgagaaaaaccactactcttatctgcacttcaatcagcaggaggttctttttcagtttgtttagaaaaagtagggcctgtcatctgcatggcatacaatctttacaaagaaattttcttttgccctttgtgttttaactactgagtgctgcagaaacttctgtctaactgcaaaacagtttaaggtatcatctatgacaatgttaaaagtaaaacccaatcaaagtttatattatcatgcataatagaccaagcaccattatctgaataccaaacggggccaaataattctctatgattcagatgagacataaaagtgctttaaaaacaagtatgtggtaaaaatcactttggaaaacctttggcattatctaatgaaattaatatgtgcctactctatgatgttgcaattcaacttgtaagcatatactcaagagaaataggtgcacatgtgtacaaagacatattcaagaatgctcataacagcactattaataatatctaaagctggaaataaccaaatgacatcgctattggcatgaataaatatttcatagtatcataatattaggaatactataaagcagtaaaaatgaacaaacaactgttatacccaacagcacgggtgaacccttaaacataatcttaaggaaaagaaattagacataaaagagtatacagtgcctgattccattcatataacattcaaaaatagatgcaattcaactttcatgctagatagaagtcaggatactagttatctttggaaagggtagagatagggaggattcttagtatgggcaatattctcttttgatctatatgatggttacataggtttttatatgtaggttattaaaataatatactgataatatgatcatacattgaggtttttatttattacaataagttgagattattcaaaggtacatttgttcatttttctatacatatatacattatatattacatatacatatatataccaatttttaaaatgttctaagagaaagaaaagctcaataaataaaaacaccccatttccttgtcactagagatgaattactattatgttcaaatcgtatatacagcatattttttatatatgtatctaaaatatgctgaataagcaaatcaacaactacatctagacttctgcatcgcaaaccagaactacatttaaatgcattttatctcacacttaaagaattaaaataaaactcttttctgaacaatcttccaatatattgaccataagtaaatgtaatatgagtcaattattttaaccgttttgtaactcaatgtctgttggatttatcttgatttttataaagttcagcaattcaatttccacattttcttttgtttctatttttgtgaggcactatagtttttatgtaataaatgttactgatatggcctcctacttagaaaatgttattcatgagagtatattgattttagcaaaatttacatatttacatatgtacatccacaggtttgcatatgtaaaaatatagattatttacttactattgaaaaagtgtattatggaagataaaaggttttcatctctgtcagatacgacaggtgaactttggtaacataaggcctagcaaagttttattgatcttacatatatatatatataaaatggtttttcataatttcatgggatgcatcatccaagagaatgatcacagtgatactaattactgccattgactagccacctgccacatgccagacacatggtgacatggctgatgataacatgtgataggtgtttcccaagagagtccctttaaacaaggtttttttcctgtcttcatattgatgaagtgttttttctaacgccattatttcatttattctatgaaagacaaaattggcattttaaaagtagaacacggtcttttgatacctgtcatctgagatacccaaaggattttttttttaagttagcatcaagggtaaataataacaaatgaagttattttatgttagatcttgtaggtctaaatatatgcacagcaatatttaacatcctgaaatcagaaattttgtttctgatggcatctctttccattatgtgatttgaaacattttagggatattttcctgtctactttgcatggaaaaaactacagactttgtcaaatctagttgccttggaagaagaatgaataagaggagatgtgttaaacaatacaaaatatttttgctatttcaagtttgaattgattttgaaataatagtttcaggctaaataataaactgtctttttaggaaacaaaagaagtattttagaaaaagacattaaaaagactttattaaaatagaggacatgatgatcttgtttgttgctttaagcagtttatgtagtaactttaaggtggtagaaagtgtcaggaaatcaatttgaaggcaaatcttcacatatgaaaagaatcagaaatgttaactcaggtcttaaataaaaaggaagaattaatatgatatattaaaagtgatacgaaagtcaaaggaaagattgatgagacttattaatatgaaatgaggtttcttcaataaatatgtaagtacaaaaaagttaaattgtattaagaaacttgagatttaaaaaaaaaaaaaagcgaagtatttaaactacccctcttgagctcccagccacattcctcttagttgtctaataataacacttcttggctatttcactggatatttctaaatgatagggtcctattcatatatctcaacttgtcaatttttaatatcatcaattgacattccttttttagaaatcatgacttagctacttatactccatcttcagtgcttatccttctaatgtaatactatcataattttatttaaatactatatgtcttttatgacgtaaatattgtctaatactaaaacatctactattccatgtttctgtgttttatcttaagaggttaattttatttgtttatttttcctgggtctttagcttttcttgtattcttgtcctatttgccattattatattattttcccactaacatttcaaaatattagttattctaaatagtctgacttttctttagagttcttcactcaaagtcctctatgttctgcctgaattaggattgattattccctatgcccactgtactgtttttctacattggatctaccttgtcagggatccacaccttcctctttcttggtttactttctcattttgctggagcacatcctcaaatggcttcttaagaaatattacatgggcagtgaattttctgagtccttccagtttaactcattgcaatatacaaaatggcaggcccattcaatttatatacttattccttcaagttttggtaatttatctgcattattattaaataatatattaatatattacttaaaatataaattaaaacataaattccttctaatttctccagtctacttttttgaaactcccatgagtcaaatttttaccttgttgtattggtgattgatattatcatttctctcatattttcagtatttttttgtttctcttttgtgggtgatgccttcaacttttttgtccaagagtcatattaaaactttattttaaaagatttgtatttttccctttttaatattattctatttttcttcttgaatctcttcaaaaatattaattagcagtttgcttttaaaaatattatcagttttttaaataagcatttgtcctccagattttttcccctgtttaatgttgattcttcttttccatgagggactatttacgcaacaatctacataatctttattccctactaacatttaactgtgatatcctaaaatggcctgattgaggaactgattgagatgattaagagctctgtagcagggcgcagtggctcacgcctgtaatcctagcacttctgtgaggctgaggcaggcagatcacctgaggtcaggagttcgagaccagcctggccaacatggcgaaaccctggtctctactaaaagtaccaaaatcagccaggtgtggtggcaggcacctgtaatcccagctactcaggaggctgaggcaggagaattgctaaaaacttgggaggcaagagttgcagtgagctgagatcgcaccactgcactccagcctgggcgacaagagcaagactccatctcaaaaagaaaaaaaaagaaaaaaaaaaaaaaaaagaagtctgtgtatagggcaggacgaaaggtgatttggtagaaagctagctgttttgccaggcagcattaaatgtaagaatgtgcagattttttcctctgggatcctgtcatttctccagaatggtaatctccatacttattcctggaggagaggtggttacaagtattctggggccacaactattcttggccttttgtctacccctgaagtttccatcactggaataaactggacagttagacagattaacatgagaaaaggcatacacattcattacacgcacatgtacctggaaggcaacaaagtatgagacttaaagaggggccagatggttgaaatttagatagcatctggagatacggaaggaaggaaataaggacttaaagtctcttagtaggtggtggcaacaagctgtgggagtgtgaggagaggaactgcatggcaagcaaaggttgtcatatcatgaagataaagtctctaaggtagcaatcctcagaagaacacgtgaaaaggtgtcccaggcgtggtgtcccgggagtttcctctcctgagataggatttaatcttctctagttcatgtagattccagggaaggggttcatgacaattacattccttctggaggaacttcccttagataagggggaacttcagagaaagcctctccctgtgcttgaggagaggcagaggggcgagagatgggagtggaaggcaagtcagagagaacttggttctaaggtggcttctttagtccaaagtgctcagctcctcaaagcgccatactttggagtactattttctgagccctaacagccacaaatggaagaagtattcccctgtacagaaaagtttgcattacttttgtcagattatgtctcttaatataatcacattttatgaataagttttatttcacttaacagatttatttattttttaaaaccacaactttaattcccaagtaactcttagaagtttctcctttttggattttcattttgatgtttagtaggcttaaattccagtgtttaacacaacccccagcttttgagtcacagtttatttcattatagtagacccctgattgccaaattacaatatcttatgaaccgggcaaaatgttgacttatttaggacattatgttacctatttattccaaaatatttcatttgaaaatcagctacattcccatgtagacttttctttatacaaaagttaaaataattacagaaaggtaaattattctgatgctaaaattagcctttcattgatttcaagtagattgtaattggctaggatcaaatacatgctttatgtaatacagtttatttcttaaactgatacagaaagtgcacataattctggaagtaaaaatgttcaaaagctaagaagctctcatgttatttttcttcaatttgctacaaacatatatagagtgtagttattttctagccataagaattagcagaagctttggagagaaaaggtaggagactgaatgccctgagcatccctttgaatagctcaggcaagaagaggtgctattatcccaggaggagactgtaagtgacgtttgtgtaattcaagtatgtcctgcctggataaggacttgtgggtaaggaaacagagtagtaaatagccaaagggaagaaagtcagaaaagcttgctgtgttcctccacttaaatatatgttatttctttagggactgcaggttttacaaagagatgaagactaattcggaatgctacttacctctgtttccaaaagaaaaagactcctccagaatgtggttttaagtaggccatggaccaaaagtaggccacaaggcatggcaggcagctttatgaacttcaaggttctaggaaatttcatccattggagagttctccagtgctttaaacaatattagaaagaaaacagcggtacaaatcaaccatgctagtaaaaatctctcctgcaagacattactgagtggtgaagactaagtggttttgccattgttgttgtattgttggttggatggtttgccttggatatttgcttgcttcttttttgttgatttttagcatataaataaaatttataagcccaacaaaagaaaagaaagcaatctttcaagaggctttaagataacatcatacattttcgaggtttttaaggctgagattctattttgttttacttaaaaggaatgttacaatgctgttaacgtttttgcttattctacatttttgcttattcatgaaactcgggagaaattctgtctattggcaggctctcattgtgtattcatcaccacactaaccactcatttactccgaaattaagtgctcagtgatatgcatgttataaattcattctcagttgcaaaattttcttggtgcttaagaaattgtactttaatcgcttttagccaaaaagtttagcaaaaatagtactttgacatagtactgacagcctgtgcttagattttgataaatgtggacaaaatcaatagatagatgcataaggagtgcccagataaaatcatcatacttcaaaagctttttctaacataactcacagctgtagacttttcctttcaataataagcaaaaacaattttcatagctacaaaccgccgacacaactttctatttaaagaggacttctttgcaggaggcagaataataactcaacaaaataaatagaatctctaatttcaaaatactattatccccaaaagtaatgggaattttaaaaattatttagtgtttccagtttagatatttaagaacaccactcacatctacatgccaaataaattgactccaccctccacccgttatatcagggccccactccatccattgtcttttttcttagttatatcttgatatgtcaccctattagttttttccttgcagcatttcacttgcttcttgctttttttaaacaaaaatttatgcactaccctccctgcatccatgttcctgctgcctcatattcattcattcttcagctggtggcaatcagcattcagtttctctccataaaactgttattaaatccaataagcctttcatttctgaatcaagtgaagatttttctctatctttgctgaattctttatggcatttaacatgtcttttcactccatctttctttggggactctcttccatgacttctaagacaacactttttaattctcttccaccattttaggtttgtctttgtaggtaacctttatagattcttctgtgtaatccttacataccaatgttctgaattccattctgctcctctttttccattccatagagtctgattgtgtacttgcaaacacttccatggtatctatttcaagtgtattttgaaaagtctaacatctaggctttcaacttgatctgttgtactttctgtattctatacctgagtgtcagcaaagacgcctgggagctgtctttgagtcttccttctctcttacctccatatttaatggattaccattctcattgattttaccttcttaatttctcttaaattgattttctttctctatacctaatgttagtacctttccgccatgtttctatctggtttacattgctggaacagcacctgatttgctatcttgttcttagtcttgccatcccaacttagtccattcctctgatgtcttttcctttatacagttatcataccatttatcaatttgcattatatatctgattttatttacttataagtcatgttctttgttagctcattaggtaccaattttatatcaatattatttttctgtttgtcattcagtccatttttgttgttgttgttttggtttggttttagagacgaggcaggtgaataggtatagactgaatgctcctaagctagatgataatgaccaaatgattactgagacagggatgagcgatggtcagtgaaattgaaaggatattttagcagctgctttaacaagtatctgggaaaagtccggtctcttccttgcatttctgaacgttaatttgtattaaaagcagcatgactcagaaattttatataaaactcaaataaaccttagaattggatcttatcgagtattgtgttatacagagaatatggagaatatgtgggataaatgagtcaaatggtatgttaaaaaaaaaagtaggaagcatgatagactcaattcttaattcctagaggaaacagagttatgtccaaggaacatattcaacccaatcactgtacagctgtagctttttcttttctttctttttttttttttttttttttgagacagtctcagtccattgcccaggctggtgtgcaatggcatgatctcagctcactgcaacctctgcctcccaggttaaaacaattctcctgcctcagcctcccaagtagctgggattacaggcacctgccaccatgccagctaatttttattttatttttttgtatttttagtagagacgggacttcaccatgttggccagcctggtctcaaacccctgacctcaggtgatcctcccaccttggcctcccaaagtgctgggattacaggcatgagccaccgtgcctggccaatttttctaaataaattaatatgatgatgataatggtatatccaaatagctacccagtttttgattaggcagaagtatgcttatggtcagtcagagtaaaaagtgagaccagcatggtggcatgcacatgtaatcccagctacttgggaggcggagacaggaggaccctttgagcttaggagtctgaggttatagcacactatgattatgcctatgaatagccactgcactccagcctgggcagtgtagcaagaccctatctctgaaaaaagaatcaaaggccttaagaaatattttatttttacctcagaaaatttaaaaattaacttagagctaaatagtttgggtttcattatgtgtagaaatgaatcttgcaacagtaacagtttcccattacacattataagtgtctgttttgagtaaatttgttgaggagtctaatttagtttgaatcactgggaaaagacacaattgaggttttataaaatgtaaaaaatcaaatgaactctgtacttccacttttttacataaagtacatcttccacttctagttacaaaaaattttttttttctcacttgagtcgtttatctgtagtaagtaaatttgggaaaagtgcaagtattcatatacattgttttgcatttaaaagaaaagtgataatgttcaaacccatgctatttacaaaaatcaaaagctcaaatcatgaattctgtttgtgttaaggatttaaaaaaatagtggcgtgagaatggttattgctcttcaataaagatagagataccacgttttgctttaacatatctagaggcaactttttcatcgatagctttattagtaggtcaaggagaaatcatacctaagtagaaaggtccgtggagaaaagagacaaaccatatcagagttaaaattaaattgaaaaaatttaaatcaaggaaaccattttcacttctttcgatatgatgtgcaaaatcatgcattttaaatgggaaatgggaaatttcatagcttcttagcaatgatgtgagctctgtggtctgggtggatgcagggcatgtgggtgcttttgctcatttaaggaaattgcatttgaaacattctcaatacattatgtagccacaagaaaatttatagtgatttctttttggtggaacaaagtatatgctcttttccagctcaggatccttttccagtcttcctacacttaacagccagtacaaacttagtccatagaacgtatttgttgtgcacagacctgcacaaacacacacacatgcaaggtttcacgaatcaggtatgtattttgtgtatgtgtcaaacttagccatcaactggaatttgtgttttagtttggatgctgatttacctcatcagtaaaatgcccttcacttactctccctagacatagactattttccgtaaaatatgttagtgatttcatatttaatgtgatatggaatagaatgagaggttgtgtgaaattaaaatcatgatatcaattatctttctgtcatgcagaataaaataagtgttttgacaagatataaaaaatatttatggtaattaagtacattcatactgtatcagctaaatttgtagaatattgatttctgtattaaattatgtaacattttaattaaaataaatatattgtcgagttgtgagcagcacagtggtaagaatattttgcatgaagatggttacataaatatgcactaaaattgagtctaactgcaaaaaaatgaatgcagtagctacacatttagaaagaagttctaagaataaagcagtttacaaacaaatagtatatatacatgtatatgctttgttagaagaaagagaatttattgtgagtgggatactttaactctttcagatgttaaggattctatttcccaaataacttcattcatgtaagaagtatatttcatgtgagtcaggttttattctctaggtgttttctaatgtgggaaagtgaaatacaagggtttgaaatggttctggggatgcagtctttcctgtcagattccagcagatgctgatataatttaatattcgtggaagacagggcaaatatagaatagcatcaaattgattttgcagagttttcaagccagatgtcccttggcatttacatggaagaagtctactgtgtaccaagttgcatatttttgtgtgtaagttctcagccatggtatgtagtcattggtgttttgacagccatctgctcagacctttatttctctgttcagccataactaaaattgaacatttttcaaatgttccaggtagtttcaattttaagataacagaaaactagtattcaatggttaaaaagaaaaaaagcaatacctatctttggcttagtaataacccctaaattgaaagttaatttcttataaatagcagtgcaaaatgaacaaactttgagaacagaggcctcaccttattatcaaatgagtttgttttaatcatgtggaaggctctcagctagacactgaggaagttatagaaatgggtaattccaaggtgaatgttccaaggatagctatgtcttatacataacaagcacttcatcattatttgctgaatgaatgcgtatgttagaatccatatgtaatagcttgtccatttgcacatattttcaccccactgatagtttttaatatgtggaggtacacatacatatctctgtgttttttgtgggtgagatatgtaggctaacatgtcgtaagtgaatgaaactgtgtttgataagaactgtcaagtgttgactatgcacctattggtgtgctagacattctgaagattcagaagaagtatacaacattatttctaatgttatgattacatctacagacaaagaatcaaacaatgattctttttaatggtaacttgtgttttttaatgttaaagatatgggccaaatgataaagaacaggaaaagatgagtttttttctctatcagaaggatagattttgagctaatcttgaaagaaatactaaatttagacttatggagaataatttaggaaagcaattgaacactacccaggggaggtgggaagtgagatgctgtgttcagagtgagataaggaaataatttgaccagagcatgggattttaattgagaatattaagagataaaattataataaatgtagggaaggtgtatcagagtgagattatgatatactatacttgaaatatctaaatgaagtatttatgtttactctaaaagtcaagtgagagagattctggagtgagacaagaatgtgaggaatggggacttctgtggagtttaatctatagtaatgcacatgaatctgataaattattataatctttgcttttagtagaaatggggatttagagtacatcagtacaggtggcgaaaaatgtgaatttaaaacatattttgaaaaacaaggataagaattagtgtttaaaagctaaaagagaagaatttgtgtcagctgcaaaataaagtaaatacacatacacatacactacatacatgctcataatttaaattatgaactattttatcacactctgctgtgtaagtttttctaactcatattgtatatcagccatgttgtattcttgcattaattaatgtattcattaaatatgtcttcagtacttttttgggtccagcattacattaggcagatatattattcagcaagttttcaatttagttcagggaaagagggatgataaatattattatgagtgtttagaaatattaagaacccgaatccatttatcagtttcataacaatgattttcaagcttgtttcatttctcacagggtagacaaagacaaaatatatatctcataaaagtaataatctaccaggcatgtttgttgtagccaagcaaatatatagaattctaaaaatattgtttatagctcttgtttcaacatgcttgggacaagttaatgtttacagttttgtgagtgaatgaatctatatactgaaaacatttcattcaataagttgaccttcttgaggtttgaataaattttggagcctgagggaatcaatatggtttttaagttgatctcctaggtatgtctaagtttaagttcttaatataattatcaaccctttattattttaatatttcattacattaattatcttttggaatattttcactgatcagtaacttctagtcataagccgttctggtaccaatcatcaaatttcatatttgtaagaaaaaatgactagcctttggctgtcttgacatgcccaaatccaccaagtatatatctcacttccaaaatagtctcaggatatgttttctagatatgatcttagatgatggagtgtattgttaaattaacaagtagtataaaaatagacaaaatattattaaaaatacaaggagaaaggaatatgttagaaacaagtaagaagttccatatggaaaactgataagcaattttttagaagcaaaaatctcatgacgctaaaacaagatgatgaagaaattactctgtgtgcaagtgtggagaaaaatagcttgtgataccatagtgatcttagagctcattatacatcagcaatgaagagctttaactaccatgcaattaaaatactagagagtataaataagattgtaccatgtgtatgtggcagcatataaaaactcagaagtggaaggaattttagtcaagtgttactcttgaaaaagcaaacggattaggaatatttaattggagaacaacatagacaccttctgtaatattattcaagtaagaatgtctcattttggacatcttacttatagtcagattgattctcaaaacactttttaaatgtctagaaatatttacaatggtatttatcctgagaaatgctaaaaaaaattagaaaatgtaaaggtgactgaagttaggaaataacataaaattggtaatgatgagcaattttcttaatggctgttcataactggaaaaaaacagatatgctccgaaatatatgaattgtgagataaactgcagtaaaagaccccaagaaattgagggaaactatggaaatgattgtagcaagtggtagcaagctatttttgtttgcattttgaaagcagtttttagaaatttctaattttgaaaatcttaaattgatttttaggaattctggggctacttttttctcagacctctagggcaaccaattgtagagacttcccccttctgttaattgactcagatctgcttacatattaaaggccacctctggttctcagctggaaaaaagagttcctcccttttgaaacagttgactcagaatcagttccttcctttcagatccttatctttaattactttgtcttctaacctggggtcctaatctttgcctaggaatttaaagtaaagattggccgaatcttatttctcttgacttgtatctacctttactttagctcaccctctgggcgtggcctctagccagtctcactttgagtatctttgaaactctctccttattgtcaaccccttactttgattattttttttaatttaatgtttccaatgtagaaatacatctcaaaaattatgcagaagttctatcatataatgttcttgcatgggtctgaagctctttgaaggcaagggtccttgactatgttgttcattgttgtgtaattactgcctagatgagtacttggaaaggtggagtgattcaatgaatatgtgttgcatatagtttaagaagaactgggactggaattagaaacacatgttccgtctttagcaaatcacccatcattactaatcttccattattttatctatgatattgagcaagtaatgcctatcccatctatattatagctttgttggaagactcaagggataaagtgaaaatgctttgtagagttcagtgctacacatttattatggtcaatgaactgcattacccaaaccaacattaattgtacataacatgtgacaaagaaaggcttatggttttggagtttgtttattttagaagaccagataaactagaacaaatattttccatgaagaagttttttttcgtgttagaactcatgtgattaaattgattcacaaaatttgaggtcatttattaattttatgaatattttactgagcacctatatgatgtcagtgactctaattgtctctgaaaataaaaagattaataaatcatggcttctgccttcaaggaacttagagtttagtggttatagaatgttggtttaaaaaaaatggcaaaaataaaattctgacaaaaactcataatatctgagagtttatatgtgcttgctaaatgaaaagaattattagcaatactatgctgaatgactgtaaaatgctgactttttacttgaaatatttacaagaggaaacagaatatttgtgggtttccctgcatatttatgtgtgtgttcaaacagctgctagagaacaaagtgttttgctataaacactgtcaaatctcactgtgaaaaaaatttgtctataaaacaagtattttcatagatatactaaagctgcatagaatttgcttttatagcataaaacagaattagatgcttgagtcagctatgaaatactttttcatgcaacactcattctaattctttacactatgcattaggctgaggcctggtgtaatttgaaagtgataatgcaatagagaaattccagaagctgggggtggggggaatagactggatattgcaaaatgcatcagttagtcaatcaaactcctaatttatcaaccaaaccaacctaatcccatagagaattcaaagtgactcacgaaaagacacacaaaagaagaaatgttttgtttattttccaagatggaaaatgtaaactatccagaggacagtggtatgggtttagaaagacaattcacacaataaattttaaggaaataatggttttagtctttgatgctaacattatttctgggcttccaagtcactaaaacaatacatacatctttttaaaatgttatttttgttgtgttgtttggttttgtgttttagtctttttattttctgacaaaagaaagtttgccatgtctccagaacaggcacacaatttatgtactaaatcctgatatgaatttcttttcttttcttttctttttttttgaaatggagtcttactctgttgcccaggctggagtacagtggcacgatctctgcaacctctacctcctgggttcaaaatgattctcctgccttatcctcccgagtagctgggattacaggcatacactaccatgcctggccaatttttgtatttttagtagagacagggtttggccatgttggccaggctggtcttgaactcctactcaggtgatcctcctgcctcggcctcccaaagtgctgggattacaggcgtgagccaccaggcccatcctctgatatgaatttcttattggagaatccctttatgtgtccagccctgtggtaggctctgagaatatagtaatgaacaaggtaaacaaaacatacatagtctctcccatcatgaagcttacgttccagcaaggaagctagaccttcaatagataattatcatttaaaattataccttgtaatcagtgctatgcaagaaaaataaggcagaattaggggctgtaatgaaggacctgtttacaaagcattaggaaagccctcatggaggaaataagacaaggaagaaacacttgtgaacaataggaaggtatgtgaagtgaaggagcgttaaggaacagagatttctagacaagccctaagcaaggaaaaagcagagctttattctagaatcggactaaaggcagtattcgttgaatgtgatcagaggacattgtaagccaggataatcattttgaattttaacctaggtacaattatgatctatttttaagaagactgacttgatcagatttgaatcttaagaaaactcattatgtaaaaaaagggctaaagaaaggataagggtagtcagcaggccattcaggaggctattgcagatgtccagatgttacaaatgcttgtgacttggccccaagtattggcaatgaccctggagagaagcagatggatctgatatttatttcggagttagcataatatgaaatgatgcaatggcatcaataacgactcccggttttctctatgagacactgggtgggtaaactaagatgtgttgagcttgagagaattcaggagtagctaaatctgggtgtcccttcgggtggggattagaacgctgaaaaccacgaactctactttggagagtaatattaaatttgtgatgttcctgagacgtctaaaaaaatggagatttaaccaggcatttggatatatagctctatactttcagaaagatacctggtctggagatataacttgggagttattgactctacagatggtgtgtaaatgggttggaagtgggtaagatttggggaagagaagaatgaaataagaaaatgatccaggattaagccctgaggaacgataatagttactgataaaaaaaaaaaaagaaaagaatgaagtaaatgaatgtgacttttctgtttcattttttctaagtcttttaagccagagaaaacataatgtggaacagtgtttttatgtgtgttttatcactagagataagaaattgtcaagctgtccttaaggaccagggagggcccatggggaacagcatctttcctgatgctgttgtattcatcaaagcatagatgagtctcttctgatatttttgtttgaggaacatgaatataagctcatgctcctagcatagcaattagtttagagatttatcattgttttatttttattttttgaattattaactgcagacaaagccctaaattttttttgttttctatatcacaagtacctttttttggtttaaggttctaaatttcattttccgtgacttgaaactgttttgcacttcctctccttgctttatattttgagtttacacactaacctgccaaagagacatctagtttataggcttgattttggaagaaagacagaagagagcagatactgaacatatgttccgctgatattgatgaagtgaggttggaagaagcttggaagcagtctatttctctccaactgccaccccctctatgaatattttgggtacccttatgctggaacattccaaataagtgccccagctatgggttttttttttttctcataatgattctgaaagcctttgggatgatttaggattgttctacaagtggaacataaaccaaaacaaagcagttcgtggactctaattttaaatgggtgatggatgagatttcaatgcaaattgtaaagactgaaaatgatgtgaccagagaagggacccctagatagtaagtactcaataaatgacagaagcagggtatagtatgaacctgtttcttgggaaaatagacttgaagttagacaagaatctatttaatcaaactctagatatgatgttttgctaacttttgttttttgttgctttggttttttggagtttttttgcacttcaagaagtctttttgatctgaggtagtgtagtcaactctaatttattaagcatgaagtgattggttacaggtattttaacaagtatttggaggagtttggggaagttgaagtacgaacacattatttgaagtcactgttacagaggtgcactattttgtccttcctgatgtagccattagtgttcctacaagaaatctggattatcatgacagtttttttttcttttttcctttttctttttttaattttagatttaggggatacatgtgtgggtttgtgacatgggtatattgtgtaatggtgaggtttgggcttctactgaacccatcacccaaatggtgaacattgtattcagtcagtaatttttcagtcctcattcctctcccagcctcttcccttttgtattcctgggtgtctattatttccatctttgtttccatgtgtatccattgtttagctcccacttagaagtgaaaatgtcatattcaattttctgcttctgagttatttcacttaggataatggcctccagctccatccatgttgctgcaaaggacatgatttcattattttttatggctgcacagtattccatggtgttcatataccacaccacattttctttgtccaaccaacacatagattgttgagcacatagattgagtccatgactttgctattgtgaatagtgctgcaacaaacacacaaatgtaggtgtctttttgatatagttagttcttttcctttgggtagatacccagtaatgggattgctatatcaaatagtagttctcttttttgttctttaagaactctccatattgatttccataggggttgaactaatttacattcccaccagcagcgtataagcattcccttttctctgcaacctcaccgatatctaatattttttgactttttaatactagctattctaatttgtatgacttggtatctcattgtggttttaatttgcatctccctgatgattagtgatactgagcattttttcatttgctttttggccacttgtatgtctttttcttttcttttcttttcttttttttttttttagaagtgtctgttaatttcctttgcccacttttaatggagctatttgtttttttcttgttgatttaagtttcttatagtttctggatattagtcatttgtcagatgcacagttagcaaatattttctgtcattctgcagttgtctgtttattttgttaattgtttattttgctgtgcaaacgccgtttagtttaattaagtcccatttgttcatttttttttttttttgcatttgcttttgcaattagtcttagtcattaattctttacctaggccaatgtcgagaataatttttcctaggttttctttttatggtttcaggtcttgcatttaagtctttaattgatcttgagttaatttttgtatatggtgacacatagggtccagtttcattcttccgctagccagttattaaatagggtgtcctttccccattgcttatttttattgactttgtcgaagattagttgtaggaatatggatttatttttgcattctctattttgtctcattgccttatgtgccatttttataccattaccatgctgttttagttactatagcctcatagtctcagagcatagtgtgaagtcaggtgatgtgatgcccccagcgttgatctttttgcttagaattgctttggttatttgggctcctttttgtttccatattaattttagaattgttttttctaattctgtgaaaaatgacattggtaatttgatagggattgcactgaatctgtagattgttttgggtagcatagtcattttaatgatattgattctttctatccatgagcatggaatgtttttccatttgtccatgtcatttatgatttctttcctcagtgttttgaagaaatcataatcaattcctggtagagatcttttacctccttggttaaatgtattcctaggtatttcacttttaatagttattttcttatgtatgtctaaattttaatcacagcaaatttatggtgtaatcctatcttaattagatggatgatgtcctttgttgggaatttaataaaatctaatactgcttagctggaccaagtggataagatgacatttgaatccatagtggaccttgtagcccttcttttatttgggtatctactatatagagaaaacattggtattctataaacatgcctaagatccattggagtatgtatggttagctctgtttattttctttttggttacaataaaaatacttaacattttcactgtaacctgtttggaaggaagagagtaagcaattttaaaaattaattcaacagagaaacatgtactactttttctgattaaaaaaaaaaagaagaagaagaaaagagcccacagcagctcagaagcctccaaaaatactcttttattttagaagctgaaaagggcagatctaactaatggtacaagacaaattgaaagtcctataaacaggaatagaatacttactctctttggttttgtttgcttctgaacaactggattcaaccttctttctttccccccagctcttaggcattgttgtgtcaggacagctatggttcaaattgggctgattttccagttctattaaacccttcatctgcatcgtggatcaaatacattaactagctgtctgcagtgcacagctggaaatcattctcttccacattttgctttgtgccatttttgttttataccaatatgctctgacacacccacatagctcaggatttcagcagtcaattatctccttttcttccttgataggtcttagaacattttaaattggtgtattctcttttgtcttttaaatattgaatcacttgcaaacatctctgcttgcatgaatatttttcaaaatgctccatagacctagaagctgaaatggaaagttagaatcattcaaacacaaattttgattttattcctttgagagatggtaggtgattggcatgaaatagcaggataaatattgtctaccaaaagtaagatgagagagagaggaagacagagagacagagacagaaaggataaggatcagccatgtattattgtaaacagtatatgatatcttagagattattttaaaatgaatatattgaagtgaattgttgcattgactgaatggcttttccatagaaagactccagctatcatcagttatcaattacattattggtggtctttacaaacttgactataaatgttgagacatttttcgagaaatacatacacatgtgtgtgtatgtgtgtgtataagtatctattggtatctccgcatgttagttaaaaatataataatatgccaagtacggacaatgaagacagctactccacaatattcatttaatttaatttttttttttttttttgagacggagtctcgctctgtcgcccaggctggatggagtgcagtggcgcgatctctgctcactgcaagctccgcctcccaggttcacgccattctcccgcctcagcctcccgagtagctgcaactacaggtgcttgccaccacacctggctaattttttgtatttttagtagagacagggtttcaccgtgttagccaggatggtcttgatctcctgacctcgtgatctgcccaccttggcctcccaaagtgtagtttaatatttaagctgataaaacaagaaaatatatttaaaaaatttttgctagactacattagaaagattttctttaaagatgtgagctagatagaggtcattttaaaatgatgatttatcaaattttacacagttaaagatagtgaaaataaagagcacattaaaaaataactagatggaaattttcactgtgaaacagaatttctgaagtgacacggtgttcacttctgatcatggtcattgtacaaccattgagtctttgtataattgctgtgagtagtgtcactaccattttcccttcactttttttctatagatatttaaatgaagcaactgtatacatatttattcattttgtcagttataatcaagttattctatcctaatctttctatcttcactctgtgtgtgagtctgtgtgtacataacatgtgatatttatatccatcttccttcttgatcatgagcaacaggaaccaccaatactattttacttaagctgaaatacatttgaaatataccatataacttgcagagttgatgggaaaatttgaaaaccagggtgagaagatggcagacatcaaggtcatccctaggttttgatacctgtacagaatagtcattgcttactgctgccgccatcactactttctctttcattcctctgatatgactatctctactcctatcattatctgattttccttatctctctagtctgtgcttcacatgcttaatattcaaattcctaggccaaagtcacatgtacatgccctaactgctatagggtagggagaagaaaggtctcctctatttacatttccttggcaggaggtaggacactgcataccctcaatagtagacacaatgccaattactcaagaaaagaaatggaggatgaatgttggacagccaagaaatgatgaaggtctgccacatttttcatataggttggctttttctttgaatgttttcacttagctagtgtaccaaaacagttctacatttccaccaaattaaaggtctgattagtttaatgcccttcatttgccatatttttctcaagaaagattatacagtgcatgaactcattcttattcagtaaatttaaatttgagtggcattatattccaactagtgctatccatgccctcagtaattttatagacttgagagccaccgtaaaaaatactaaagttacagtatgatgagggttctactaaatatcaactaagtaatatacggacaccaagaaagaaacagaaaattctgtgtggcaaagtcagaaaacactttcacagagcagggaatatttgagctatgaaagatgaacatgcaacaaaaagggagaacattctttgttgaagggacaagataatgtcatcacaaagcattttcaaaatgcctgctatatttgtaaataggaagagatcagttcactagatgtataagaaggcatgaaggaggatagcaacagatgagttcagacaggtagaaagcaggcctgattataaatgtttagatcaccaaggagtttgtctacgacactacaggtgacaggcaactcacaaaagtctttaaaaaagaaagtgagttttagggaagataatttcaacaacaatggggaagattaatgggagtagagtcacgcaggaagactaggaagggcagtggtgctcaacctgtttggcaccagggaccagttttgtggaagacaatttttccattgacagggataggggtggatggtttcaggatgaaactgttccacctcagatcatcagccattagattcttataagtagctcacaacctagatccctcgcatgcacagttcacaatatggttcacgttcctgtgagagtctaatgctgttgcttatctgacaggaggcagagctcaggtggtaatgcttgtttgccagccactcacttcctgctgtgcagccctgttcctaacaggccacaggctggtactggtctgcagccctggggttggggaccccgggttaggatgctactgtaataaatgtaaagtaaggttaggatatctgaatataaatgttgatgtgtttgtgtggcggggagcggtgtgtgtagctgaatttgaggtagagacaaaaagtaattaaactggaagcagaaatcttagaatggggaaaagtaaggcatatttgttcacaaagtatcttttaacattttctggtttctgtggagtcacattttattaatgctggttgacatttatctacctagaaaaaaatgacagaaatttcaggaacaaaggtgactatgaattaggtaccaatatttttgtggatgatcttcatgaagtcagccaataatggagatgagtatgtggaaaggatggattatttggactttttgaaaagaagttattgggtgaacatgatggctcatgcctgtaatctcaacagtttgggaggttgaggtgggaggatcacttgaggccaggagtttgagataaacttgggcaacagagcaagatccatctttacaataattaaaaaaaaaatagaaattagctgtatgtgatggcttgcacctgtagttctagctactcaggatgctcaggcaagaggatcacttgagcctaggaggcagaggcttcagtgtgccatgatcatgccactgcactccagcctgggcaacaagagtgagaccctgtcttaaaaaaattaaacaaattaaaaagaaatgaagttattgagtgacagttaaagaaactgatttgcaagtggccttcaggaggcagaagaaggctacttgtctttccccagtgattttatgaatccattgaggagatctgcagaagtgttgtcactgctggagaaaaccaaggcttcacttgcaaaaaggagtactttcttaaaactgagaaatttggaaatatatcataggacttgtaaagctatgatggaagttagcccatgagtgtgtttacagaaggcagagctagatggcataagactcagggatgatgcaggaggtgataaatatttttgtttagagtagtgagaagagtgaaacacagtagatctttaataataaaattttcactcatttggaattatgaaaattgtgtttgaaaaccagctgtgccatttaaattctgggtatatgtttcttcatttgtaaaattcaagtttgaactaggcttctttgaactaaattcttcttgccaccagacaacaaccttcttcttcatcacctagaggaacattgcctgaagcctaaggaagcagccttccctgtgccacacagaagaccccttaattgttcaatgaatttctcattgacttgtgtagtgcttcaaaagaaaacacttacacatcaaacatgattctaagtcaaagttcttcatttatatgagattaaagaactggaaaactgtacaagagaaatagtcacctgctgattgcaggcctgtgggtttcttggaaaaactcagcaattttgcttatccaggactatctttttgcccagttcctctgattctgaaggaagttgaaaagatagttttcctttgctgtatccaacatccttttctacatttgatttaagaaatgtcaatttaactttttattgatactgatattgaaaatacataaaatccaaagaatgagataaatcttacatatgtgtcatatttctatagatttttttgaccaacattttattttgaaaattttcatgcacttggtaaggttgaaagaatcatacagtgaacactatgtactcgaaatctagattctaaaattaggccaagcatagtggctgatgcctgtaatcccagggatttgggaggctgaggtgggagcattgcctgagggcaggattttaagaccagcatgggcaacatagtgagaccatgtctctaccaaaaaaaagtaaggccagcacggtgctgcatgcctgtagttacagctactcaggaagctgaggcaggaggattgcttgagcccaggagttcaaggttacagtgaagtattataatcatgctattgcactccaacctgggcaacagaatgagaccctgtctcaaaaaaaaaaaaaatagttaatgccaggcgtggtgactcatgcctgtaatcctaacactttcagaggctgaggcaggtggatcagttgaggtcaggagttcaaaaccagcctggctgatatggcaaaaccccgtctctactaaaaatacaaaaattagctgggcgtggtggcaggctcctgtaatcccagctactcgggaggctgaggcaggagaatcacttgaacctgagaggcggaggttgcagtgagttgggatcatactactgcactccatcctgggcaacagagcgagactccatgtcaataatagtaataataataatgataaattaatttaacatgtttgagtagggaggagatatgtgctttatcacatatctatccatctgaacatatctacccataaatccattttatcttttaatatactgcaaacctcattcctatacacatgatcatgaatatcattaactggagttaaatactgctaatttttttcaagctcaaatttatctacattgaaatgcataaattatcaccccgtgtaacattcactcactgaatgtaatatttaattaacaaatacatacaccattataatacaaactgctatcaagaatattatcatcatcccagaaattttctttatgcctcttcccagtcagtctctgcccccaagctcccaaaggcaaccatttttcctgttttattttcctaaaagattaggtatgtttaaaaagatcatataaatgaataatagagtatccactctttggtgtaaacttatattatgtggcataatcctttttggagtcatcagcattgttgtgtgtatcagtaatttgttccatttttatgttgaatagtatttcattgtttaaatacaccacagtttttgtatcatttcccccattcatggaaacctaaggtgtttccaggtttggctattatgataaaaacttctatgaacatttttgtttaggtctttttaaggacatgtaatgtcatttatcttggatatgtacctaacaggggaaaatttgaaggacttttatatttattaaaaactacctgttttctaaaagggttgtgctaatttacattcccaacagcaatgcagcagacttttgattgttctacaaactttttaatatttgatgttgtcaatctttttaatataatgccatttaatctaaaacatgagaactttgtcaatatataggtccagttactgtgatctctcacccaccatttctttattatagttgtcatatatattctatttacaaacatatgcaatgatgtgattttttgccttaaatattaatatgcatttaaaagaatttaacagggaaaaagtctattgacatcaaatgtacttatactgtcttttatcatctccaattttctattaatcacatgtagtggatttttttttcattctagatactgtgttacatttttcagtcacagaatttatattcaatattttttgttgttaccatttcttttttgctacaagaattttcgtatgtgtgtatgtccttgagtatagtttaaaagctgcttgaagatgcttgtttgcttattccaacatctggttgatctcagtacaatctccgttgattgctttttctcataagtatgagttactttttattgcttccttgtatgtctagtatttttttttaattgcaacctggatgtcatgaataatagcacattgtagaaactctgggttttgttatgttcctctgaagagcactcacccattcttttttgttgtcgcatcagttggttaacttgactgggctcaaagtcccaacttttttctttcctgtagagtgcagaacctaaaatctctgttcagtttttcagccctagctgggctacttggaatctgactagggcaggtgtaggtctggcatcagtgagcaatttggacagagtttatgcacagattgaggctccctttctgtggacctctctttacacctgctgtggctatttttagttttgttcactagttcttcaagccagtaaaactgtgggtttctatttgagttttagccattctggagctcatccagtgccttttccttctaagtattcatagtcttcctggcttacctgttcttaggtgcactccagatatctggtgtttgctgtgtgtatatatatatatatacacacacatatacatacacacaccaaatatatacacagaatttatagctgttatctctgggagctttgctccaataaaagctacttcacaattattaaaaatagaacctccataagtagattttaaaatgtttctgccatttgaaaccaaaaagtgggattttgagaatgtagatcatcaaaatcatgccaacatgtgtgaacatactacattatttgagaaagcaaatatggtataaacacatccaaataaaaacagtggaagttaggtgatttttttcaaatgtttgccatattgtagcagaatttcagtttttcaaattttcacatgatatacacttagcctttttctagatatcctattaccatatatatatatatacactatagaacagaatatattattctatatataatatgaatattctaatctctaataaaatacatagtataaacagaatattgtttgatttttgttcagacattgttccttataaccagaactccaactaaacttatttagtctagtgctattcagaaaaaaaatgtcaatcatagttgtatggataatgatcactggcttttatgtcattaacattacaggaccttaagttgagttaagaagatgtaagtcaatactctctaaaggttcatcagctatttatagttaatttacactcctaatgtttacataatcttaaccaagtaacacatattgaatatggaaataaatattgccctggtgcttttgaatgggaataagtaggcacagcataatagatttaacatataatgaaaatgggttgcaatctataataagacatgctgaagattcaataaaagctcagatattgattcattcttcaaattggtcattcattagcaactaattggagacctttgctgaccaatatgcttaaccgatttttaaaaataaacagcaaaatagcaatgaaatttcataaagcaactattccctgaccataaaacaaggcaattaaattgtgcaaaggttaattttgagcacataatcagtaactgtaatagaaacaaatcaaagaaaagaattgaaagatcctaaatgtaaattttattagtgtctttagttttatggttagaaaactctatgaagcaacaatggcatggtgagggataagttatttgttttattaaagatttaaataagctttaccaaggaccagattttggttctactttaggccctgacaagaagtcttgtaagctttttaaagagctcacttcaaatcatagttatcaatcttactaattcataactttgtacatatcatttatcttctctgagctgcacttccttcatttttataaagtggaaagaattaataaaatttatacaatgggttatatgggaattaaataatatgaagaatatagaatagcttcagaatcaatgtttcttgtactctgtaatccctttgtagctgtatgcttttgctctctttatttatttaattatgtgggataattggtacataatccaattctatattttctgaacatacaacataaagaaaatactttatccctggtctcttttcttggcttcctcccatgattgctgaggcctgggaaagtacaggcctggcctgctccaatcaggtctttcagggcagaccaaagcagggcacagggagtcttacccatacctgcaaaacaggaatgaggccatggtcagggtcagaactagtcagtgctgagggaggaggcaaaaatccgagagaaaaagtgacaatgccctggtgaagttttagaaatgttagcacctgcctgagatggcttttgtgtaagtaagctggctgtctttgaagggggcagatggagctagactgcttaaactcatcatataagcgagcaagagaagtataattttgctctcctttaaacagaattcccagcatgtctctttgttcttactacttatttttctatactgtaaattaaatttttaaagaactggagaaaagtccactaaaacaaattactaacagtgacaaataagcagtgctttatgttaatatgtaagtgcaccattgtattagtccattctcatgctactaataaagacatacccaagactggataatttatagagaaaaataggtttaatagactcacagttccacatggctggggaggtctcacaatcatggtggaaggcaaagaagtaacaaaggcaggtcttacatggtggcaggcaagagagcatgtgcaggggaactgcactttataaaatcgccagatattatgagacttatttactatcacgagaacagcatgagaaaaacctgccctcatgattcaaatacctcccaacgtgtccctcccacaacacatggggattacaggcgctacaattcaagatgagatttgggtagggacacagccaaaccatatccaccattatgtttattcaatgtgtaacctatatgtatctgtatctatagccacatctatatccagacaattacataatcttatatgttgaaacaattacagattcaagtactctgactcactcatcatttacataagctttcagcagagagaccatacttatatgccattccctctgcctgatatgtttgttttttctttcttcattttccctaacagataaacttctatttctccttgaaaattcagctcaagattacttcccatgataagcccatcttagtaatatttttattctcagatcctttactgtctggcataatatgtgctcaaaacatatttgatgaaggaatagttgtaccgttaaatgcaaaatggtgatgaatgacaaaatagaaagatatacagacaaactttatttaatcgcatatcatttattaacctagaaaataaaatgtctaagatagataatggcgtggagaccatctaattatttttaaatttgtaacctgacaaacgtcacaaaattgttaggaagttttcactaaggcttatatcatggaaaagataaaaaaaaataaggtaaaaacttttaaatggtactctactttttataaaacattacattttctaatgaaataaataatactttatgaatgtttaatatttctctaaccaacaattacattagctttccttatgtcacactgacagaatgtctcattgtgttggggccagagagcacagagatgaggggggaataaatgtatcaggaacaataaatgagatagtgattaagtgaaaaagtaagtaccattggcaaatcaggaaaaattgggaacctcaactttcagctgaagaaaaacacaaggcaggaggccagatgagagttgggggtcactattttggaggaacaggattaagggatttttaaagacatatgtataaggagggagaaaagaaagaaaagattctttgggggcagctctttgggagatcttaagaatgactgagacaagaactgagttgtcacttgatcttttgaattcatttacctgtggaattttttggagtgattacaataaagatttaaactatttataattgcaatttttactgtactattatctttttttaacagaaaagaaaacttaatagtcaatacatactctaataatcaaatattataaaaatcttcctaatttactttcttttttaattttttgtttctttcaatgcaattctaaggccaaccaggtccgcaaggtagcactagatctatgctggtttcataaaacattgtagatgccattcagtagagtgattaagaggatagactctggagccagattgctttggttcaaatcatagctctgctacttgctagctgtaatcaggagcgagttacttaacacctctctgccttcttaataaaatagagataatagtggtatgaagctcatgtggatgttttgtgtagcaaatcattgtaggaacagtgtctgacaatagtgcttggcacattgcaaacattcaacgatgctggctattatgattataattattattattatatgcagatgatacagacaaacatttatgagtccaatatttataatctaattattcgtttattttacaaatacattgagtgcctactctgtccctactatgtgccaagctttgaggataaggcagaaaatacaaattcaagatctagagatcttggtaaaaaaggcagaaaacacaaactcaagatctagggatctcagtaaaatatcaagccatgagatttagtcaggaaggtttcttttttcttttctttctttctttctttctttctttctttctttctttctttctttctttctttccttccttccttccttccttccttccttccttccttccttccttcctttctttctttctctctctctctctctttctttctccttccttctttgcttccttccttcctttctctctctctctctctctctctctttcttgacagagtcttcctctgtctcccaggctggagtgcagtgatgtgatctcagctcactgcaacctccacctcccgggctcaagcaattctcctgcctcaggtttccaagtagctgggattacagatgcccaccaccacgccctgctaatttttgtatttttagtagagacagggtttcaccatgttggccagactggtcttgaactcctgacctcaagtgatccgcccacctcagcctcccaaagtgctgggattacaggcgtgagtcaccacacccggcgaggaatgactttctatcagaagttgaattgatatagacctacttggcacatatatagagctgaaacaacctagatggtcggcatattttctccataaatagagtcaaattatctgtaatttcaaatgtactttctccaagaacagatttttcagttaaagagtggcttttgatgagtgactttgctatactgttattgaaaaagggtctataatatgcaaatgctagacatgtatgaagcacaattgacattaacttacaggaagaaaagagactgaatttggttctcagagggaataaaaaaatctccccagccctacacttagatggacctctgagatcgtatctatgaaagttaaaaacttctattatatctaagacataattactggtgtatgatcatggaccactataatggcttgtttctggcaatatattgctttattatattgctggatggcatggaaagcagtaaaaattggtattccaaagtaaacattatctatcttctctagtctgggataaagaagttttaataattatttacactgaaggataattagagcatgaaatgaccatgaaaaaatatatttgcatagttgtgcagaaacattaacatgcaattatgtcttgatactagatataaaatatctgaaatggaagatggaagatttagtgggatcttttaccaataacttcaacagaagatttgtgttttagaatgtgtcctagagacaggaccttcttcctagctaaatattagagataaaaaattaaaaagaggcttaaagtccatacttaagacccagaaagaaaaatagtattcttttgataacacatagtatttatgtagtatactgaattgtcaggtatttatcattaattatctcatgttgggttactttaatgctccgaaaaatattttatctcaattgcttttaaaatgtatcaaaatcctaactttgtttctggtctacacaccttcatttgtccatctttttcaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccgtatgtattttagtgtgtaggtgtgtggcgctgggtaggatctataattgtgagatgttgaggccaagttgcattaaattcaagggtttgtaatactaagaattcctagaattctttttaccattaagagcttcttcctggcccctctctgtcattcagcaaacattattggagttcctgctatgtgctaagtacagtgattggagatgattcgccagctgaaggcctgtggcagtcattgggtttactaactccagataccaaagtggtttctgagggtgtggttattaactcaggctgtcatcattcattggtaatttatgtgccagatattgtgcctgagatccaggaggaataaggtaggatatcgtctttgagctactgatatatagtgtggtaagtacaaaggaaagaatgagcacagcgttctgcagaagagagaggatggccacaaaggcttggtgtaagtaaaggcttgccagaaggagcgatatccaagctgatgaccaaggacatgagctaaacaagggtatgagataaacaggtaaagaggtgagggaggggaagaggagaagtcatgccaggaagagaaatcagaattagacagaaaatcctagttactcggggagctacaagtaggaatgactagaactgaaagtgccaaagggcagagagtagagatgagactagagcaaaaggctggagccagattatgaaggcatttaacaaccacaggagaagtgatttagggagaggcaccatgtaaagccctctttccagcctctatgaaccacagtgatacctcagactcattgatgtatttattcaacaggcctttgaacacctcctactagcaaagcattgtattggagcataatgttaaattacacataacccctgattcagaggacctagaggggaaatagaggcaaaagaaaagtaaattcagtgctaaaataacatgaatgctccatgtagatgctaaagtcatctaaagatttctggctaagaaatctttatatctatatatctctatctgtatctatctttctgacatgccttcttctcttctcctcgcttacctctctctctctgtatatatataatatatatataaaatatatatagcaggtagatatatacttatatgtaatctacataaaggtaaaaatatatattatttatatttatttatattatttttaatgaacagatatattattttatttttattttgtttttgaggcagaatctcactctgtcacccaggctggagtgcagtggtgcgatctcagctcactgcaaccgccatctcccgggttcaagcaattctcctgcctcagcctcccgagtagctggattacaggcacgtgacaccatgcctggctattttttgtatttcaagtagaaatggggttttaccatgttggccaggctggtctcaaactcctgacctcaagtgatcacccgcttcagcctcccaatagatatattttttgttaatattatttcatatataatatattaaaaggtagatatatattatatgtagagagatatattttacatatctatagatcgatctatagatatctatatctatagatcgatctatagatatctatatctatagatagatatatagaggccagaaagtaaatgaattgatggattattagtttcaggttcattaggcaagatgataaagcctgatggagggaaaccaccattggttcagagactggtggccttgaaaatttcatgaagaatatgagaaagcccaggggcatgaacggagttgtggggaggaggtgcgagtgtgtagatgtgtgtttaggatgggctgtgcagacggggagaattagagagataaaatatgtaaaaccataagtgtgtgtatatgtatgcaggtatatatatatatatgtagagagagagagagaaaggaggtaataacgtgaatacttaatgccaagtgaggtgaactatgatgggggtaaagcttcacaattatattattttaaaatttgcttagtatttcttctcctttttttttttttttttttaggcagagtttcgctctgtcgcccaggctgcagtgcagtggcgcgatctcggctcactgcaagctccgcctcccgggttcacgccattctcttgcctcagcctccccagcagctgggactgcaggcgcacgttgccacgcccggctaattcttttttttttttttttgtatttttagttgagacggggtttcaccgtgttagctagcacggtctcaatctcctgatctcgtgatatgcccgcctcggcctcccaaagtgctgggattacaggcgtgagccaccgcgcccggccttttctctgtctttttaaatagaccttatttttagagcagtttgaggttcacagcaaaattaagaggaaagtacagaaattccccatatttcccccgccccaacacatgcgtggacttctccattaccaaaatccccctccagagtgctacatttgttacagtccatgaacctacattgacaacagcatcacccaaacttcatagactgcattagggtttacttttggtggtgtaccttttatgggtttggacaaacttataatgatatatatctaccattagagtatcacgcaaagtagtttcattgctcttttttttttaaattataaaatgtataaaatgagagctttttctcacaatttacattttttatcccaaaaagaaaattgaaaggcattgtgccttttttcttggagctggttaaagagaggcatgcatagtcccctcattatataatttaggaatgcagaaaacattactatatttcagcaattgacacttgtttgattaaaattagtggtcgtgtgtatcacagaatatcagaaaacatgttaagacaccaaagaaggcaaccaccagaaacctttcctattaatgactctggttaatttctttcttttttgttttgttttgttttgttttattttgagacggagttttgctcttgttgcccaggctggagtgcaatggcacgacctcggctcaccgcaacctccgcctcccgggttcaagagattcttctgcctcagcctcctgagaggcatgcgccaccatgcccggctaattttgtatttttagtagagacgaggtttctccatgttggttaggctggtcccgaactccagacctcagttgatccaactgcctcggcctcccaaagtgctgggattacagacatgagccactgcgcccggccgactctggtgaatttctcggatgtaagttgttatggtatgtgtgtaggagtggggagtatagttgcatacccatgtgtttgctagctcttgtatagaatgtaagaggaaaggacatatgtcagagccctttgcttttatgtaaaagccaagggagttcaggtaaatggagtcaaggcaataaagggaaacagatttcaagggaaaaaaatcaggaaaatgaggcattaggtatgtgatgaaggaaagaatttttaggaagaaaaagtaacagttttaaatgcttcgaagataattgagtaagaaaagcataaaataggtttcccttgcttttgacaacatggccatccattgaacacctttctaaagtactcagcagattcatagtggcaagaggcacactgaagaggtaataaatgaatgatgaagaagaagaggggactatagaaatattctgtcaagtatccttgatgtgaaagagaatgaaggacagaggaggttgtggagttgcaaaggttttcaaagataagagacatttgagttggtttagatgcttggggggaaaggcagggaagttgaagaccaagtggtggtgggcatggtgtctctctagaagtaaaaacatatgggtcattaagcataggcaaaaaccttatattagaagatacatacttttaactcaccaaatcagaaagaagaaagaatgaatagcagcagtcagcagaaagtgttgggagaaatttcttatttgatgatcttgatttcttcattaagatgtaaatctgggttacctgctgaggaaagaagcaaacatttagattatgagcctctcaggggaataggaggggatcactgagccgtaatcagaataaagtggcaattccatatggagtaaaataaagaatcaaacgtgtggactgatactcttggagcattacagggaaagtagaatggaaagagaagatggcaagaaaattgaagaaaaggtcagaaagtaaatgaattgatggattattagtttcaggttcattaggcaagatgacaaagcctgatggagggaaactaccattggttcagggactggtggccttgaaaatttcatagagaatgtgagaaagcccaggggcatgaacggagttgtggggaggaggtgcgagtgtgtagacgtgtatttaggatggactgtgcagacagggagaattagagagataaaatatgtaaaaccataagtgtgtgtatatgtatgcaggtatatacatatacttatgtatttattaaatatttaaattaaacatgaaatatatgatatgtaatataatatacttatataatattaaataaatttatataaataatatacacatataagtataaatattatgtatatataataatatgtacctatgtgtatataatatttacactagaaaggcaagaaataagaaaatgtatccaatcataaaaatgggatggaggaatgatgcaaagattggggtagaaaataatttagttctccactcaattatttttattcttggctggaaaaatggatgagatgcattgtcagattgagtccaaaagctattctgtctttcaccctcttgaaagttctacattcagagtatcttttgtctcgtggaagataaatatattcagccaatactatccatgttttcacattgaaaccaaaaatgaatcaattatttcagtaaagcaaggtgtatataagttatgatttgtatttccccatttttatttacctgtagtgttttctaaaccagtcacagtctggatttactttacattattattatttattattattattattattattattattatttgagatggagtctcactctgtcacccgggctggagtgcagtggcacaatcttggctcactgcaaccttcgcctcccaggttcaagcgattctcaagcctcagcctcctgagtagctgggactacacgcgtgtgccactgcgtctggctaatttttttgtatttttagtagagatggagtttcaccgtgttggccaggctggtcttgaactctcgacttcacatgatctacctgccttggcctcccaaagtgctgggattacaggtgtgagccaccgcgcctggcctgcatgattatttttaaatgaccagattcattccacatttccagattatgctttgatactagaaatttagaaagaataaaaccccacaagaataaaaatctagcaatcaactgcatgaatatattttagtaaaagttggagcaacagatgataaaattccacaaattcagtgaactctgagaataaatatggaaggtccgcagttaattatcctgcaaagaaaacgaaccttgaactttctgttaatagactttgcttcccaattaaaagctagcagtttgaaaggtttacctcatcagcgattccctatccagttttcagatgcagttagcccttggattgacttgcatatttatccctgttgaggatgttatacgtttctatctccttttaaataagggaactttgccaacaattcgtcagtatttgcaaattaattatgattaaactttcataatagggattatggttaattgttgattcatctcccagtcctcctttttgtgactaattctcttatcagtttgacctgaggtggcagataccacaatttcctattagacaacttctctcacaattacctaagagccatgaatttgatttagaaatggggttgtatgtgtgtgtttttctatcacatattaaacgcacaatctgtaaaaaagattcaggaggatgtttgggaaatgttttctgtgatatttatttttcttcagaagaagtgccaacaatatttcatttatggttttgattccccatatgccaatttcagcaccctcttatttcaccagggtcatttatttggtatttagttatgcttctgatatttgctgtcatcataaagacctgacatcttccctagcttcaaaagaacaatttgactaatgctaacatttaaatatattcagaaattttacttttcattaatgagacaggaagcctcatctctatggactgctaacatgatgatttggtggaaaataaagtccagccagctgttaagttgaattaaaaaatttaccaataataatggaatatttttgccctgtcttgtacagtcatattaagatttgcaatatgaatatccatatctggaataggactataataccataaatagcttaaaacatagtcttcatgttttcagtaaatgttatgacagtgtattatatattaattataaattaatatgtaatacaaatcttcacaaatctgaaaatgccaaatttagtgaatattcagctttttaaattttgaaatggagtctcactctgtcacctaggctggagtgcaatggcgtgatcttggctcactgcaacctctacctcctgggttcaagtgattctcctgcctcagcctcccaagtagctgggaatacaggcacccgccaccatgcctgtgctatttttttttttttttcatagagatggggtttcactgtgttggccaggctggtcttgaactcctgacctcaggtgatctgcccacctcagcctcccaaagtgctgggattacaggtgtgagccactgcacctggccaatattcagcttttaataaaatttttcttttaaagatgattttactttctatcagattcctattgcattgaggacttagttttgctttatttttattgttttttcaaatgttttaccaagtacaacttgtctctaagattcaaaacagtgtacattttgaatagatgtatcatttattttatgtatatgcataataatggttagaatgctcacagttatactgttcatcagtaaccctgtgaatacagggttcacatccaagatgttctcactggtccgtggcaaagtaagaaaatgagaacaactttccacatttttcataaaaatagaaaggatacaatttaaataattgtcctccattttgatattatgggttttaaaaactaatgatggtttttaaatgccctttgtttcatgaaataataatgatgctttattaaatgatagaaatatattggaggttattattacttggaaaaactaagagctagaactcctatatcaatttcacaaatcgatcacacatttatttttaatttcatattttttctctgaaaattatgaatctggaaaccactgctgtgagcggaattttgttattcctagatcagagatgacacataatgttgaatgatttgtctgtggtcagttacgtactaagtggtggagccaggaggaatatcagctacccgtgtgccagcacctcatggtccccctctcatcaccattattattagaatacatggctagattgcaatattaggtaggcaaattgagagtccatgtttgttcctcatagcaatgtgatttgttccttatgtgaggtattccttcaaatttaaaaaggattgtgttctaatctaaaaggtcattcataagccactcattcgaaacatcttcccagatacttagttttatgaaattctcaagactgacaccccaaagcatccttaatctataataaacacaggagtacagggaagctcacctccactttgtttacatttctatgggcaaatgtgccgactttctagtgagatgtgaggaatttaagtgcccttactgcagccttgggaatagaaacaggatcatcaacagcctccactcctgccatcctcacccatgcatgagcaaggcctgtttagagagggagaaagaaaaagaccttatattacttggaaaatgagaagcaaagattttagacaagaaccaatgactgggaaccaaaatgcaatgagggcttggcagcccaggagtagtggctgctgttgtgagacacatggagctaaaatgggagagatgagaaactgtgagctttgaggattgtaagaaggaagggagctgcaacaaaggtcacaggtctgtggggttgccacgcctcctattttctatctctaatctcccttttgattttcacaattggtcctgttcttatatgtctgggtgaaagtaagggaagatctgtggtttttggtaggatagagtttcatgtgccatcatctccttccttgccattattgtaaagattcctccactagagttagtgatgatggcaacagacaaatgccggatgagaggtttgggttatctctcatattattaaatagtgatagaaaattggcaagttaaagactggccgcaaaaagcttctgtaagggccaagggaaaacttctcttttgccctctgaaggtttgctgaaaaatcaactgaaaaaagttagcttggtaggtgaaaggcatacaaaatgtattttaacatgcatagcatggaagaatcacaggaggatgattacccaataacccaataggagcatagatgtagatatacccttcttcacgggggagggaagatggggaaaatatggcaatttggaaaatagtaaatgattttttaggggaattcaagaacctacaatggcctgggacaaagtctgttgggcccacagagcagatagtggtttgtaacaaaagtctgttcaggtgtgccgacagacttcagtctctcttcatgtgaaatgagttaaattaatgaaaacttaagcaagagggccagaggaaacttttcctcctggtgggatcagactgtaagtagatacgggagtatcagagtaaaacttatttcagcatttgctggtctccaagagcctttaatttaaaataatcagcataccagcatgctatattttcgggtattggtttctgagcctcaatatctcatagaatgaatttaacagcattttatgttaaaaccagatatatattggactccctacgtcttaataataatgaatgtgtcagaagggcaagtgttcaagtgtatttcaaccacaagtcaggattttatgtttctgttaacaaggttgatggcatactagagctgtctcaatagttagttgttgcttttttgaatgattgacaagtcaattagattttaacattatatctttacacttaatttctgtagttacctttaaaattgcccattttggttaatggccagagtgctgaccagctcattcccctgcagcctaagcatttaaacatttcctgctaccttgtatggtgctatgagacagctgtcattgaagaaattctgttgagaatctgaattactctccttctgtattattttaatgtttgatattcacatgatggttgttttaaccatttttttttactttaaagaaaaagctataaactagttatatgatcttttcttcttcctttcatatgatgctgctaactcaatagagagacacccgattacaaatgctattgatggaaagaacacttggtggcagagtcccagtattaagaatggaatcgaataccattatgtgacaattaccctggatttacagcaggtatagttcctctttttttgtcatttccacttttgaaattgcattttacatttgctatttgtttagttagtggtttgtgggtgaaaggatactctttcttatcactctccattgttttcttgataagatgaacaaagggtcctattcatatagcgtattgttatttacgagtattcagcatttaattataaagcacaattcaaatggaagcacgtgaagagcttagaaatgaattaggtgctaactctgttttagctagctggacttaatgatgaaaatatggatcaataaaattttacataacaaaaatataatagtatcatttttaacttttaaaataatacattgctcccactgtgctgatggtgtgtgcacttaaaggttcttggataacaaggctcttgagcaaattgcctctcattactgagagctgagaaagttttgacagttgctttcaagttaaacttgggtgactaaatgaagtaacaagctttgtagttatacaaaattgatgccggaagttgttcaagtttgtcttgcataggcctgggtgccttctatgcttaatctctttcttccttctcttcacaatattcaggtcaggctgaagttattaatcaggaatcgccagcacctcaaattatttaggcttgcaattaggatggaaagtggacaaatgccacattccatcctatttgtatgcctaaataatgtgcaggggtgatggtcaggatagttaatgacagacaccatacactgtaaaggtcatggtttttataagttatcactgtgtggggaagcccccagccagtgggccagatcagcacaagacattttcctaatggatgccatttgccaccagcatgagtacaatctccctcctccagtgtctaggttcattttggtgagggctgcatatattcaagagccacagaaagctggctggagcaaacaagctggtggattgcacggtagacctgccttccacccatatgggcctcctcgggatatgaggaactggtggcggcaggggctcagtgctgcagcttatatcaccaaatggcatggacttatttctaccctcactaatatacagcagctgaatgtcagtcctgagttaataatatttctcaggaagtctcagagcactatcagagaatggcagggcaagctaccacactgatcaatcatgctttaggaaaattaatcctgtgcatgaatcccctggggatcttagcctcaaaatggactgcataccactcctgataaagacaactttgtcctttattggtcacaagagttctcccccttcatgtgatcattgaaagtctagtctcccaatcaagagtgagtctgctgtgcattgactcaggtcatctccagggacaggcaatcaataaataatgatgctttattgttctggtttattctccatttattcttttagattgcacatagaacaatggggtcaattattaatataatttgcacaaatcacttatagtactctttgagctgaacagcaatattatttacctgttatcaaacatggcagcatttttcccctcctaatttacaactggatggcgcaaccacaagtttttactaaatcatttctaacttgcctgtttttatcaattcagcaagtcaaagagtttacctgaaagcctatttttcagtgatgtcattgatattttcctaaatttactttgcatactcactcatccattcccacacagtatcttaagaattatgtggatttgtcgttctgttttctcttcctcccatttagtttaatggaggtaagatgagtgaatatgccaagacatattttatgcttcattcatcataacaaagtgccagaattctgtatataacccaggtctacctgactccaaagtctgaaattcaccaagtggaattggtacagagcatatgtgttcaaattgtcccatattccaggatggtgtccatccatatccttatttattccagctttctatttcctgaaaatcaacctactgtgtgtgtagaagaaggggaattcaagtaatctctaaaaatgtaataaatccttatttctacttgactcaagattttaatttagtcagttatttagtgatgtgaaaagttaaacaggttttgtaatcaagtttcgtgatggaacttctcagacaagaaagagcttcagacttccaatttggcctcaggctttggaataacaaactgtgagacatgtttataatacttattcagctatggatggtatattgtactgcactggcaacagagaaaatgtggacattcttattatgtaactcctcacaataatcctgaataaaccagctaatattaatattcctattgcatagttgaagaacactgtgctttagaaaagttcagtgacttggccttctttctaaagcttattatgggcagggctggggcaacatgaatagtctgaatccagacccaaatacactatcttttctaatgggtatctgaagacataatcctagggagctcaggataatttttattatatattttcaagggctccaaatgtagttcaggttcaagaaatattgcactatcttctcctggcttctatgggataatatagccaacaacctgtttcgttataaagcaggggactagaaccctcattttctagtatactctagtgtgcctctaaaatggcaaagcttctgtcttttctacctaccgcatgaaggattaataggttattcaaaataagatgagctattatccaactgggattaaaaggcagtaaaattataatgaataggtaaatatcactaaatgtttgtttgtcatttattcagcaagagacttgaccatttattagttcttcttttgtataaatttcaacaagtgccagtattgttgttgataaatgcttggctcctctgtgacacattttcataaattagtatcttaaacataacagaaacgattgcatttatttgattaaatcactatagattacagtgggtttttttttttttttttttacattttaacattcaagataagcactagaaaaaatagcaatttgtttggaagaaagtagctacttattttataagtagattgttcttagatacgtattactaagggattattaacttttctcattctatttactcatagcatattttgagcaagtgatttaatcatgctgtgcctcaacttctagattagcagactaaatattacaatatcttggcaagaaaattaaagtaatgataatggcaatatagcaactaaattccatctcacaattacagctattaaaaggatctagagtcagcatgaacttaaagaaaagcttaactgttccagtgacgtgtatataaaaactcaatataattgcgaacaaaaatatacaacaatttaaaggagacagtaatagggactcaaacgttaataagatgtctaaaacattctattttagtctttttcctaccagatttcaccagaatatgtcattatgtctgattttatttatttcttttaaaatctagccattatctccgtcatgccctttgatttgtttcagaagaaagctgattggcaggcggggtaaaacagagggaggcagcttttcagtagacttttcaaacacatattgaggtgatactcactcctggctaatccaggaatgccattaattagttaagctcatgtcttaactaggagtcttctcctcaataagcaattcacttctcttcctggtctatccctcaaaactaagaatgcgtttaccaaacaagattatcttacagctacagagatcacactccacatattcttaacctaaatattttattcactgatcttgcagagaaaaatttgtttggacaagttaacagttttaactggaatttatgttttaggaggaggataaactactatttctatgcaaatattactatacttttagaatccatgtgaatagtataaaatgatttttctctaaagcctagaatcattaatgtaatggttaaacatttctgcaataataaaacataaaatacgtggaaatactttatatattcaagttttaacaatcatttaaacatattaaaggtgatccaattttcagtcttgaaggaaggtcattattctttcatgtcaattctttcctcatgctcttcttactgattcctgattactgattaaaggatgtgttgtacaaggagggaattttggaaaattcacaaatacatggaaattaaacaacatactcccaaacaaccaatggataaagaaaaaattaaaagagaaatttaaaaataacttgagacaaatgagaatggacacactaacactgataagaagaagcaaaagcagttctaagaagaaaggctatagtaataaatacctacgtcaaaaagaagaaagatctaaaattaacaacctaaggttacatttcaagaaagcaaaaaaaaaaaaaaatgaagaaaagataaaagaaagaacaaactaggcctagaagtagcagaaagaaggaaataataaaggtctgggtagaaataaatgaaatagagactagggaaacaatggaagagattagcaaaactgtcacttgggttttggaaaatataagctaaattgacaaaagtttagctaaactttctaagaaaaaagatcagaattgaaagaggagacattactactgatacttcagaaatacaaaggatcataagtgactactctcaacaattatatgccaacaaactggataacctagaaaaaatggaaaaattcctagacctactaacactgaatcatgaagaaatagataacatgagcagatcaatgaagagtaaggagattgaatcaggaataagaaataccctatcaaagaaaagcccagaacctgatggttttactgctgaattctaccaaacatttaaggaactaataccaatccttctcaaaatcctccaaataactgaagatgagggagtacttccaaacttattttatgaggccagccattagcctgataccaaagccaaagacactgcaagaaaagtacattacagatcaatatttttgatgaacatagatgcaaaactcctcaagaaaatactaacaaaccaaattcagcagcacattaaaaggatcattcactgtgatcaagtgggatcactaccagggatgccatggtttaacctttgcaaatctataaatgtgataccttacattagtagaatgaaggacaaaaatcatatgatcatctcaatagatgcagaaaaagcatttgacaaaattcaacattgtttaatgataaaagctgtcaacaaattagctatagaaggaatgtacgtcaacataataaagactgtatatgacacatcctcagctaacatcatactcaatagtgaaaagctgaaaggtttttctctaagatcaggaataagacaaggatacccacttgcaccacttctatttggcataatactggaagacctagccagagaaatcaggcaaaaaaagaaataaaattgtcatcaaaattgaaaaagaaaaaggtaaagtgtctctttttgcagatgacataatcttacatatagaaaaccctgactccaccaaaataactgttagaactaataaacaaattctgtaaattagcaggatacaaaatcaatatactaaaattagcaacatttccataaactaacgaggaactatctttaaaaaaatcaataaaataatcccattcaccatagctaaaagaaaaataaaaaatttggtaataaatttaaccaagaggattgctatgatttggctctgtgtccccacccaaatttcatcttgaattgtactccaataattcccatgtgttgtgggagggacctggtgggagatggctgaatcatgggagtgttttcccccatgctgttgtcgtggtagtgaaaagtctcatgagatctggtagttttatcaggggtttccgcttttgcattttcctcattctctccttgcctgctgccatccatgtaagacaggactcctccttaccttccaccatgattgtgaggcttccccagccacatggaactataagtccaattaaacctctttcttttgtaaattgcccagtctcaggtttttttttttttttttttttttttgagacgcagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaggtatgtctttatcagcagtgtaaaaacagactaatacagagatgaaagactggtacactgaaaactgtaaaacagtgatgaaataaattgaagacacaaataaatgggaaaacatcctgtgttttgtggaataactaatattattaaaatgtccatactactcaatgtgatccacagattcagtgcaattcttgtcaaaattccaatgacgtttttcacagaaataaaaataaatcctaaatattttatggaaccacaaaaggtgctaaagcaatcttgagcaaaaagaacaaagctggaagcatcacactatctgactttaaaatatactacaaagctgtagtaatcaaaacagtatgctgctaacttaaaaacagatacatagaccaacagaatagaataggagcccagaaataaatctaagcatttatggtcaattgatttttgacaaagatgccaagaacacacaatgggattgaactgtctgtccagtgaagggtgtttggagcagtagatgtccacatgcagaagaatgagtatagacccttatctcatgccatataaaaaatccattcaaattctaaatgaattaaagactgaaactgtaaaactactgaaagaaaacacaggggaaaagttccatgacattggtctgggcaatgattttttaaagatataaaccccaaagcacaggaaacacaataaaacatagacaaatgagattacattaaactgaaacacatctggataaccagggaaacaatcaacatggctgctcttcaaatcactgaatttattttgttggtactatttgggtcactgctaaattggtgaataccaaactaacacagaagagattataatatacatgttccaaatgtagattataccttacctgagtataccttaagtacaacagaatatagttaaaatcacagttctttacctgttttaattgtatatagatttttaagatcatttgttcagtatcacaagtagaatctgtggttaattagaaaatatattttccctttaaatgaatttgtgctgacttttaaaattattaataaaggtgacagctagctttggtgtctatattgaagaaaatgttcatcctaattggtttccgtttgtctaccctttggtctgctttcaacacagcagtcacagcaatctcattagtacagatcacataacactttccactaaaagtggaaatcttattagtacagatcacacaacactttccactaaaagtctctactggttttccatcacattcagtgggaaaagcacaatgacccacaaggccttaaggaccttttcctcacctcttttcatctctggcctcatctgatctctcttcctcagttgcccagctggtcatcccgctatgtcttgaacactcacacctgcctcagggcctttgcacttgatatttcttatgtctagaattattttcttcaatttcaatgtagcttgtttcctcacctccttttggtttttattcaagtgttaccttctcaacaagggcctccttgacaactctatttaaaattgcagctcccagcctgtccacttcctaaaccactttcctgctttatttttctccataaaatatatcaccatctaacttactatgtacatgttactgttcagttgaatatttatctttctaaatgcaatttttttgtgcgtggagctatttgttgttgtaatcattgctttctaagcacttagaatagtgcacaacatataggaagcattcaatgtgtttgtattaagttaataaatgactgaatgaataactagtacaaaccaccaatccataatttaagaatcttattgaatctgagaattaaaggattaagtgatttcactgtgcttcttatgataaaacacactgcactttttctaattatgaaatttcctttaaggttgaatggcattgttttagtctatttgggctattataacaaagtaccagatgaggtggcttataaactgcagcaatttatttctcatagttctggaggcttgacgtccaagatcaaagcactggcagattcaatgtctggtgagggtctgcttcctggttcatagatggccttcttcttgctgtagcctcacatggcagaaggggcaaataagctttctggggtttcatttataagggtactaattccattcttgggggctctgtcctcatgacctaattacctccccaatccccatcacctaataccatcacattaggggttaggatttcaacatatgaattttaggggaacagaaacattcagtctatagaaagcgtgaagtaaattttcttccagttcctatgcatgttcttactctgcttttaagcgtattctaaatttcagttgtatctgtcactatgtgactttaccacacttacagctttatttaggaaaagagatgttaattattttaactcttcttttgtaacagagaagtctgggactgtcattttttgttttttgcttgacattgtattttttcctcatagaacaaaagttagtataaaagaaagggaaaaaaggccatacaatgatgctgtttaaacaagagtgtaaatgtaggatatgtattttgatctaaaatgttgataaaccaaattctagcaataccatgaaaatgtaaacattttggagacccagatcctatttcaaatagagtcaagatgactgccctagaaaatgcttcttgaagtcatggaataaattagatgattgtttatttaaaaaaaaagaacaataatacataggagatctgttaaaaaatctgtgaggaaagagctgttaaaatgttgaaaccacatgaattctgttatggaaagtctgaacaagactttctaaaatagattgaatgtgggcagttttcacagctgcctgatgacttccacacacaaaacatccacatttcatccttttggtggaatactgtgtattttccaattttattcttagagtttaattttttacttacatattatgcttatgtatatcatatttgttatatatattatatataactaatatacaattatattatttatttaaaaataaggaattaaaaacaattatattatttgtttttaaataaggaattacaaaataatgaagagaccgtatttattatagatcttgaaactgtgactaaaaaccccatgcacagagaaaattcttgagtcaaatggcttcattgatgaatagaagttagaatactggttattgttacaaggagagggaagataatgactgggagagggtatgaggaaagtttcatttcttatttttgattatataattgtacaataataatgtgttagtacatagaactaatataattgtaaataagtgtgtttatatataataaaatatacaaaatatagataatatattgtataatgtataattatatacaatataataaaaatgtgataaataatattgtataatatataattatatacaattatattaattatatgtactaatgtattagctatatgtatttatatgtacctatatataagactttttctagaaattgactacatatttgaattgtgagacagcatgtatgttttgattcatagataagatatgtttccaatattacccatatctctaaaatacaaacatggcaaaaaaaggctggagtgagactaaggagaaaggaggagctataagtgtgcccagattccatttctttacctatgacttatgcgttggtacatttaccttaggtaacttgtcccacttttatgctcttcaatttggtctagtgtaaaatggagcaaataggcccacttccttattacgaggcatattataaggataaagtgatgtgttataggcaaagagcatagcacactgctgcactttaggtgatactcagaaaatattacttttggtcttccacattgaaaataatggtgaatggagaataaatgggctaagttgtaatgtgaaaaatggaaaataacaaaacaaaagctcaaaaatgctttaattactggatattgaaatgatacctatgaggttcactttgtatatcacctaagaatattattttactcaatatatttttagcactttatggacattaatatttctatggagaaagcttaaaaagtgtcacttgtgcattgaaactcttttgtaacagcttctttactcttctgttgttgtcatgatatcctccagattacttaaatttttaaccaagaagtaaccttacttattactagtatgctctttccttaaaagcttttctgatttatgttattttaattatatcaatcttgttattatgtacagtttttaattattttaataatttcaacctttctgcaactttccattttagatatgtctcattaatggcatatagtgaagttttgacgttttgtctagtttggcagtgttggtcttttaatgaaacatgcattttcagtggatctgtgtgtatctaagtgaagcatgtacacagaaaaggtgacaaataaaagtctgagagaatttttgctaaatgaaccttcccaagtaactactactgagacaaaaataaccagcaacccagaaacttccctcatgccttttccaatcactatcttgccttctcccctaatagtaaccagtattctaacttgtattcaccagtgaagccatttgatctaggagttttctctgtgcatgggttttagtcacagattccatatctataataaatgtgggactcactggagttttcatttcttatattttcagtttagttgagttgggcttttcaagaaattgatccacttacctaatttttcaaatatatcgacatgagttgttagtgatattatcatcttttaatttacaatgatctgtagtgatgccctttttttattccagatattgttgtgtaacctttgtttttcctttacagctttaataggtcttcataatttcattagtctttttcaaatagccagttttgggcttgattgattttctctatcgtgaaattgttatattgtattgaatcctgctcttatatgtcttgttttttacttctcgttattttttattttagtttactacattttcttagcttcttgaaatggatacctatgttattaatatttcagttcttttttcctaatatatttattaacgcctacaatttgcctctacatagggctttagttgcctcctacaagtttgatatattgtatttttcattatcatttattttaaaatatattctaattttcatagtaaatttttctgtggcctctgagttatatagaagtgaagtgcttaatttctgaacaattgagtatttttctaatcgttttgtttttgttgttattcctttcctcactaattccactatggtcagtgtattttcaattctttgagactaaactttttgagacttgtttttatccaacatatggcagtgacttgaaaacaatgtggaccagttgccctggctcactcctgtaatcccagcactttgggaggccaaggcaggcggatggcttgagcccagaagttcaagaccagtgtgggcaacgtggtgaaacctcatctctaccaaacaaaacaaaacaaaacaaaacaaaaccccaaaacaaattagctgggtgtgtgcctgtagtcccagctattctggagtctgaggtgggagaatcacttcaacccaggaggtagaggttgtggtgagccgagattacgccactgcactccagcctgggtgacagagctggacatcagaccctgtctaaaaaaaagcaaagaaaagaatgcagattctatagttgttggttgcagtactacaaatatatcagtgagttatatttatatatattgatacttttaaattagagacatacaaatttaggattattaaatttaataatttaaattttgtattaactcttttgtattaaccacctttttaatactactgccagcagtacttctatctttagagtgtacttttgtatgtagattcactagcttccttttttctctgtgtttgcgtgatataggttttctcatatgttgagtgtacttatatttaaggtgtatcttctgtgagcagcataaatttgaattgtttatttaactaatctgataatcttttcctttaaattggatacttaattcatttacatttagtgttactatactgatatatgggttcaaattaccatattctcatctgttttctgtttgtcttatcttttgctaatttttcttcctcataactttcttacttttggaatactgaaggtttttccctatttaattattccatttcttctttcattagcttgtcttctgtgaagtcttttattactcatactaattaccataaatatggtaacttgcgtccttcatttatcagaactttgtaatattttacctcagtcccacctccccatcagatttaattctatagttctcatatgtttaattctatgtatatattaaactccataggaagtaattgttaccatcataaacatgcagttttcatctaattttaaacacctttaacttttttgtttattttttgttagtatactttgtttatttatttatttctgttagtaaacttccatcaagaaagtatcccatttcttttctgccttttttaaatgaaagcctgctagtgataaatctctcatcttttgtttgttttttcacttttctttacttttgagacttattttccaccaagtataaagtagaatttcttgcctggttggaattttgttttgttttgtttttttccagcactctaaatatatcctatcattattacttgtttttcattatttctatcatgaagtaagcggaaagtcttattgctggttcttggaaacaagatcatttttcctttcactccattgaaggctattttttttaattttgcttttggtgttcaggggtttaccacaatgtacttaggaatgattttattggtattaatactatttgggattcaaaagcttctagattctgtggatcaatgtctttcaccaatttggtaaaattcttagccgatattttctcgaatgttgttactgtccattctttctctccactctccctgagacttcagtcacatccctgctagaccgtttgccgtgctcattatgtattctatggcttcttttcatttgtcttctcttcttttgaggtttctcagtctgtacattttctgggtgacctgttgtttggtataaataatcccttttttctgctggattcaatcttctattacatacatttactggatttttaatttttgtatttttattttttagttttagaatatccatttgatactttaaaaaaattagactccaaatatctctccacttagtcatctggaacatattaataacagttattttaaattatatgtctgataactctgacgttggaaacaactgggagtctgtttctattgtcttttcatgcattcctgttttatgacaagcttggtcgtttttgattaaataatgtatgtgtctgaaaatgtataaaaattctggaagatgttatttttctcttaaaatgatttattttcattctgtcaagagttagtgtagaggcaagttgctttgcttcagtcagcaactcaaatgttttgtagcttagttagagattctgatggttgtttctagtttactcttagttctagggatagactttcaggactccagtggaaaccccgacttgtttaccacactctttccttcttggctgactcttaactccaaagtttgtcttcccaactctgggagacttcccaaggatcttcttagtttttcacttctcatgagttcatttttgcatgatgtttatcttctggctccttcaccacttagaaattggcaaatctcttgaaggcaaaagctgtgaagaatgtaggtctcatttctctatgaattatggtccctcacatcctagctgacttcatagccctgaattctaatgtttatcttcttatcctgtgagattgctgaacacactaagatgtagctttctctataacctcctattcaactgtcagcaaatcaataaaagtaccctgagaggaaaatggctagcttaccttaatttgcttccctttacttaagtctggctgccttggttgcttgctgatgccttcaaactgctgtttttagtattttatccagcttttatggttgttgtctttgagagaaaatggaaagggaaaaaatatttattttatttacagttttaaaaacaaaaatcagcatattatctgataaaattattattgctttttgtgaatttaaggaatgttctgaattattgcttcaatattaaaacaataattattggaacattttgatggattatgaagaaagaatatgtaaaattgggatcgtgtggaaaatctggtatgcatgaaattggcatataaagtaggcctaaacaaagcaggtgctattcttagtaagaagcttcatgccccttatggcatatctgccctgaataatacataaagaaaataatttaacaatatgcgtttgaaaaatatttgttgagcaactactgttttttaagcagtgttctaagcctgtaggtctgtccatgaaggagacaggagtccttgcattccagggttttcaagtaaacaatttagaatagtgcaagttcatgaaaaaaaaagcataagattataataagattatagacggtgatgaaagagctaatttacatgtatgttctatgtatgcatttttcaggaagtgatatttgagctgagaattaaaaaccagaaaataccagtcatagaaaaatctgggtagagtttattaccagcaggaataaatgtggggtgctgaggaaaggaaagaaggccaatgtggctggaacctagtgatcaagagcaaaggtggcatgagatgctgtcacggaggtctccaggtcttcttagctcctgaagggagtagtcagtcatgataaacagtttatattgaattctgggtataatgagaaacccgcagtggtatttaagcaggtgtaacatgatttcctttatctcattagaagtaacattctgctaaatggagaatgattatagtgagataagtgtgaaaactaggtggcagtcaggaaaccatagtacttttttagcaaagagatgatggtaacttggaatagagtggtagtagcagagagaagtggcaggctgagatttatctggagttcggcatcacccgaattgatggtggaacaaatgtggagagtggggccaaaatgttgactcctaggagtttggcctgaagaaattttcctgaaatagtatggattaaaggaggagcagaatggagatactgggtggcaattaagggtctgttttaacgtgttatctttgaagcattcgagtggtgccaggcatggtggctcactcctgtaagcccagcactttgggaggttgaggtgggaggattgcttaagcccaggtattcgagaccagcaaccagcccgggcaacaaagtgagacccctatctctacaaaaaaaagcaaaaaattagccaggcatagtagtcccagctactcaggaggttgaggcaggagaatcacttgggtccaggaggtcaaggctgcagtgagccatattcatgtctctgcactccagcctgggagacagagcaagacgctgtctcaaaacaaaacaaaaaaattattcaagtggaaatattaaagggacaattggatttatgagtctggagttgagtgatgtgcactgggaaagagactgtacttaacagtaaaggcctgtttaagatcatttagaaagcaggtatagagataaaaagagggcctataattgaatcctaggcacttcaaatttaaaggtggtaagatcaaatacatcaagaaagagggaatcttcagctatggcaatgcagatgctgtgaggtacaaattaaaccactcaggtcttggaaatacctaaacatagggggaaaaaacacctaaattgtaatgagtatatgtgtgtatatatatataaatatatataatatattatatataatatataatacatatataatatatcttatatattatatataaatatatatatataatatatataaaattagagaatctttaataagaggtgaatggctccaaacacagatttaatttggaagctcccaccctagcaatacctactggtgttcattttatttatgtaaacacacaaatgttgactatgtaatttttcaattaaggaaatagccaataaaattgtgtggaaaaaagatagcggtagcagataataacatcttttacttactaaagagattgtgtctaaatattaaaagtaatacattcccttgtcaaaacacttcatttttgtttgttttcacaaatattttaatgtggattttgagtcaaattttctgtaggaaggtcatggtagattaatgtcaaattagctgaaacaataaacacaatgaaaagaaaaatcagccttgtaagacagtacaactaaggagatcagtttaaaacactaatgaggagttgcctctcagcactgggtcattatgattatactaatataataagttaggttcaggttagaaagcaaagatgaataatcttcaaaaggcacagtaaatagtcaatttagttgtctaccttcataatatttactatttccatactaaaagcttacagttgtgggctagaatatatgatattcacgtaataatatttaaattgaatttcatttttttgcttcttcattatccttacctctaccctcctcaataaattcatctcaaatgataagattttccatccatcattgtgaagaataatttatttacttaatgattctggaaatatgggaatgtttataaaacgaaatacaaaaattaagaaatggagtgggcaagtaaaaagacattttcccactgattttagaatatactcaagaaaattaaactagtgacaaaatagatttatttaacttataagctaattcataaattaatggcaaaatttatcacagtatacataactgagactttgcagatttttttgtaaatagataacattctgatacaattaacagatctccatcagctgcattagatttcaagttgccctgctaccactgtatatatgcacatagataaatatgtatatgtagtgcaacacagatgagaagatataaagttgttttattttgttcgaatatgtattacagagaaccctatgtgctgtatagcaccttatatatctttcttttaagagaacctcataggacttccaaattcttcactgaaatagctcctacttcttatattacctttcgatatgtcagaaagattctttttctggaagctgttgttctcatccacatcattgcacaggctgacaatcaagacactatttctcactttctttaaaactaaatcaggatttgagggagtggagggatgactaggcagagcaaaaggatttttaaggcagtgaaaatactctgtaggatagtataatgatgggtacatgtccaaacccgcaggacgtgcaaggccaagagtgaagccgaatgtaaactataggctttgggtaattttgacgtgtcaatgtcatttcatcagtcattacaaatgtactactctactgggggatagtgataataggggaggttatatgtttatgggggcagtgagcgtatgggaaatctctgtatttttttttttttcttttttgagacaaagtcttgctgtgtcgctcagactggagtgcagtggcacaatgtcggctcactgcagcctccgcctctagcattcaagcgattctcctgcctcggcttcctgagtacctggaactacaggtgcgcgccactataccccgctaatttttgtgtttttagtagagacaaggtttcaccatgttgcccaggctggtcttgaactcctgaccttaagtggtctgcccatgtcagcctcccaaagtgctaggattacaggtatgagccactgcacctggccaaaatctctgtatcttcctttcaattttgctttgaacctaaaattctccctaaaaaataaaatattaaaaaataaaagaaactctatgtaccctactgactctttgtcaaagattatctattttttttctcaactcatgcaatgtttaacactttggaccatattatcacttatggttagcctcttataatatggtatggctatttttttaaaaagtcatggtaaaatgacataacaaacaattttttatcttagccacttttaagtgtacattgttgtgcaaccatcatcaccattcagctctacaatgcttttcatcttgtaaaatttgaaatactgcacccattaaataataactccccattctctctcccccagtccctggcaaacactattctaccttctgtctctataaatttgatcattctgggcacgtcatataagtggaaccacacagtatttgtccttttgtaactggcttatttcattcaacatagtgtcttcgagattcttccacgttgtagcatatatcagagtttccttcatttttaaggctgaataatattccaatgtctatgtataagtagactcacacacacgtacatatatggcacattttttgtccattaatccattgatgaacacaggttaattccaccttctggctattgttcttaatgctatgaacatgggcatatgggcttcaatctttaaggtttcagttactcatggtaaactgaagtctgaaaatattacatacaaaaacattttaagagagagagagggagaagctacattcacataacttttattatattatattgttgtattttttattagttattgttgttaaatctcttactgtgcctattttataaattaaacttcatcaaagatgtgtgtgtatagaaaaatacattgtatatatgggcttcacgcattgaatgagggtcttaggatgtatcccctgaggataaggagggactactataattctactgttaattctttgaggaaccactatattgttttccatagtggctgcaccattttacattcccatcggccatacacaaggattctaatttctccacacccttgccaacacttctttttctgtttttttttttttctttttaaatagttagcatcaaatgcgtatgaagtggtggtggttcatattttcagtcatcgtttcccagtatttcttgagacaattttgaaatattgtaagagatataaaataactttgatgttggaaagaatagcagtgaagaatgcccatgtaaaatttgagaatcttgaaacatgacagatacaacattgcattaaaggaaattaaatcctggacaattttgcttagcttgtaagtacatatacaacacatatacaaatacatgtacctataagtacatataaaatatatcctttctaaatttggctatattgtcagatacctgagaaaattattatctttatagcctctgtgatatgtcgccaatgcaaggcccatgaaaactcaaaaagagtcagttagtaaatgaactcttttattatttgtataaattatagtttttataatttaaatgtaacatatgaatacttgtgtctggaattacaatagacacatttttatctccagagagttactactggcactttttgaaatcctgttttgtcctagacactggacaaaatattttacataaattatcttatagaacttttcaactccgtaagaaagatactattataattagtacattttgtatcacagaaattaaacaacttcctcaaaatgacacagttagaaaacaatagagcacaagatgaatccagttctttctgatgtcaaagcctgccgtgtatactccagatgacctgaaccttagagtaactaaaagcatcagggcttctctgatatataattgtgagaatctcactaaaaacaagattaaattactacagaggagtcttagaatttaaaactctaaaaagtgaaacttaggatttaccaaaaatgtttctaacttctcatatacatgtatggatgtaacctgaaatgctgggttgattattgaaatgtccatatgaacttacaaatttaccagaaaaaaatcaaactaccccatcaaaaagtgggcaaaggatatgaagagacacttctcaaaagaagacatttatgcagccaacagacacatgaaaaaatgctcgtcatcactggccttcagagaaatgcaaatcaaaaccacaaagagataccatcccacaccagttagaatggcgatcattaaaaagtcaggaaacaacaggtgctggagaggatgtggagaaataggaatgcttttacaccgttggcgggactgtaaactagttaaaccattgtggaagacagtgtggcgattcctcaaggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccatcaatgatagactggtttaagaaaatgtggcacatatataccatggaatactatgtagccataaaaaatgaagagttcatgtcctttgtagggatatggatgaagctggaaaccatcattctcagcaaactatagcaaggacaggaaaccaaacaccgcatgttctcactcataggtgggaaacgaacaatgagaacacttggacacagggtgggtaacatcacacaccggggcctgttgtggggtggggtgaggggggagggatagcattaggagatacacctaatgtaaatgacgagttaatggatgcagcacaccaacatggcacatgtatacatatgtaacaaacctgcacattgtgcacatgtatcctataacttaaagcataataataaaaaaagaaacttaaaaaaaatgaaatgtccgtatattttcttgattttttccaaatgttttgaagaaagtttttgtattattaaatgctattcattggtcaatttaagtaatcttcttttaagaaatcattcagaaattgtaggtccttgatcgtaattctttttgggtaatttcaattgcaataggttaaacactgtgctggaagatttgagaaagattatcattggtccattttgtcaaaatcatttccagaagtttaagtccttttttcttcatttttagtgtgattcattgattttcctaaggaagaacatttaacttctctcagtattcacaaggaatacctgcttgaatgtttaagtaccaacagaggatttaaagttcttattacttatgagcattaaatgaattcaatactccaaattttatagaagaagcatttctgaagatagaaaataaggataatttttaaacacaagaaatcacatgcttttcatatcattatcaatgtggaaaatgctaaaacaacttgctattaaaaaccatttatcagaaacttgtttaattaatatgtcaaatatctgggtttttaaatcatgtataacaatcaaaatattcctaaaaacatattgagaactttaacaaaacattttacagttggaatgaaattagtactggatgattggattaaaagccagtagaaattatatattatcctatttaaatgtaggactatataagttattggtaatcctttttcgtaattttattactttttccagtacctaagtggatactggtgactggtatataataagtaaccaatgaatagatattgaataatgcattgctttgctcaattttctcatctctgagctttcctgtctgtgctactgcaacattactttcttaattatattctctcactccactgcaataatattacagatgttattccctgattaagaatagtataaattgacaatccaacccctcaaatgaaattttttggtgatccaaacgttttaaacatccaataaagatataacatgctagttctctagtaggcacccatttccaggtttccaaacgtttcaacaaaaacatttatatatttctctattgattgcataatgtggagattctgttttgagaatgcacataaagtatattatattctgaactgtaacaaaatgagactctaatttattcacagtcctttttaaatttgtctgtatttttgttttcctgagaaaaatcttatctttatagcctctctggatattgaatatcttgagactagctttaattctcttgatttttattaaaacttctaattccaactttattcgtgaactacatgcttatataaaagtacgtttcatcaaacagctttctctttatctctttaaaatcattaccttttattattttcagtatgctttaatgctttaaaattttattcttgaaacatttggtttttccattgctactttcctattgattgttttcctcatatgtatcttgagattttagtctaggttttataacaagcatagctatatttacagatattttttctataaagttttcaatatagattctgatttttttatcttataaaaaatagttaacaccattaacgtttggatttatttctgtctagttctcctctgctcacacacacacacacacacacacacgtgtacacacaaatacatatatataaaatgggcagcacactaataaagataaaaataaactttataaagttttacattttgtaactggatattatattgtgaacatccccatgtaactgtgtagtatttgaaacttagttatttaaaaattaaattgcaaatgtatgatcttatagactattttcctgcttccaagacttctttggaactgtggactccctgaaatgccagggtaacataagcgagacagaacagctagcagaacctcagggaataccactgactttatggtgtcagccagtatcatgagagcccacaatgttgcctttcaaaccaagtgatacatttctatcaataattaaataaatttgaaagtacactgccattgcatttgcaatcttctttctttgttctttattcattgcaataataaaaacaaacaaacaaaaaacaacaccaaatcaaatgactgttgatgggggaattataagaatagatgggagtgaagacccaagctgactttacctccaactcaaagatttttgtccactaatctaatttctctttctctctgtgtttgttaaaagtttcaaagtagatgtaggttctcttgccaagttgatactcgtgttctttccttttcaagattacataaaaagtatagcttagatccaacgtatcaacctggaataggtgaaaatatcactattgattataactagtatttaacgaggcttaatatggaccaaacactgatctaggtatttcacatgtattatgttttgtaatcctcacaactttatgaaggaagtatatgtgtgagaaaagatacacacgattagattttgagagccagtgcaaactgcaccgcaggtgtattgcctgttcaaatttttctttaccactctatattaacacctaagttaaaggccggcacaataagcaatgtgttgcttgataatatttgtaaaacaaatggattagtgaacaagttaatatgtcactctgtggtctttaaaatatatatggaaatgcagaatattaaaatctgcaatacatattttgaaaaacaaaggtgagagtaatgctagccaaagcaggtttgactgcaggcacaactgtccttcccactcttcttaattgaagagtcacctcaatccccatttgaatgttctcttttcaacctcctaaaaagattactgagaatgtagatatttaaatgtattctgttcatctttaaataatttcatttatgtttaagctgcaaaaattgatctgaagttagtctggtatattgtgtactttaagcatgtgatacatttctaaaatgttgttcatgtcaagaatatctacaattcaaatcatgaccttcttttggcttgtattctaattttgaagtttctgacctagacacaaaaatgattaactgaagaattttaatagttgtactgttgttcttcacttctatcagtgatgatatttgatagtgtaatatgctgagcaggcaaacaatgaaaaagtcccctccatgcaaaatgtatgtaaaatcagctttcaataagtgaacagtatttactacctgctgttccttttcaccatttgcagtaccattcttagactcactgcaggcataaaccctgggataaggaaaagttaagcctccattcttcatacctctaataaggctttgccaatggctgcaatcattttacaaccatccacttatgtttaggtttaacagagtcttggcttcataatgaaatacttcattaaagtatttttatgatatctgtttacacatatgttcatagtagaattacatggtgttctgttatccagtctttgccattcacatggactcagtttatagtgtctggttatgctactgaagatcttcctgctttaccatttgctgttaagtaattgtagtcagacagactgcccaggaagccccatggactcagttttatcccttgggtatcacaaatgaggaagagtttgattccatattggtgaaatactacttctgtttcctaaagatatgttgttttctaagatttgcttctagattttgtgattaaatgttttattggacagggatttaagaatcagaatttcatgacattttgtcctactttaaatggaaatgtctatagacttttctagtgaaggcttttacaaatgttaagggatgattgaatgctcacagcaggacacatggcattacagaaagtctccaaaattattcatccttttggggacaactataaccatgattttttgtgacactcataacctgttgaattggaaaaatattaatgttagaaatctgttctcatgtcacttttaaaattcttctccttttttgcctcctgtagcatgagtcctagtttgattaaactagacacttgattttctccaatggtaacatgtttttaaaaaaggacttttactctgttggaaccaattaggccaatgtgaggaactttggaaggaacatgagcagccaaacttgctaacagcaaaacgtatttttctgaaggcagcatgaaaaggacggaggagttctctaaggactgtgagttccacgggtccttttgagcttcagaaatccagctctcagcacttcataaatcatttctgacctgatgtcactgaagttgtattattatgtggttagtataaaattcagaaaaattgggagaaaatacaaggagaagaatttgcagggtgattgttgtaagatttttatcatgtcctcttaaaaatggtagcttttcagaaacttttgttaactgctttgcattccatcttgagaaaatgtctgtatagttagatgagcatcatctcctctccttgtttttaaatcacatccaaaatgacatcaggcttgcagccgtctcattttttccttttatttacactcttcacacttcattggcaattgaggtcaccactttaaaatttagggtgaaggctaaagaccagcttgacaaactgttggcggaatgctctcttttgcaagtcttcgttttgaagaaagaatgtgtgatttagaaatatttaagattgtcattttggtagaacttctcatctatcaatgcagggtgcagcatccctatttattaatgttgtgttggttagatatgttcacccattaggtacgtgcagaggtacctgaaaccatctgagaggtggtatcccatttttcataatctattcaattgaactttaaaaataactgagcatcttttatatacaagacattaacagacatttatattctatggtatctactgctagcaacttataacagttttggtggtaaaataaaggcaaacttgcttcataacaaaacaaaattaaattatcaaaaagaaatgctcagttgttaatttaaaatataaaatgagacatgagaataaccttaggttagaaattcagatgtagaaaatatctgtataaagaagttagttgaaatactcataggcatgaaaggtattttgcaaaaagcaaaagtaggcaaaactggatctatgaagttgctccataatgtactagtcaggtgaagtagcacaaattacctagtgtatcagttttcttttgttaacacaacatattaccacaaacttaatggcttaaaacctcacaaatttatctcacagtttaataggttagtagtctgacacaagtctcactgagctaaagtccaggtgtgggtagtattgcatttctttctggaggctctaaggtagaattcattttctaaaattcattcatttaggatagaagctgaaagaatcagtttctacaggctacctgcatcctttggctcatgaccccttcctccatcttcaaagccaggaacaggttgaatccttcgttgtaccaccctaacctcttcttttgcctccctcttatacttttcaggacccttatgattacattgagcccagtggattatccagggtgatcctttcatctcaaggtctttaactgaatcatatctacaaagttccctttgccataaaaagggtcatattcacaggttccaagaattaaatatagacgtctttgagggaccactgtttactctaccataactagcctatctcatttcaattttctaatcagttactacctgtctcttagagttcttgttagcagaaacaaatttctgtgtaataaagtgcctggcaaaaagtaggtcctaaataaaatgttattttccccaagggaaagattattaggaattataacattgggacacacctttgtttaaaaagctctaattaacaagaaccacagcaggggcgcacatacaggggttggagagaaattcagttagtgctgtcttctggacactccttctatcttcattctctcctctgccattgttaaccttccattttaggcaaggagctgtattaggaaaatgtggtttccttttattaaaagaaaatctctaaattattaatagatattacttttccaaagaaaatttcagaaaggagaagaacaacataatcaaaatctgtggacactttaaagataaggatgatggagaaagactgaattttgcaagcaggttataataactcctgagagtgattgtaatagggtgattaggtcatgcatggactacaagggatcaagtagaaaaggagtggtaaagtagtaaacagcagagggtacaggctactcttaagaaagtccctagagaaggataagaaaatggggcaatacataagcttggaaatagatgatgatatttcttttttttttaatttaattttatttatttattttttttattaatcattcttgggtgtttctcacagagggggatttggcagggtcacgggacaatagtggagggaaggtcagcagataaacaagtgaacaaaggtctctggttttcctaggcagaggaccctgcggccttccgccgtgtttgtgtccctgggtacttgagatcagggagtcctgatgactcttaacgcgcatgctgccttaaagcatctgtttaacaaagcacatcttgtaccgcccttaatccattcaaccctgagtggacacagcacatgtttcagagagcacggggttgggagtaaggtcatagatcaacagcatcccaaggcagaagaatctttcttagtacagaacaaaatggagtctcctatgtctacttctttctacacagacacagcaacaatctgatttctctatcttttccccacatttcccccttttctattccacaaaaccaccatcatcatcatggcccgttctcaatgagctgctgggtacacctcccagatggggtggcggctgggcagaggggctcctcacttcccagaaggggtggccggtagaggcgccccccacctccctcccagacggggtggctggccaggcgggggctgccccctacctccctcctggacggggcggctggcagggtgggggctgcccccacctccctcccggacggggtggctgccgggcggagacgctcctcacttcccagatggggtagctgccgggcggaggggctcctcacttctcagacggggcggctgccgggcggaggggttcctcacttctcagatggggcggctgccgggcagaggggctcctcacttctcagacgcagcggccgggcagagacgctcctcacttcctagacgggatggcggtccggaagaggcactcctcacttcccagactgggtagccaggcagaggggctccttacatcccagacgatgggcggccaggcagagacgctcctcacttcccagacggggtggcggccgggcagaggctgcaaactcggcactttgggaggccaaggcaggcggctgggaggtggaggttgtagctagccgagatcacaccactgcactccagcctgggcaacattgagcactgagtgaacgagactccgtctgcaatctcggcacctcgggaggccgaggctggcagatcactcgcggttaggagctggagaccagcccggtagatgatgatatttcatttgcaatagctaaaattgactaagtgttaagtgactctgatctgttgaaagaattcatgaaccaagatcagaaactttcttctgtctttgatttgttattctactctgttaacattatacttctaacacttcccatcactacaaatctttgctattagtccccaaatgctttgaactagagtgattcatttatgtgtgtaatgtcataaattggagaatgtgtaggttcatcttaccttggtaaatacagaagcacaaaaaacaaaggcaatgccaggtatttctccagggtgaataaattttagaaggcaaatttaaactgtcatatttctgattgcctgtgattcacaccattgttgtactctgtgacagtttcattgaaaggactgtcatgttccatgaggaactcagcctacctgctcttttaccagtagctggtgggaaagccatgctgtgccaatgacttattcacaggaggcaggtcaatcttttgaaaccacagattgtttcaaatgagagaaaaatatgtgagaagagaatagatgtcaagggtagtgctaaagacaaggaaaatgcttgcctgggttttccctgcagctgacgttgttaaaaatgatagcaacttaatgaagcatggcgtactaaatgcattaataagctgagggaggaccttattcattccaatttggactctgctcactcgtgttactcgttttcttaagactggactaaaattgtgagaccttatgggccaacgataccctttagagctgataattaatttgaaagaattattaaagcatatttcttgagctaagaatgcagtgtattcacagtaagaggcagagttaaccatttatcaagataattaagaaaatgcattaaatgtttgctccgtaagagcaagcactaaattaccagtagtagtaatattattatgtgaaagggaatcaatagtttgtttactaaaatgagatgcattagcaagcttttttattctgatataaaaattttcaaatatacacaaaagtatagagaataccgtggactcaaatgtacccaacacccatccataagtattaactcaggacccctcttgtatcagttttcaacccatccacatcctactccacccctccagattattgggaagcaaattccatatgtattactcgctttgtaactacttcattatgtatctctgaaggataagactcttttataaaggaaaccattgtcacatctaaaaattaatactattatactgattctttaatattaacaaatatttactcagtattcaaattcatcacacctgcttccaagttttttaaaaacagttgaatcaggattcacaagaagtcacatactgcatttgttcgatatatctaggtctctcaatcaataacattttaacttccttgcaacttatttttttgaagaaaccacgttgtgtgtccagtagtgtttcttacatcctgcattttgctacttagggttcctgtagtactgtttgcatatttctctactactatatttcctgaaaactgatagataaatttagagagttactctgattcagggttcatatttttggcacaaccactttatagattgtgctatgtgcttccatcacactgcagaaaatatctgggtgtctcttttttggggatgtttctggtcattgatcagcattaatggccacaggtccatcattttatgggggctcccttcatagtaaactgcacagtaaactatacacagtgaaccttgtggtaaactgtagcatcctgtgtactatagcaatttactccatgttgcttttttcatttaacaataaatcccgccattcattgctcttccatctcagggttttcttgcttattattgcttgttaaaattcttccaaatcacatttataatcaagtcgttcagcactaaggaaaaaaaataacattttcatgaaaaaatgaaattgcattacatttatatattctcttagggacattgaaaataagtcttgctatttttcagagctagactttgagatttgcttttttgcagagtgagatagagaagtccttcaaatactgtcccttgaagagttaggcattgatttaaacccttttgaaaaacaatttcaacaaataattgaaaatgttctcttcaaagtattatcattagtcatccagttagattattattattaggaattctgaggtggtggaataattcattttccaatgtgttaacttctcatgagtttaatgtgagtataaaaagtctgttttaactgagggcagagtattcctttttctcttataatacaggagccagttacaacacaggaggtgaaatggcctgtttgcttacctgcaacttcaggaatttcatgcttagcaattaattgcagtacacacttgtgggggtaggggtaggaggttggataagtgggttgcacttaataattcagtgacaattacaaatcgtttcactatatgtgaaagtatttgaagtaaatttacctgaagatagaaaatatgggtgggcaagctcctcctgaactccccaccacattattctaggtttattgaagtaaatgtaaacttataaggggacataaaactcacacagaaaataataattagacatatttccacattaatgtttttaagtttaaaacatcatttaaaaattttatcactgatgcttgacttaaacaagtccacttatagcattgtcagaatctgtataagtatctcttcagggaatttttaagatgagagtgaacaattttctgagattgcctacacatttttgttacacagtaagagccaggttctatgtggcttaggtggggatggggctttgagtgaatcctctgttgtacacagacttaatacattctccatttcagcccacttttcacctctgttttcatcagacctacctcggtgaggttctagacttctgccctgctgcagctactcagtactttaggccatgacctccgctctccttcctcagcaactcaccacagaccttccagaaaaatgttaaacccttctcatccttttcttgttattggtttctattttctttctttcttttttctttagcgtcacaggggaagagctgataattgtattggctatatgtatcaactcaaacagagagacattacctgcagttctataaagattcccagattattccaatgggtattaagcttgaaaacatgatgtctatgatcctttctggttctgatattgtataactctcatcacttaatgaaagccaccgttcctatttggataaataagagaattgaaaaacgcactattagaactgagagtacagatgagctttccaaatatattagagatggcatcacagtacatggaaatgttaaaatccataacatgggcaagagcacatactagaaaagtgcagaacctctttagaagtgaagcattttcgttccatgcacatcaatttgctataggagttcagggacaaatagcaatatgggaaggaggcggagctcaacattgagcagaaattagacacatgctgttctcttgagagattaagaaagaataaatagaagagagtaagtcaggtcctatgagaaggataaagcattgtcttccatagagagtgaccttcattaatattttttacggcttttgtggagatcagcctaaggaaacagaagtcctatggccttattacatcattacagaatcacactttggctgggtctcttaactgtgtaacagtggtgctcaaaagtctctgtaaatctccaaaacacaatactctttagtagcatttcttagatttgtgattcttctggggacaaaggatctgggatacaatgggttcccgagtgcagtggtgtgatctcggctcactgcaacctccgccttccgattttcaagcgattctcctgcctcagcttccggagtagctgggattacaggcgcccaccaccacccccgactaattttttttttttgtattttttagtagagacggagtttcaccatattggccaggctggtctcgaactcctgacatcgtgatccgcctgccccagcctcccaaagtgctgggattacaggcgtgagccaccgtgcccggccgaggatttttttttttttttaaatcaagacttagcaatgcatgttctagaaactgattctggttttcagacttaactaacatgggtataggtgagctaagatattaagctgcagggaagggtctagagtagctagagttcctgggctgctcacttcaagctatgaggtctcctgaacactggtaaaaaccccagtgctgtacaaatatcattttatcttagccatgatgttcaagattggaaagcataactctatgtgatgatcattgtccgttgcttattattttgagactaaaggattcttaagaaagaccctattctccatttccacactaaatgagatcaagttcttaatactcttcttattataggaggaacatctaattcaatgctacatcagtaattaaatgatattttgttaggtgacatgcaaatgagtaacaaatggaatatgaaatagaaagttccctttgttatgtaaattgtcaaacacttgatattgtttttaaagttatttgggatttttttaagacaccaagtttgtaacaagtgcccttcaacagaaaagacacttggatatcatgagatgttctcttaggttcctcaaagcctagcagtcatagcattttaatacttactagtggggagtctgccttccctgctgcacaccagaacagactggggtgggggttaatcatctggaaatgaggtattataactactgattttgaagagtctttataatgaaaacaagacacagttaataaaagtagcatagaaaacattagagagttattttattagggccattaaatatttggagtacagtacttagaaaatcactgttaaaattgttacagttactctctgaagcctgctaagaatactgctatttattacatttttaataatgctattcactacattttaaaagtttactcaaaaactacatgactttcaagtcatttaagaagtccaaaagaaattccatgccaacaaatttaattaattttgcatggaatgtgaaagaacccatagaaaataaatgaaagagggatattgttttgaaatgggactcattcagtcttctgtaaggcggtgactgcttttccgtgtcactgctggcagttatgttgaattatagaaagagtctgtggggtctctagtagaacttctcttcgtggattatttttatctattattccagagccaacacaggagctatgaagtcataaatccacattgtagctgcatgagaacttggccttatcacatatttgcatactcagtgctttctaagcaaagttctttatccataaccttagtgtagtcttatttttcttagtgggtacctgtgatctctaatatgctttgctatctctctttttgttttatatctttaaaaaaatctctatgtttttattttttctggaaggaaacaggctcacttggaatatttacctagattctctctttcacaagaacacgcagtattttgtattcattatctcattatctcttccctggttgtgtctttagaaaagaaacaatggataacagagggtaaaagagtttcagtaattttctcagctcacagagacctaataggacaaatactccaggaacgtatgccttagttcctgcagatgacaatatatgctaactgggattcaagctctaacaaacaggcaagaccaatgtcaaactaataaccataacgtggaagcacattacagtgattttggctatccaactaaatgtaataaatatcaaatgcccaccatttcagaagaattataataaggaatatagcatctttaacccatttctcatttgcctgaagaatacttgcagacagcatttgtggcttaatgtttaccctgagataacttgtggcttactgtcctaaccttatccccaaagtttgccatgaaatatctcacttttattattatttttgcataggtctagcatattgactttggaaacaaaagacatcattctatttgtagcattctgtgtttgatagtagtatttccatatacaaaatatagtaattattgattgctgaaatcaaatcctagaaaatacagcattcctatataaaaaattattaaattctgatcatcatatacatttctgttacattaggattagagataagttttatttagaaataactctaagaaacgtttttatattttattttcacattgaaaataagtcagatttgcttcagcctcaaaaaatgtgtttatgtaaaattaaatgagagctggcagtgagctgtacattttttttcctaatgggacatgggttatgggttaaagatgtacaagctggccgggcacggtggctcatgcctgtaatcccaacactttgtgaggctgaggcaagtggatcacctgaggttaggagtttgagaccagccttaccaatatggtgaaactccatctctactaaatacaaaaaaaaaaaaaaaaaaaattagccaggcgcagtggcacctgcctgtaatccagctacttgggaggctgaggcaggagaattgcttgaacctgggaggcagaggttgcagtgagccaagcttgcgccattgcactccatcctggacaacagagcaggacgcagtctggaaaaaaaaaaaaagtgtaaaagctagaggccctggcctccacaagcccacaatttagttattcttcttctttatgattttaagaccttgtcaggaatactttgggattatcagtagttaggaccaagatatttcatattttatagcagagacaactctatctgtgcattttataagattaatccattggtatgtttcttgttgaatttctatataaagacattctacgtgatgagttgttcaatatgaactgtctaaaaaacaattccttatgaataatacctaaaaatgcataagtagcaaatatcttttatagtggttgatgtaacatattctatgttgttcctacttttgccctttctctgttacttattttactttgtctttattttaaagataattttatttaaaagtaaaacatttatgttcatacaaaaaatatagcagaatacgggatggaaaataaaagtcctcctcttttcttgactcctaaaggtggcagctttaatatgttcacataattcctctcccaaaatgtcttggcatattcaagcagttacaggcacatacatagatatgtgtgtctatctgcagttatacctatctatatgcctttgtaaatataaattcatcagtatttctcacctgcagtgatactcaataaaacagaatgctcaaagcccagacccctcaggacaaatatcttggctgtccttgctatgctggggtcaatcagatggtctcaggggagaggaggcatttgggaggttgggcagcagtgatttgtcaacaagtacagaagcatttcagtattttatccactagttgttccacaactgtgcctaaaaggctaatactaaccctactttgactcattcgatgggtgatttcccctccatggctctcaagcatgcatgcattcaagtaaacatcttgaaggaatagcatcagagccacctgtattaccgcattccataccaaatttttatatttttaaatctagtcccttagggtataccatagatcctatacacgtatgcatgagttaccatgtcaaaactatgaagcagataaaatttgtttctagagcatccctttcaggattccctctgtagctcagcagtcctgttaatcacattgtagtgagcctgtcctcccaattgtgccccaccagtgacctcatccacttagagcttagagctgccaagctctcatacctcatagcatttactagtcaagaacatatcatactgttttattattatagcacttttcatttgtctcattattacaatatattaacaacacattgatggtggaatagtaatttaaactaattcatatctgtctttctacctagaacattgtacataaatgtcattccataatgtttcttcactattcttttggactacattggtaaagacacagatatgcactaccacaaaacatctagaatatttctttttttacgtcttcaaattctatataaatttgtaaatagagcattgccacattcctctccattgtcactctgttaacagtaacaatacctctttatttcaccccttttcttgcatgtttaccttttgtaaagagaaggtacagaaacccttcatttaatgtgtttcaggttcaatccgttgtcttcataacactggaatttctcctccattattttctatttggggatgtaaaggaatggacatttattgaggatttactgccacaatgctagaaccacaatctgaacataggaatgtgtttatgttgtttttgctgtaccatactaactgcctctaaatggcacttttttgaggattatgtgatataagtaaacaagttttctaaactatcaagcactattcacactgggaatttctagcttgtattttacagtctttaacacagtaaggtgagtaaattggtatgtactattaataaatgttttaggtggtaataattataatggaactttaaacatcaggtgaaatgttgccaatgagttgttactaaaatccagtcttaatccatttcttttaaagccatggttgtcaaaacaaaacatcacttcttagcaaaaaattattagatatgaacctgtaatagtaaaatcatttcagagaacattataagattatagaataaaatctgaaataaaatctactgtagcatttagacttatatttgacataaaatgatgagaatatttgggaattcaatgttattgttgttgttatacttccctaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagaggtaagatgagaaaactcaccatttaagcacatttgatacggtgaaataggcctgtcagaaagacctgaatatatcagtaattaatgtcagggagattttaaaataggatttagcaaaagtacatttaaatgagttattaaataaaaaagaaaaacctgaggtgattagaattttaactaccttcatgtgtctcccatctccagtaaagatcagagaagaggaaataggtttaatctggaaagtcaatgattaattttacatataaagagactttctcaacaatgaggattgctaatgattagagaaggattggagaccttaaaggtggccttacatttgagtgtactttggtctgaagatggagacaaaagaaatgaatttgtgaagaaatgtaatccacatgaaagacccaaatgaaaagtaattctttcaatcttttgatgtttttctgctgtcaccacatagggctacagtggggtttcttccctgggtcaggctttgtggaacagtaatgtgcaggaagtcttaggttctcagtgatgtgcaagctaggttacgtgcttagttcaaatatgttcttctccagtgtctgtcatcctgtggttaagattttagattcattcattgattttaagccacatattctaaccatggcttcagttgttattagtttattagttgtatgtgggggcggggaggttttttttttgttttttttttttttgttttctggcttagttgtgtgttcttgatccagttacttaaattctctgcacctcagtttcatcgcccataaatcaggaataataatagttcttacctcatataattgtcaagaggattaaatgcattattgtatttaaagcattagaacaatgctgaaatgcacactaagtactctgtgctatttttattgttttgttgccattaaggaaataataaccattactactattatttttattattatccttagtcttctctcaaatacccaaactttgacttagtgactctcttgaattattcaatatttctttagtatgtttccctgacttgtctccctttagtatatgtgacccacctcctttcatgctacctaattatgtatatctccattgatactcatgtctgatattctctcccacatagtccaaacatctgaagctagtatcatcatttatatttacattttcagaaaacccatattcacattctatcatgcccaccccagccaatctagggttatctctcaacacttctagggaaaattagggttttggcataaatctgtcagaccctcattaggcactatttttatattaatgtataccagtgcttcactatattttaaattccatgttcaaaaataccagttttggggaaaaacattccaaatggtactctcagcagaaatctcaatctgccaaatgacaaggactcaaatgcagtgagtcaaacagctgttcaacctgctttgtgcctagaggcatccaattcctggccagtttggcctgaggatatgggagtagggagtgcagaaagagttttgagttgaatttttattattttttatcctagattcagtttacataagactaataattctcaaacaatttaagactattctatacctttaaaaatgattcaattcagaaatttattaagcaatataaaatacacttcggcaggtatgtaacatgcgtgtcacaagcatataccctacccattctctcccttcattaataatggttctccattccttaaaccaagtcagcctgccaatatgaaacaaaagacatgtttattagttaattagttagtttctttaattggctatattgttttcactcctaaacaacacttactaaaaactgcttattgatggtaactattaggagcaactgactgaactgtctctgtgacatgtttccttacgtctatttgtcactcatggggaagtgaatgaaataaggaacagaaagtaattcaaaatatttgccatagaatgataagactgaagaataagaattaaattcagacctctcctaggctatctattcattttatatagcttactttgtggaatatgttacttttttgaatagacaggtgatatcctccaagactctcagctcaatgataatataactgaaataataattgaggtctctgattctcaggtaaatatttcatccataatctggtaaggattaaaagttgacttttaaaagttgacaatcgctaaacttaaaaatggttcagaggagatacaatattgctggatctaatgtaagtagaaagaatcctaattctgatatatcatggcatagaaaaagacacaaggaattagaagacctggattctggtactggttccagttatttgtgggaccttggtcaaatgatttaatctctctgggattaaatttctttaatagatgaattagttcaatgcccagattgttctaaggcagcatggtattttctaaaataatatagctttggctatcatacaacatttgaggatattctaaaagttttggatacttttctctaacattatccagacaaagtagctgtggaataaatctcactcgtcagctttagttttaaaattatgtactttcacataatccctggaatacaattattaattgtttatgttcaaaactttacagagaagtgacagtcaaataagagaaacaaacatataaaccagtaaataaaacatgattgcataagtactgtaacagtagtgtatacagagagcaataaatctccccctgcttgagtggaaggaggcacattgagaagataacttctcagaatatgggaaaaccagcaacaactcttatctcaaaagtctcaaagccaatatgcaaattcatctccaataatgcctatgtgttaaactcggtacatacagaatttacctccattgttgagggatattgttatcagatgtagaattctaggtttgcagttattttcttttggcacattttattgttttctgatttccattgcttatgtagagaatgcagctatccgattactatcttttggagtgacttttctctgatttatttaaatatttttttctttgttcttcagtagttttactatgatgcttcagatcttcactgcccactacaatagccactagccatatgtggtaattcaaatttaaatttcagttaatcaaaattaaattaaaattccatttccccattacactagccacatttcaagtactcagtagccacatgggactagcagccaccacactggattgggcagaaagcaacactgccattattgcacaaagttctgttgggcaatgctactttagattgtacctttttattttctacatatctgcaaagtgatgtctttcatcagttcagaaaactgttcagtcattacctctctaaatattgcttcttccgcattccctctgctctatgattctaattaaaaatgacttggaactttttactgtatacactatgtattttaaactctcttctttagttttcatccttttgtctttctgtatcttcattctaggtattttcttctggattacttctagttcattaattctcttctcagctatgtaaatattgctattaaagttattcataggattcttaatttcatatatttttcagtttctaaatttctctggttcattttctttttttctttctttcttttttttttttttttgagaccgagtctcgctctgtcacccaggctggagtgcagtggcgccatctcagctcactgtaacctccgcctcccgggttcccgggttcaagtggttctcctgcctcagcctcctgagtagctgggattacaggcgcgtgccaccatgtccacttgatttttgtgttttcagtacagacagggtttcaccatgttggtcaggatggtctcgatctcttgacctcatgatctgcccaccttggcctcccaaagtgctaggattacaggcatgagccactgtgcccagcctggttcattttcaaatagaagttgtttctcattttacattgaaattttatatttatagtaaaattttaatttaataatatgatttattctaaaattttcaatattctatttttaatctccttgagcataaagtaaaaattatctttaaaagtttttgtctgataattctaatatatggcctttttggatatattttattttctgtttcatctgctgattctttttatgctgtcttacattcttgtgtgcctgattatctttgtataacagaagttgtatttgaaagagaatgtgtagaaataatttgagagctagtatattgtcttcatcctgtgtgaactttctgatgctactgccaggcaatggaaatctggatcatcttaattcaattttagggattcaaatttctgggacattcagatgattcaaagcattgctataacccagtgacagctgctttaattccagtatacgctcattcccatgctgcttatctttggagtccaagccagcgtgtgtgggaattacgaaagtcccacccatgcagtcctggaatccaacttttgtcctcctaatacagcagggctgtcaaaagagctgctcagtctctcagccatgtgtctggacaggaaaatgctcacaggacaaaagctgtcacaacgtaccaatcacctgtctagacatctcttttgtccttgatgttgagaaggttatcttcactctcttgatagctctcacatggctttaaacatatgtttttgtatatttatccagtttgtctagttgttgtcattgagagtgttgactcttactgtataatctaccataaatagaagcgaagttgcacatgcatttaattttttttattttggaattatgttaagtttacacacatgtatgaagattatagagaatcctcacattccctcatccagctatccctaggaataatatcttaaataatgacaatgcacatgttaaaactaagaagttagcattgatacattattgttatctaaaccacagaccttattcaggtttcattcattttaccaatttcattttttctcttctgggatccaattcaggtactattttgcatttagtcactgatctgtgacagttttaagagatattttaagaaatattttaagagatatttagagatattttatagactattattcagtttgggtttgcctgatgttttttcatggttaaactgggcttctggattttgggaaccaatactacagaggaaacagtttctcattgcatcaatcattttttattaatatatgcatatttttttcttttttattggtttatggggcttgtgcttctattaataggtagatttttaaaatgtttttaatttttatggttacatagtaggtgtatatattttagatagatttttaacgtggacagcagtatctaaatatttactgtgatttgtaatgtatatttttcactaagcattgaatggtcattttcttccagaccttcaaaatattccttaaatatgtcagaaataagaaaaacaagtccctccctctctgccttcctcccttccttccttccttccttttttttctttcttctttacaaacaggttctcattgtgttgatcaggctagagtccagtggcatgattatagctcactgcaggctcaaactcctaggctcaagaaatcttcctacctaaaaaatcagcctccagctaattttttaaaatttttttgtagagacagggtcttgctatgttgcccaggccgttctcaaactcctggcctcaagtgatctttccaccttagtcttctaaagttacagtcttctgagattacagacatgaaccaccatgcctggcccagaggaatttttaaggcccacccatgtaacaaggcattatgaaataaacatgtctcaattgttacacactagttagacaacaatgttcatgttttaggcttagaacattaataggaaatagttttcttgtgactaatgccaaatccactgagtctaaagtttattacatttccacttgtctaaagaatttttgagacatgtgccaaaatctttagaacattagagctgaaagataccttaggtaaatttctcatcaatctattaaaggatattcaagcccccaatttcagcctctgtatccaaacttcaatactgccctatgttcatatcatcactggagaggtctggcctttccttatggcctctttaatcttaattgcatcatctctgatgttttatttggctttgtttgttactccagttactcccacctgtttcccttcatggtttggtttggccccttctctgccctccactccacattgatttcaagagatcaacaaatgttagagaactgggttcaactactaccaagaaagagcttaaccctgaaacctagcatcctaggcctgcacccaaagggagaagagaagcttattctgagctatgagataatcgtaaggtatcaagtctcagggcctggcaaaggagggataatggaggatataggcaagataataatatgactgggtatgtcgttatccaggctgcaaatagaaggaggctttgagcaaaagccttaaaacagttttattttagaagggcaattttctatcatcaatgccaagagaaggctcagcagggaccctactttgtcctgctttgagcaaatgatactgagctccctaataggagttgcagggtatgaagcaacagactgcaggggcctccattactttgaggccaaccacagggtagagctcttgtgggaacagctacataacatgcatgtccagcagtgccccagggaaccaagccatcgagagctactatcacagcccaagtgctgcctctgcagaaagcagtagcccagatgctattgagaactgcttacaagaactgccacttggaagcaccctgagaacttggctttacttggaaatcacctaggagcatttgaaaaatagctactcctgagaccagaacttttaattcattatatttgtcagaggctcattaagccctatgtatattttaaacaagtactcttggtgattcttatgtctgtattcctggcttaatgttcagctatttccagccttttaaaccctgtaggagaacagggcaccagttatttagggaaagaatattggtcattctaactacttccaactgaagaaagagactaactttttctgtcaacaaatgtgataggttttggtggactgagtctcttggcaggtttgagttgagcaaataaacttcgaactaaaactaggttattgatggtcaaaggggtatctgagagaagaatcacagtaataatattgaggaggacgaactttctagatggcactgctttagagatcctagaattaaaattataatatttttctgttgtatgagacttttccctttctttgactcacattattgcttttaatttatttggattgtcactagactgctagctaaatattcgtggttaccatagtgattttgcttccatttcctcatacagaggcctttaagttatttacatatgatttcctttccttcttaccaccaccttctcactctcctggactgcagctcaatggaacttagattcactttgattctgctttgaaacatggcaggcttgtataaaaatccctggagaaaccatcattaaatcttgaagacacttttttttttttttgtaaactgtatgtagagctttgatattattttgatttcctatgtgacagaattttatatatacagacagaatatttttcttcctcttttcatcatctgacattatggtggtccttagaattgcaaatacaggagaaggaagacacaaacccaagactgtattaaaaaatgtttcagaaattctcctttgatataacattgttaaggttataacatgattttgcatgtgagtttgtatggaaatgagggaatggaaatgaagacctagcctttctcaattacccttgcaattgttcctttagggagaaacagcggagtattactaatttgtattggttttcaatagaaatttaggtaaataattatttggggtttcaggcttcctttctctaaaaataattctttttagaccaatgtggggccaatcagtacctggagcaacaatattaaagtacctccttacagtgaggtttatatggagtcctctaaaaaatgaaatgtttcaactctggttggaatacacagagcagctgaaatattttgaaatgacacacacataaaatacataatttatttaaggtaatttattgttacattttaaaaatacatctttttaataaaataaagataaaattaagaggattatattcctcctttttctttgttgatcagttactagactcccttactcctccaaaaaaaaaaaaaaatatatatatatatacaatgcccagaaagtatccacaaatccctgttaaattaatgcagtattgttgaaaaacaaagatggccagagaaactgaatgagaatggaatcctgaggagaaaacaccaatatttaagagacctggttctctcagtgttgtggaacaggatccactgatatggaacagaagggtaagcttctgttaagctaggtaaggaagcttagggttgtgaaagaaggtacaaagacactgcacactgacttttggggaattacctggatttggctttcaggtagctctgccaaggattaacaatagggttcagaaagaagagtaaaccatctaatatgtgccccagccagtttacgtggttataataacgatcaaattagatttttatggcaaaactctctttaacctctacgatatgatagtatttccagcctttttattctcaaggttcagtagctaacattggcttaagcccactcctaactatgaaatgactgagctggctcagcctggaatgagagtggggagcatgagagggacacagccataccacatgaggccatggctagggaaggcagaggctactgaacaagactgaaggaataagcaaagcaaaaaaccacaagcttgctgaagttggaggaccagaaggaataggtgagggtctcagtgctaatgtagggttaatccagggccaagtagacaaaaataataataaaaccacaacaataataataataataaatgatggctagcatttgttgcacatttattttatggagggtgttaatctaagaaatttcccatgtataaattcatatatactaatacttgtcgcattttacagttgagaaacaggtattacagagaggtcaaataactttcccagggttccacagctagtaatttttggagctgtgatttgaattcagtgtattctcagagcaccagaaaggtacaaagctaaaagtttccttctgtgtctggggtttcctggaaaatctgctctgccctataagctcaggagtcccccctcctagcagttcctgctgaagctctatgtgagattgcacagacctgagtttgagctgctgcttattttttattttggggttttagtattttcatgttttaggttaaaaaaattctttaccttttagctttgatgaattacttcatttttatatctaataggtttttttaaccttcactttaattgatttcttaacctctttatcttgctcattttttaatctttttaatgattttaaaatgctgattttaataattttatcttggcatatttatatttatcagtttttctgcttcaagctttattctggcaaatgatgtatatttatatttcttttgtgttgttttttaaatattttttatttttgtttctggaatttaatgtatgtcagttgtgcaatagacttgttagaattttgtttgctttaataatttttaaagtgactttttgcattacttttgatcattttactcttagcttattttgagcttttgatgtctaaatataactttgtttgtctagtgttttagtgtctttagtcattgcttctacatggcaataggaaatatgaccataaaaacctcagtgaaagtaacccacatttagagaaggcttgtattccttaatcccgcccctctacacaccccacccattcaacccatctgtagcctccctttcagctgttcttaaaagaccttcccttttaagggaacttacattttcccttcaatactaaatcccaaaagctaatagcaatacagaagatccactgaccaacatttcttcccaagacaataatagtaacttatatgcataattgttaaagcaattttaagattttgttttgttttttgctatccaagttcctaagacatgttattcctctaaaagtttactatatgaaatgattgactaatggttgaacaaatactataaacacataaggaaggtgatatgggttttactcacagaagattcctcaaaacgcatacctgatttggttttaataaggatcacattacaggagatccaatagaagctacttaaaaagtgttttagaaaatgtttttaaatattaatttgcatccattataacattactatttgaatttaacttccttccaatatacctgtagaatgagctattgagtttaacttctttccaggcatggttatggagcctgctagtgtgtgggtgtcccggggccacaccgtattaaataggctagtgataaaatggataggacaagatttctcatcaggaacatttttaaacacagaatctgttgattctgtgttgggggcagaggctgggagaaatagggagatattagtcaatgcattacttttataagtgggcaacagaacccatgttgtgtggtcaaagtactgcagaacttctcaagcattgtacacgtttcagtttttgactacgactttaatggtccacaagaaaggcctctaagaatctttttcgtgtccatttctataagagagaacataatgctgtgttagacatagttgagatccattataataatgtcactacattttgaaataaaattctgaaatgccttaatacataaatccttttatgaagtctttaaaattggctgctaaaaccaataaaattatatttttggaacatagttaaccactttgtgcacataagtgaggctgtagaaactagggtttttaaatgacttaaaagatatatatttctccaaactataggtaattatatcaatattactttgacagagatatagtaattctccatcttatagtaaaatttatgaaaacattaagtaaaccaacaggtaaatacatttttggtcaaacaaaactttaaaaattatgtttttcttttatttggctcaagctaattctttctgttatttttattattaattgactactcaggtaaaattctatctgaattgaattgacatcattgatcccattgtcagaaaagacagccctctatcccattcaatttattaaactgctaatcttctggacttttcttcaaagcttgtcagttttgatccaaaaaaacttcagatttcattgtgtggacctgttacttcttgtgtgaaaaacagtatggtttcatggaatccactcttggccattgttaatattgtacagataggcacacaagcatttaaatatgctagcaccttattgcaaaaaaaaaaaagttctacttatattcattgcaatttattatagaaaatgttttctgaactgaaaattataaactgttgtcaataattcaggtcccaattctgaagtgtattgagattaccaaactgtgaagcaggaacaatatttattctctacataaagaaagaaaagaactattaaatgaacttgatattataagaagcacttcaggttgtcaaaactcatattatgacatctataatctggcctaaaatcacaagcaaacattccatgatggaatggcagatcatgctagatttgctggttattatcagttttattttacgttacctaagtagaatttaagcctttcagttaaaatatgactcccaagcaaaaggaagaggattaatggattaactattgtttgtgttatcaataatattggcaataactatttgtctatggtgctgtgtcagttacaaggcactctgccatgcattcttccatctgatcctcaccaaagccttggagatgcttcaagccaaaattgttattattctcattttacagatggaggtgaaggaactgatttgaggtcacactgtggtaaatgttcaacactaatctctggtccaggtccagtccagatcttctgatggcaaaccttataatcattccacttcataaatggaacacttaggtccaatcagtcattttctaaatgtgtatttactgttggtcacaagagtttgtgtgacactgtgtggataattaaatgccatccaccatctctactcggaaaaacccaagggtgtgtcagttaatcagtcttaacaggaaagataatgtactattatcattatggcaaaagtacacttgaaaatacaacaaaggatattgaagctattaaaataagcttcttatccttagggaaactatttcaacactagagctatcatcaaaagtccttgagacaagtaacccaggagtggaatggttatgattacactttataagcaaacttaaaaagatatcaggagctgctttactaggcccctgctatgaagtgaaaactggagaaaaatctacagcaaagcattctagcctgaggatgtgtactattttgcaacacagcagactgactacagccaaatattttcattggaaaaatgtaaatgaaaaatgttgctcaattctgctacctgggtagtacataagacatgtaatttaaattctaatcagggataacaaaaatcctatgatacttattttgcaaaggaaaatggcagtcctggcaaggttataagttagaaaattatattttctttgtgtaaatttgttctttagcttcattcagtaatcagaattatttatttccttattcaaattgtaagtgccttctaaacccgagcctactactattatgttgagccatgggaaattgccaatatttgactattttagtccattaaaatgcagtttcatatggtttaaactaatatgtgccaaagcatgaatagaaatacttgcaggaatactgtcctaagtataacctcagatgcacacagtattttagcaaaagtatcaatgggaaatcaggcaagtcctttcactgaaacaatttataagtataataatttattttgtgaaggccttttctttaccaaattagtaatatggtgaatattaaactaaacctgagtcatactacatttgtttttaaattttgtagggaaggggggaatagcaaataatattttatgctagtaatcaggcattatatcagttgttgtaaggaactacatgaaagttggtggtatacaggttaccagtagtaagtttgggaactgtgttgttttggctcacagaatataaagcgtgtatgtatatacctgtgtttccacatagacacactctgttacccttatatgtattgtataatcacatgtgtagatgttcattgtatctggagtgacagttgacaccttttaggggcattttacatgttttaaaacctgacatccacttacagcacttatctactactctcttcaggataaactacctttattgcaagacttttgctaaaaattcttagattatgtcaagggaaaaaaatcctctattgctttttaaagaaaaaattatcagaatgatttaattttgtgttattttttatctccacattagtttgttatttcagtggttatttcagttaaagacatttttctcttccattatttcaatttgttacattgtatccatttatctcatagaaagataaacttttgtgttgaattagctgtggaagaccagctcacacattaatcactactaagcaaatgcgttacaaaaaagagaggacaacaaaaatgagctggaatacagtttcagttcaaccaccaaacgatttgatatcatgaataaatttcttgggtatatgtagccagtaagtagacctcaacatttagctatttttttcaataaataaatattgagcactgtctttatggcaaacactgtcttaggtgcaggggataatggacattatgcttttgggggattagataagagaggaaataagtcagagaaaagatctctagcacagaaaagtctggttacaagattacagagagagagagaaaaaaaaaactgtagtgacttgtctagggaactgtgtggttgccacatagaaaatgtggaagggagtgatgggagacaggctatgttcctagcaattgccttgactcaccataattatttcacctactgaataactgaataaattgagtagagaggctgcttgtaccaaactgtaaaacagtttcaggatgagaaaattacattttaaacatacacttagggaaaacaaaaacaaaaacaaaacacctgccttgcagaaacatgtcatagaaacagattttaggcagaattatttccctgtacaacaattgtgattaagtaaatgttaaaataaaaagaaggatgtttagcagcataaggaatagaaacatttggagttttagctttagcttatacaatgcatcctgttttataattgttttccaacaatgtttacataatgggagggtcactctttaacatgaggggctctgtcactagaattgcagtgtgttagcccctcattttctccagtgtttttgtaaatctttccattgacaatcttttaataatttccaaaacaatcgggggtaatgttcgaattctaagttcttgtcataaatgaatcaatccagttggcaggagatggatgtagtctttttgctggtgttccgtgctaagaaaagcacacacatttttcttgagagtatggctagccgaaaagcatctgagaattgatggaatcctaaggcagacagaaacgccaaaagtcaagtaactggttttgtctccagcacttacagtttgttgtctgggtgccatgacataccctctactagttaattccattaagcaacatgggccatttaaatataggcaaaacaacaacaaaacaaagcaaacaagtaaaaactctgtgaccacagaaagagcctgtaacatagacagaagactacaaatagtgttcttagaagataaatcattaagacagtagcaaaatgagaaggaatagtgtcctgggcaacataaagtgtgtgtacccttctacctgcacaaacactcaactgaaatttgccaaggctcactagtgtctttgaggcaccctagagaggggaggctagaaataaccatcatcctcagctgttccatggtaaggccctacactaggactcagaggagagatagtttggaacattttatccctatcagtggaaaatagcacagttggtgcctaacttcctttcgttgaaaataacacaggtaattttttagccaaatgagatttttatcaaaaaagcaagcaaaggcagaatgtgaaaaggagctgatatcagtaattccaaggatactaaaatttgttttaaataataaagaaatagcatcttcaggccctttagactttggactccaaaattggatgcagatcaaataggatatttatatattaaaaaatcccaagagaacttgtacagcataaggtaaatacaaatcaaggttgaacaggtataaaataattaggtcaagagcaatcagcaaaatatatgcagaaccaaacaatactttgatattctggtctggaaagagaatttggggttattctgaaaaatactgtcactacaactctgtccagaacccacagctgcagaaatgagtaaacaagtcatcttattagaagactgcaaggttaaagaacagctaaagattcaaaactaaatgacattcttgttagttcccattgatacgattataactcacacaattccctaaaggaaaactacaaaaaggatgtttcttgagataggaatacaaataaacttttgcttgtttgtttgttttgttttaaatccagtgataagaatgaatgttttctgtatttgctttttttaaaaaaactctatattttatgtgcagacatttaacataaaatcttttcccaatgtctttcttagatgattaggtagttgaaagacgctactgtttacgaggcattgctaaaagcttttgggttccatgagggagagggccatgacctactcctttgtacatttccccactcctccgtttacatcacataaacatatatgtatggtcttccatgcagtcagccaaatcagacaaatcatgcctaggagttgaaagtgggaactgatttgtctagtttgaatattctgattagtgaactagctagcttagaattttgtggtatttgcatatgtcattcatttatgtactacagctacacctaaatcccagaaaaatcggtaacaaaataacctattattctagatttaaattttaaaatccacataagaatattaataacacaaattatttgtatgacaatgacttctatttttttcatttcaccctcagagatctatatacttcctctatccaaaaacaacacagaagcaaaatgttacagagacaccagaatgttgcccagaaaaccatgcattaattactcaagccaggaaattcccaattttgcaactctattttatcatttaagagagatctttccacatgtgtgttctaaaaaagaacagagaaataaccagtcctctgtaacttagcaaaaatacaaattggtgtttccactttgatttctctttttgaaataaattttcagcttgactttcttttgcctcgggtattctggattatcattttgtagcatctggataattttacattaacatctggagttgagggtctttttatttgtcggatgcatatagaatacttctgtaagaaatgtattttcccagctgctgtttattcattttaaagagacatggttaagtaagtctaacagcctccttaggaaattcaattcctaaattccttaggaaacacaaaccatgtttaatctgaagtcctgccagtctgttttctctcctaccagcttttcccatggcagaaatggttgagatctgtacagaaggaggactttagtctggtaacaggtggtgttgctgagtgcaagggcctttgaaatcaggcctggtttggaatcttggtccagcaatcaatagctgtgtaatcttaggtaactctttgaagtttagtttccgcatctaagaatgaggaagtataaatacatatctgcccacgttggttgtattaaatgagataatttacataacacatccgactaaggtgcagatgtaataaatgacagctgttattatcatttatttcagcacgttgcagaaagcaacttacaatttcttcttttcctgacctcctagggcttttatgcatgcaattagcaatttgggatttgcacaaggtttttccagagtacaagatttttgagagctgtgactgaatcttattctttagaaacttgctctttgagtggaggaaaaggaagaaactaagttgactaatgacattataaaagcaggtagagaatcatttctttctgagcttctgtagcacaggctatgaagtgtgctagtaaagtaaatacaattttaagcaaagtttcagaaatcaccataataaaataaagtctgtaagtcccagctattaaactggcagggacctacattcattaaattaaatgcaatgtgcaatgttgttcgaaagttgttcaaaatgtttttagaatttttcttggagttgattgcttttataatgatgacttcacgtcttgactctcagtgattttgtttgtctccttagccccaaaattattcaccttaaaagatgaaatttggtaatattaagacagtcaaaggaatgtcctgaagttctgatcacagctatgaatagttctaaaatcttctaaatatttttgggatatgtatagaaccaagatgatttgtgtgaagggtttttccattcacttagttgtattatattttaatataattgtttaaaaaagattcatgttatagtcacagattaaaaggcagtttttaaaggagatgaattaacagtttcagagaaacaattttaataacatgcattttatacatttatttattctgaaaacagtaattttcaatatactattttcttataaccactttaaagaaattaaggacttgcaggttgtctggttttttactatttttcttatccatagcaaggttggtgctcaataatactagatgagcaactgaatgaagagatgacaaaaataaatgaatttattaccactgcatgttaaagaagtgtacttttttatgcttgtctttgagaaaagtgtcaaggtggcatacatgacaaaacacaactttaaaatgacaacaaaaaattaaaatttcactgaacaaaataaaataaaagaaaaatgcatactagctgctcatctgggatgagttagttattgcaattcaacttgtaatttaatgcagaattttcagacaattagggccaaaaaagaaaatgttaaattagctagtgtctgacaaagaagaaagctttcaaactttcaagacgaacattttattagcaatgaattctcagagcaaatttaatgcagtccttatgtaaggatgtcagatagaaaaaagtaaaaggatttcaagcatcactagtgcaaaggacaatattacttgcttatttctgcagtgtaacaaagatgaagatattctcttaaattttttactcaatgatgattcatgtgtctctgagaaactaagataatatgatttaattctgtgcttttgggatagtctaacttaattcatgaaggagtacaggggatgggcgctttgtgtgtccactttgtttgtcactctcaaatgtcagatgtgcaggcaaattctcagagttaaattacttgacaggaacttaagcatccgtatttgttgccaggtagtcttctgtgtggttaaagtacagaatgtactcctacaaaagcagagaggcggcccgttgccacacaaaagtgttttttcagatggcttatggttagaaccaatatatttttctagcatacagtttgagtgataatagctcacattccccgatcacatgccttgtgccaagtaccattctaaatgccttgcatcttgtaactcattaaacctttacagtaacctcatgcaatgtacactcttgttgttcccattttgcaaataagaaaactgatgggcaatattaccttgcccaagtttatacagctggtaagtggcagagtcaggatttgaacccaggctgatggtatagtctgcgtgctcagccacaatcatgaacttaccctcaaactgcctgtgtttgcataatcatgtggatactacaggatagattctttagactcatcttatgtaggaggaatagtgacatgaaccatcataagaggagcattaactaaactttgcttgtcttacccatgaaagaacatcagtgtgactccctgccaaatatctgataatgaaaagaaatgcattgtgatcagcaagataaaatgaagaaaataaaaatgtacactgaaatagctgaacgaatgaattaacaacctattttatagcattgtgctggagaagaatgctcatcttacagaggtgattgtgtctaataaaaactgcactggatttgaagtaaaaaataaaaaacaaaaactggatctaatttccaattctatcactcgtagtctctgtaacctcctagtctctttcactgggatcttagatgtgccttcttagaagctaaattttcttatctgtgagttggtttacgattccttcttcctctatccactcactttattgtgatatcaaaataagatagcatatgtgcatatccttggagattttaaagctatctgaaaatgtgccatatttaaacatactgaacatagttaaaagacatgcatctgattaatgtaaaaactataccaatttattgtagtccacttggaaagacaagtagcttacttaaagatctattttgttgcatttaaagttggaaatgaacctgatataaatctcttcccaactactgtgatcctgtctttaatacaactttaatagactggaacatatgccaagagtatacagtcagaatctctctaagaatcaaagactgatgagaaacctctgaaagctgtgaaaagtgtgttattgtttttaattgcttccctaaagaatgagagaaggcaaagctgggaccctagtggtattgatgggctgttgctccttatccatgatgtgtaagagtgaggaactaagtctgaaaactttttaaggggaaaatagcagtatagcatactgaaagttttgttgtaatatttaaaaatgccaattaaaaaatagtgcaaaattgtataacgcaattatatgagaattgttttgggatcagcggtccaaagacaaagaaagtcccctcttctctccatgttcttttcactgctagcagcaattaacatttggcatatatcctcctagatttcattttttatgcataagtgaagacatatcaataaaatgtgttcttgttatattacatagttcttgttttaacacaagtggaattatcctctacatggtgtttatgatttgtttttgcacttatgaggttgtgtttaaaatgttgtacatttttttaattttagcattggtaaatttactttgtttttattttaacatagtattccactgaaatgtaattatactgcaaattatttatcatatctccactgacggtccttcaggttatttctaacttttcttgattataagcaatgttgtaatgactatcttgtacaagtatgtttatactcttccattaatacttatgtaaataaatctgataagggaaattgtaggctaaagcatatattatacattttattttattttttattaattaattaattaattatttatttatttttgagacggagtctcgatctgtcgcccaggctggactgcagtggctcgatcttggctcactgcaagctccgcctcccgggttcacgccattctcctgcctcagcctcctgagtagctggaactacaggcgcccgccaccacgcctggctaatttttttgtatttttagtacagacggggtttcaccgtgttagccaggatggtctcgatcttctgacctcgtgatctgcccacctcggcctcttaaagtgctgagattacaggcgtgagccactgctcccggcccacattttatttttgatatgcactggcacaaaattgtgtgaagaaccaattaataaatatgtctaaggaatatagtttccattgttttaattatcaaaaaattatcacttacatgggctctagttatacccatgatatgaccaatttaagaaacttgaaaatataatttctagcacgtgtatactaatgcgagatagagaagttttatttacaaccagaaattgttgggtccataaaagaaacaaatatgtctagaacattttaaagttgccagagcagatttcaagatattccagcctgagtccctcagatatgtattttggtgattgtaaaaatatcaaaagaaattatttgtgtccgaaagtcacaatatgcgtgagtcatcaacacaataagataaggctaaaattgagtttcagatattttgggatttctgaaaaaaatttataaaaatccataatgtaatcatttgtaaaattttaaagtttatcattacgaaaaggaaagtcaaaatcaaatgaaataaaacaagctttgttccatgggatagtgtcagtcataaagacttactagttaggtgctaattcattttgagcttacagggttttatcaggatcagactaagtaaaaatgtataattattttataaataaaaatgttttggggtttcagatttaaaaatcaagagtaagaagttttacaatatttactaaagattacgattagtataccacaaaacatctgaactttagatattatttatatgaccttaaaagtcagacctttccctgccaatgacttaacttctgtctttagtgctattttgtttgaaggcttatttatctgctatgaagtgatttttctacgactttctacatgtctcttcacattgggttaggaaatcttcaaggaaattaatatcctcgggtatacacaaccttttgctgtggtatttgctctgacatggaacaaaggcaaaagatacgggaaaatgtagaagtgggcattatagaagaatccaaatgtgtctaatgtcttcttcatactaattccttctagcctttatttaaaaaatagcttctgaattgcaaggatatttttaagccacatgaatcagtatgccccttcagctggacttttcaaggagcctgtgaatgctgaaatgattaacattatgtgaagctaaattgcactgaaccgtggaaccatgtggtgtggcaatagtgggtggggagacatattagtctagaggtccctgctgagcaaaagacaaagacctccttctccattgtcccgcactgatggtgggcttgggatgtattttcagaaataattatttgcagggaacttataaaaacaaatgaatcaccctcatcactgtgcttgttccgttttgggatgtttgtctactagactttctaaattgggagatttagaaattcagtaagaaagatatttaaaaaaattttttgaggtcctcagtgtcttctgcaagtacactttcaatttttattacagacagactctcttgatgctgttgtttaccattgcatttttatttaacttgaatattttaatttagcatgagtcattcccatggattagcaactttgtatgctagcatatctagttgtatcttctgtgtgttttcaatggtgtgtctgctactccaaagatcttcctgaattttacatattagaagtggcatagcctcatgacactttatatcaagcaggaagttctggaagatgatgctaacaaatacctcaaatctggaaattgtaggctttagaaaaataaagtcatcttgttagtgaatctctatattagactttctaataccttataaacaggttttcagaaattaattatatttatagcctcgagaaactagggaaaaagctggatctcaaagacattattacaaagcagtagtaaattataaacaatatattttgaattcataattaaaattaacgagtcaattttctgaggcattgacctattaaagatttatgagttacctaaaatcccaaatcttccctgaggtaatagcttcagttgagataaagggaaggtatcttatttgtcgcttcactgcaggaaaaaataaaatttgtgattatgactcattatcatgatgcctattgcaaaattacagctcactcttaaaattatgtgaaaaaagatcattaaatgttttagacatttcttaaaacttataagcaaaactttcaagttttttaaactgatttactggttgtatatgtagctaattgactatgaaaacttgaagcttaactctttgtagaccttccatcataccattgctttataaattattaccagaatattgaaggaaataaacttttttctaaccatatttatgcaatcaatatttattaggtagtttttgagaaaatcttatatgagaacttattccttgtataccaaatgtttcatggaacaccaccagcatagacatttttgtttactctgtgcaactggatttcgttctggggagcttcaatttgtacatgagctcattttcacaaaccatcttaccgatacttagagtccaaagtgaaattcaggaactatggcccagcaagctttcatgtgctattctttgcttcatgactttggaaatctatgggagaccctgtatcactagacagaatactgaaaagcaggattacatatgaagtttaccatctgatttttttcctaagggtttttacatgaacgtttattccttgtctttttgtgtggattcagcaatctccaggtttactgaacaggggttgtgaagggcagttgttcacaactgagctcattcccactgtgttgatatactccggttcccccacatagctccaccccgctaactcccaacctcatgcatagctccaccacactattgggcttgaatctaggctctgccactttctagctggttcctgagcaagttctttaacctctctgagcctgtttcctcatccacaaaaaggatgaagaacaaaaaggacgaggcaataccttcttaacactgataattaaataagataagcttaaattataaaatcagcacagagggaatgtaaattggttcaaccattatggaaggaaaaaagtaggaaggttcctcaaaaaattcaaaatgggactgcgaggccgggtgtggtggctcaagcctgtaatctcagcactttgggaggctgaggcaggcagagcattttgaggtcaggagttcgagagcagcctggccaacatggtgaaaccctgtctctactaaaaaacatccaaaaattagccaggcatagtggtgcacgtctgtaatcccagctacttgggaggctgaggcagaagaattgtgtgaaccgggcaggcagaggttgcagtgaactgagatggtgccactgcacttcagcctgagcgatagagtaagactctgtctcaaaaaaaaaaaaaaaggaactaccatatgatccagccttctcacacatatatatatgtgtgtgagatatatatatatatatattcaaagcaattgaaatcaggatctcaaagagatatctgcatttccgtattcattttagcattattcacaatagtcaagatatggaagcaacctaaatatctgttgacagatgaataaataaggaaaatgtggtatatacatacaataggatattacttagccttagaaaaagaaggaaatcctgccatttcaggcaatgtggacaacatgaaggacattatgttaagtgaagtaagccaggagtggaaggacaaatattacatgatatcatttatataaggaaactaaaatagtcaaaactcagaaacatgagagtagaatggtagttaccagggtctgggttggagggggaaacaggaaagtattagtgaaaggataaaaagttttatttatacaagatgaattaagtcctcgagatctactgtaccgcatagtgcctagacttaacattactgtatcgtatgcttgaaattttcctaacaaagtcaatcttacaaatgttcttatcacaaaataataataataaagagagtgagagaaaacttttggaggttattgatatatatgtggcagagacggtggtgatggtttcgctggtgcatacttatctccaaactcattaggttgtatacatcaaatacgtaaggctttttgtatgtcaatcaacctcaacatgttttttttaaagcagtatagaaatacctattttttaaaattattacaactgaaagccttctaacttgtggtgttttcttgaaataataatcgtatcttggttaatagttgagatctaaaagcttaggcctaaattcagatagaaagcttggcacatctgttgtaagttttgaaaccaggtgcacagaccatctttgttccagacgatcttctcagggatgtttgtaaagtgaacagccttggaaggtagagatgatgtccccctgggaagcaaagggtaggtttactcatagcttgggaagagagagatggtgtctccctccagatgaggggaatatatttaccacccataagaaaagatttgaacccattaagctgagggttcctcttctgtaacaccacccactgtgagtggaggcatcagctggcctgctttctatctctctgcaggaagtagagcccaggcaactggcaccaaatatgccaaagcttatgctgcttcctgggctgtgagtaataaagtcccttttccctcttttagaagtctcatatgttctgtcagcagccaccaagctgtgtcaggctaaattgctgtcttgcaagtagaataaaatcccagaccctttgcaatctttttcataaaaaaaattttaaataccatatatttaccgcatacagttcagaattatttattaatagtatattcacagagttgtgcaaccaccaccacaatccaattttagatcatttcaacaactcaaaaagaaaccttgtacacgttaagtgtcattcctgtacccactccctgaaaatctgcttgctctagctgtgttggattgatgtcagaacacaggagggaagggcaaatgcaagggagcaggtaagaggctttcacagcaactcgggacaaatgatagtggcttggagcagggtagcagcatgaaagtagtgagaagtggcggaatagaagatacattttcaaagtggaaccaatagtatttcctgaccaattggctctgccaagaggatgtgctgatcaattttccgtgaggtgtgagaatgagatggctgagggatgagtccatggttttggcatgagcaaagggaaggattgagttgctttgaaatgagttggggaagactgtgggcatagcaggttttgacagagaagaataggagttcagcattgcatatgttaactgaaaatgtctattagacattttggtgaagctgaatagatagtgtatagtattctggaattcagatgagaaatgctgcttaaagatacgaattagagaatttaaaatcatgagactgcataatatcacccaggaagtacaagaagacctagaaaagtaacagtctgagaactgagctctaaggaacatctacctttagaggtcagagagatgaagtagagcttgtaaaaccaaggagcaagcacacacagttttggacacagagatttcccataagagcattgcaaacgttacatattctctttgttggatgtgaaaataatcttttgggaaatgtgtgcttagaccttgatgtgatgcatagggacaaatttctaattctatttgcttcctaagaaaatgaaatgttactaaataaacagcgtcagggcaaggagtccaggtccataaagaaaaacttgcacagcatggtgaataaaattaataatggtgtattgcagattttaaaattgctaaaagagtaaatttcaaatgctctcatcataaaaaatattagtatttgagggaatgggtatgttactagcttaattgaattattccacattgcattcatatattataacatcactttgtaccccataaatttacataattagaaattgtcaatttacaataaaaaataaaaagccatcaaaaaacgccaggcaaaaatatgtgatatacttatacccatatttaaacctacaccataaattatatttaaatttataattctgcctgctgctgttttcagtaattaatatcattaagaaagcacaggttaaatcaaatttcaacacagtatcatttcagtataaaatctcatattttgaataaaacaaacatatctttacacattattaaatgaactacgctgacaaattttgtttctttttttgagaaccagaaaaacaattatacttagatgggccatctaaaatgtccttccagcttgtggagtaggttgtgtttgtttttcaatgaacatctgtttgacaaattgaaatgctaattatgatttatcatttccatgacatcaaatatccagatagtaataaacgttgatgactaactatatttttcagtttcagccagatgtttggcatcacgtaagataccaccttagttttacataaaaataaaatgtttcttgagtctggcttatcataatggggaggaaactaatatgaatgaagcagaatggttcattttttttctcaatgtgtacaattctactggtaagacttttacaatatcataaataaaattgtactttaaaataagtgtctttcaaacttttacaaatacaaagaaagccagaatcaaaacccaattttgaatatcaagtgttaaatatgaatatcagaaactgaatatatcatcaatacaaattttaaaaaaaataagtttgtaaattcagagtttatccctcagatgttatttcaagcatatatcatagtgacatatccttgaatatatatttaagatccgatagggactgggcacagttgctcacaccagcattttgggaggctgaggcagatggattgcttgagctcaggagtttgagaccagaatgggcaacatggtgaaacgccaccagaaaaaatgcaaaattagcaaagtgcggtggtgtgcacctgtagtcccagcgacttcggaggttgagctgggaggattgcttgagcctggtaggcagaggttgcagtaagctgagactgtgctactgcacttcagcctggatgacacaggcagaccctgtctcaaaagaaaaaaagaaaaatctgatatgataatttagaatatgggtcctcagggccataaaacagcatatgctagtttgttggcttttactcaccatgctgtgcactaaaagtaaaaaaatataaagtaaagcccattcttttaactgagattttgtgccctttgacataatctctccattcccacagccctcagcctctgtaacttctatttcactcactccttctaagaatttgattgttttacatttcacatgcaagggagaacatgtaatctttccaaatgacagaattttcttttttaaagctaaatagtatttcatcgtgtatgtgtacgacgttttctttatccattcatctgttgatggacaggttgatttcaaaatgtggctaatgtgaagtgctgcagtgaacatgggagtgcagatatcttttcggcaaaactgatttcacatcttttgggtaaatacctggaagtgagattgctagatcgcatcgtgattctacttttagttgttttggaaaactccatgtagttttccataatggctgtactaatttacattcccaccaacagtgtacaaggattctgttttttccatattctcgccaacatttgttatcttctttttgatattacctattctgacaggtgtgagatgatatctcattgtaattttaatttgcatttccctaatgattagtgattttttcatttatctcttggccatttgttagtcttcttttgagcaatgtctattcagcttccttgctcatttttaatttttttttcttcctcttaagttgatggaactctttatatatttgtggatattaactttttattgaatatatggcttacaaatattttctccacattcatagtttgtctcttcacattgttgcttcctttgttgtgcagaagctttttagtttgatatgacccaatttgtttgtttttacttttgtggcctatactttgggggtcaaattcaaaacattattacccagatcaatgtcatatactttctcccctgtgttttcttctagcaatttggagttgctggccttatacttaaggctttaattcatttcgaattgagttttgtatatgatgtgaaataaggggccaattttattcttctgcatgtggatacctagtttccccaacaccattcattgaacagactatccttttctcattgtgtattcttagcatctttgtcaaaaataaattggttgtacatgcataagttgatttctgggctattatgctgcattgacctatatttcttttttgccagtaccatgctattttaattaatactacaatagctttgtagtattgtttgaagtcaagtagtgtgatatctttatttttgttttgtttgctcatgatgattttgactgttcttggtttgttgtggttccgtgcgattttaaaattgttttttctatatctgaaaaatgacatcaaaatcttgatagtggttgcactgaaatctgtagattgctttgggtattatgaacattttaacaatattaaattcttccaatccatgaacacaggatatctttccatttattcatgccttcttcaatttctttcatcaacattttacagtttgcagtgtatgcagatcttttcaactccttggttaaatttattcctaagcatttaatcttttttatagctattgtaaatgggattttttaactccaagtatatttcatagatggcattgatacagtaaaatcctttattctgtaaatggcatttatatagtaaaatcttttccatggtgaatgattattagtcttaagtgaaatacaaagatttgattttataagtgaaatatttcttaagtaaactatccttggctgccagtttctttcttaaaagtttaatatttcccagcaacttcctgtggttgactcttaaggatactgaagctgaaaggagcccagcaattctgggtgatggaggaaatacgtggccaggctctgctgtccgtatcttcctcaattttcaacttgaattttatacttctactctgacctttaatttttgtgatctaatttccttttccccaataatatttgtttttgaactagtcttcctcatgccatttaaagaaaaatttcaggaataaggaaaaacacaggagtattaaaatggagaaacatcaatattgttataaacagagcaccccaaaataattattttgaaagagatgcactcatttgaatttataaactctggaatgcttattttaaaattaactaatgtgttaacctacatacaaatttgtatttttacttgaaggaaaagcagcattgctggtagtgcacatgtgcttctgtacatacagattgtacacattgaggatgatgtttatgccataagagaatcatttcctctctttttatcagggccattacatcatttctcaaatagaccactgttaggaagtagggatatataagtataagggaggagactcaagtaaaaccagagtggtgcatatcctacaaattgagaataaggcatattttatcttttaaaataacatattttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccaggcgtagtggcgggcgcctgtagtcccagctacttgggaggctgaggcaggagaatggcgtgaacccgggaggcggagcttgcagtgagccgagatcccgccactgcactccagcctgggcgacagagcgagattccgtctcaaaaaaaaaaaaaaaaaaaataacatattttagagactcagtaaaataattttaaaggggcagaagtacagatgtagctgttaggaggaagcattatttcagctacagcacattattggaggataggaagagcatatggtattccagtgaaagagcttaattataatagagcagaaaggattagaaacagaaaagaaggtggattatcaggaataaagtcaaagaagggactgaatattgatcagattttcagaaaaacctgcaaacaaaccccaccacatactagcactagtcataggactgagatttgtcaaagctagctctcttctggtgcactctggttcactgtgaatataagtgggccatagagtgtgaccattgtggtctctggccctaggccatggagtgagataattgagacaagagaagtctgtatatcatctctccacataagcaatagagctgattgggctgcctgtaaacaagattttagagactcacttttctttttcttaaaagactgccacacttagccatctgatatggaatggcatctcctcttaatgagcctgtgtctttatttgcaccttatcaaactgggagatactgaagatggcagtgatgctgatagtggtgagacatggaagatgtagaggaaacctacaaagaagcctgagataggagagaaagggtaatttttagaagtagattgggagaactgcattctgggcaataaatattcactggacttacagcgtattcctttttttaaggaaccaagttcacagttgttagaactacaagagcacaacattacataatcatgacatcaaataagcataaaaataatgcttatttttaatttttacaggtgccattttataaactatctctataaagagattaatgttagcttcttgttttggaaataagataatgggagggaaggataaatgaaacagttttgttgccatctctcattgtgagccagtttagaaatgaaaacaaacaaacaaaacaactcttaagcccaacagcaacattcattataattttcctaattacactcccttttctttttgctaagaaagaacggttgtatttttgtccttaatagaaaagggaacagtgcctaaacaacctattataaattcttctgggaaagcatattacaaataattgaaaacaaccctgattctgtgaacttggcagcaaatgtataaaagaaagcaattcagccctggcccctggatgattgattaaatgttttattctttttacctttcattcatgctgtgtttgtcaagaggaaagagaaaaggaatgttgtgaaatgaagtccactttagacaaataacttacaataatgatcagtgacttctcatcagctgtttattcatttttcttgagttgtaatatttcttaatattagctatcctgcatggacccgacagaaaataaggtcctgagttttagcttgtccccaactccctgccagctaaccatcaacacaagctgtatctgagcttctttgagggcatggccctgcagctccctgtggtcagttattagtctgagtccagcaaaggaacaagaacactgtgtgcttgctaaatctacagaaaacttcatcttctggttgtgtgggaggagaggtccctttgtgtactctgtttctttgaaggaactagggatctgttggtgctgtacagatgtcgaggtgcacagagccaacatcctacaaaactagtaaatagatgattaggatccaactctgtacagaataatggtaggaacctaaaccttggggtactgtttacttgtatcaaaattgttgttgtcctataagccatgtaaaattaactacaaatctcctcaatgaaacactttcttagaactttgatatttttaaatgatatctcaccatctgtgtacatcacaatgttgagctacaaatgtggtggctctaacaaaattttaagtatgaagtcagatgtatagaggatcccttctccatcacgttcttctgtttttcatttcccgcttctcacaaactactccccagatgtcaataattctacaatctcctcttcctacaaccttcgtgttggtccttagtcgtctactctgatctcaaccgcaaaagtcaggggatgagactataggccatccccagagcaacagcctcagcacctcagcacagatctggaggggatttgagctagaaagaactctgaccttactcttttttttttttttttgagacagagtctcgctctgtcacccaggctggagtgcagtggcacaatctcggctcactgcaagctccacctcccgggttcatgccattctcccacctcagcctcctgagtagctaggactacaggcgcccgccaccacgcctggctaattttttgtatttttagtagagacggggtttcactgtgttagccaggatggtctcgatctcctgacctcgtgatcggcccgcctcggcctcccaaagtgctgggattacaggcgtgagccaccgcaccagcctctgaccttactcttaattgcttgcatgaaaattggatatggataagaatgcaaacccaagaacatgtcctgctttccttgatgcacattctcctattgatgttcagtgaccttagcatttccagaagcacctctttattgtggatggaaacttacttattcatgttgtctcaggctgtccaggttggtaacaggtaactgctataaagggtggagcacatcctgctaaatggagagatccagtgtcatttacattttttttaactctttcaagggtaatggcaactaacaatagtttctcctgtgtgctagatattgttctaatcattttacataaattatttcttttaatccaccaaacagcactataagatagatattatttttatttacctttgttagagaaaactgaggtatagagagattaagtaaattgtctaaattcacacagatagtaagtggaggagccagaatttgaacacaagcaatttgtctccaacaaatttgatcttaaactatggttaactctctgaacacacacacaaacacacatacgtacatgcaatcacacaaagtatcaggcacatggggatagacaatattagaaaagcatatacatacaaacatccttacagttgtacacatagactcaggtttataaacccactgaagtgaagactcatcatttatgaaaatatacaattttgttctgcaaaataatttaattttttaaaattccttgtgcaatgagaaaagatcagagaggcctacagtttccttttacagagctaggccaggggctgtatttagagtaattgaacacatgattttacttgaatgcggagaaacttgaccaactgtgaatatgcaatttcactctacagatgaaataaaattaaacggggcaaaagtaaagaagaatggagactaggtaaagtgatggaaagagacaccaaaaaattagtcatgtgaaagcaaaactaagaggagagggaaaggtggcaaaagaagggaacattcagagaatgttgatatattgagaggtgagaatagggagttggtaggcaagtgtcagagtgtgggaggatggtgacagtcactaggaactccagtttgcatacacacaatgttaagaacattagaaattagctagccaatggaatgctcagtcttgaagagcttgtgtctctgcttaaactcctgtatgcattagtatgattccataaatttaaagtctctgacatcttgagttttaagctttctgaacattaaatcagtggaggctgctagtagctatcctgaaatgctgcttctatacatatgagtaaaaatccaaattaatgtatttatacagcttttcatttgtgtactcgtaaaatacacacacacacagagacaattcaacacacacacacacacgcgcacacacaattcaacttttctctgaagaacctttgagtcagagaatgagaatgaaggagactgaatttctcttttaagttcctgtctaggttttgttccaatctaatgacacaggatctggcactgtatttagacctcctgctccaagattttatttttattttaaacaagtgttcccacacggggactgaaaacaaaacaggaaaatgttgcttaagttttcctttgagctgctgttatctgactttcaagtgtactgattgttccgtctcaccaatgtaggtcattgtactctcagttactttgttttctatcggaactttctctagcagctctccacattaagggagatcatgttatttcacatatttatttttgttattaacatattttcttcatctccctataatttgaggttttagcactttcttctttgtagaatttaccataaagcatacgtatttttgaaaactagggaatagcttttacttactaaagtacttaagtactaaacctatcataaccaatttcatttattaagatgttagtaagactttaggagttgttggttcttttccggagaataatgctttagcccagcagtccccaacctttttggtaccagggattggttttgtggaagacagtttttccatggaattgacaggggggatggggagtggggatgggtttccagatgaaactgttttacctcatatcatcaagcattagttagagtctcataaggagcctgcaagctaggtccctcacatgcacagtttacaatagggcttgtgctcctttgagaacctaatgccacagctgctgatctgacaggaggtggagctcagacacctccttctgtgcagcctggttcctaacaggccacagatagtactggtccatggcccagcagttggggacccctgctttagccctcaactcttaggcatgtttcagttctgattttggtcagcatagagctttccttctatttaccaggagggtctctactgatatggatcaatggcaggaggtgatattgggtctggaactatcctttggcttagtgacatttgtactctaatctgcctcactcctgccccttctcaggggacctgggcaccgtcggatcccatgacaggtcctacatggtgacctagggcacggtaaaaagtctaccccaggaagcctagaatggatagaatacaaattcatccaacacaaattcatgaagaaaagccaagatctgcagaaaatcaaacagtaaagactattccagaagagcaacaggaggacgataaagaggagatggagttaaaatactgggtctgtcatagacaggattggaatggaatcccaaatcagatgatagaatgaagggaaggtacatggaatagactctcactagtggtgagctttcggtcactacaagtcttcaaaaggggcctagatgaccagttctttttcatccaacaaatgcttattgaacccttcctctgtgggtagtgatgggcacattcagtgaattcagactggaatcgaacacattgtaaccattaaatgagttaatcttatatgagttcatacatacagatcacatgcaagagtgtctcatatccagtaagtttgcaagaataactactattgtttttgtgtacaagatcttgtgtattgtaatttctgaaatagcaatgaggttggaatacatgactaatgattttatcctcttatgatatctctggttggggcacacccaaaacaaaatttggagcaatgcaaatgttcgaggagagtgagagaacttccttctggtgtttttctctaatgacttgctctgaagctactcctcttagattctttcctagctgtgtattcctatatagtcttagcttaacagcacaaagatttaacagtggtgtctgcatttgataaaatgtaaatgagaagctcccaaaagagattgagaagctctattttgacaactcttcttttatctgtgtaattattatatactttaactgaagaaagaaaaacacaaagataaatacaatatttcaacttcgagtactttttaaaaattatttgaaagcatttaaaaatagatgtaaaatgaactcctgtatgtcaaattcctttcagagaaaaaaaaaagtgagagggaagggggaaatttgcatttagtaattttttttgtttttttgaaaatttcaggcacttagtaatcactgttccttttgtacgtcatgcccaatgggaacgataccaggatctttcactcaattctgtggattacaggtcacccacctgggcatgtttcagatgaaactaacctaagctcatcttgagtaaggggcttagaagtaaatgctttgttggttgctttgagttgtacaaagcaggacgaccaccagaggctttctaagaaaaagaatcatagagactttgataaaattggaactcctaaagcagctaaggctttgcttctatttttgatcatttttaaaaagttagttcttctggtgtttggtagttccatagtagttagaaagcactgccacatgaaatctgctattggtagaaaaagaaaatgttacagccaactctgatacaacatgagagagagacagagagagagagagaagggagagaagagacatgttcttctttgaccagcaggaaaaaaaaaaaagctgcacaaaccttttaactagtttcactagcagaaaagaaaaataaaaatataaaatagcaaataatctttaaagaaaactgattttcttattatgctgaaatttattaaagactgttgtgttgactgaagaatatgtttaaatattttgtggaaggcaaagctttcattcaggaatgacaagtgcaaggactgtaattctaaagaaattaaagaaaagaagaatggcaatttaagttcagggacaattggaatcaagcagtaatgatttacagctttttaaaattttcaggcacttagtggtcagtgttccttttatgcgttatgaccagtgggaaggataccaggatcttccattcagttattatgggttacaggtcacccatccgtgacctgtggtcacagtgttaggtatcgaaagcataataccttcttatctaagaaggaaagacctgttaagtctaagcttaggggtagagttgtcaacgatacagtcatatttgttgaacagttcaagttgccatttcttgtattcttggaagaggtaagttaaagaaggttgtgcacagttcttgacattttattattacagcactacctttcaagccactcagtagtcatcggacatgtaagagtggttgttctatttggtcgtgtaaatttctagtgacagtaggaaaaaaaaaaaagacctttattaaagaccttccaaactaattcagtgccctacatgctgcatgaaaatgaggactttccagttctgagtagaaggaatattaaggcacctgaagggacaaatccatttataaaattatttttctttttgtgataaaaatataaatggctctgctagtatactaaaaaatataaatggctctactagtatatttaataatccttcattgatttacctaaacgtatgaagatacccatataatatttttaaaaataagttattgtagctctaaaataatttattagactagaataaataaatttatactagaatttatgatgaacagtcaataaatggaattaaaaatataggtaaaatacagttaaaatatatacaaattttaagtgatacatgcaatgcacaaattgtaaatgtttgattgaggaaagagctaattcattggaagctctagtccagtctatagtatttggggactgctattgatatgttcattcaacaaataattactgataatatagtatgtactgaaatcattatgctaaacactgagggtttacaataaataagaaaatgtataacctcattgaacttaaatctagtagcagacacaagcaagtaaattggcaataaaaatagggggagtcaagggagtttggataaattatagaagaagctcctagacagtccatggaggtatttgtgggaggatggaattggcaacacagctgagattttaaagatatataaagtacatctgtgtaaatggcaagcagtgagaacacagaaaaggtgtttgaggaaagggcctaaagataagatagaccatgacacagaaaggaaagtaaaaatgattcagtgaccatctagtagatatccaatacatatatttgagtgaatgagtgatagactgactatatgaatgggaaatattgaaatataaagaggaaggccagagataaagctctgaaaggtaagcatatattttaagacttcagagtacctaattttctgaatatgcaaatgagcagtattagaattaataaaaataaccctaaaaatgagaactcttggttggagaaaataacaaaatatgaagtaaaggaaaattgacagaatacttcaaaaactgtgcctgatataattggaaataatgcctggaaacagattgagtccataatcctgtatgtgttcattaaggccaggaagattcttggtaaggaaatgtctagtctgaaaggtctaaagattttattaatctgtataataaattatatcttatgaaactcttgtcatttatccagtatatttgaattacccgtgcattactgtttcatatattcatggtactttcatattttataacatttaaaaatatttcaatattccattgatttgaataagattctttaaattacagtgaaagctttctgataaggtatggtaagattatttttcagtaattatgctgatacatataataaagctactgacaattcataaagatgataatacacttagtacaaactgagcttcaatgggattactaaatgagtatgtgaggacagagcagaggaaaaggccaagggttgagcactgtggtgctctattatgagaaagttaggaaggattaaagttggcactgaaggggattgagaaggagtagctgaagcggtagaaggaaaacaagaacagtgtgtcctggaagtcagtggagtaatcacttgtctcaaatgctgctaataggtcaaatatggtgagaactgagaactggacatttcatttagtaatgtgaaggacgttggtgactttcccaagagcagtttcagtggaatggaggaagaccaatggaataataggagcattgtggaggaataaaccaaaatgtacctatttaccatccagagccagactcagagcctttactctgtgctagaaacacaatgaccaattgttgcattgttccctttccttgagctttctacagctcacctcgcttcttcaaacatgtacaatcagacctctgaatctgtggattccacatccatggattcaactgactgcagaagaaaaatgttagaaaaaaatctgcatctgtaccgaacatgtgcagacttttttcttgtcattattccctaaataatatggtataacaactatttacatagcctttacattgtattgggtatttaaagtaatgtagatgtgatttaaataattttgaaatatgtgtataggttatatgcacatactatgccatttcatttcaaggacttgagcatcctcagattttgatatccacaggaggtcctggaaccaatccccacaaatcccctgaaactataactgatgaggggtgatggtacttctttttttacacagtcaaaataaaagagattaggcttgtttttgttatttctccccaaataatgccatattgagcatgactggatttaagaggtccccagatgtctcagccactcatttacataaaaattctttgtccatatctgtacatccttaatctcaagctacacatatggatttactgttctgtctcctggtgtcagcttactttcaatttgttttacctgtttcattggcacacttgtagagattgataatacaaaaatgttttaggagagagcataccacacatcaagttgtcaacttcatccacttctgctacttatttcaaagtttctgatacttattcatgatctttcagtagccttcattctcccatccatccattcactcaagaaacttgtattgttagggaatgtattagaattatagctcttcaagctttccaaaacaaatgtagcaacataaatagacaagcataataatggaaaatcgtctatacgagaaatctaattattttaggcacaaatcattttttaaaatgtattctaaaataaaaatgccattgaggcacagaggtcttactaatctgtaaagcaaacatgatttatatagtatgcttacattagtaaatcaggattatttgggtgaacagagtataatattgatatagttatttggttataaaaagagatgtttctgataaggtttccccccctttatttgccttggaaaacaaatttcaaagaagagtgtcattttaaactctaaaaaaccagttgataaccatagtctgatatttgcagttggaatgaattcctgtgacagcatgaacatacacccaccaacatgtctgtaatagaaaccactttggaagacactagaggctgccacagatttctcaggtcctcacagcaagacagtggtggtcttggggatggatacatttcatcttccttgaagacagataccaccctctggctgtcaccccataggaaatcaggaagtatgctaagctatccagtggacttggaattacactgtgctgtgctagtggaaatatcctatccaacattatgatttattttgaaggagaaaggaaaaaaaaatacacacaaaacggtggaaggaagctgcacacaacatcgccaaacagctggcttgttttatatcccagaaacagcttgggactaactatattcacaagatctcttggcagagtagcttgatgaaaataccaaagctgtgagaagtgttcttttgctgaatccttcatgtagctatcacacggtttattaacctaaatgagaatatgtacaccttttttccaaaaaggtcctttgtatgtttaagtgagaaacttactgattcttcatacggcacaaacatgattcaccacagcattcacaccaaataaactctaataatgttcagaaactataatcctagacatgtagcgatttcctcctttctttcaagtagtatttttggggacagtcaagagagaatttgatagaaatgtaagcctgagttcaatggcactggtgacttttttaggtgccaaggttaatctcagagggaaattagttttaatggcttcatccatatatttatccattcttttaacatttaactctaacctccttaagccaaaaatataactcaattctaaacacatttctggctcacctgctaggtgccagaaatgcggatcttgaggaatatacaagatctgcttcactcttttagaatccctgcattagagaggattcagtattttcagattcatattttagaagacattgcattctattccttactaagcatcccaggtagattcaattaggtggaacatattcatatttttatcatgaggcattttgagtctattctttgtgacaccagaattagtttctcatctcagagtttgctgtatttctctggtgactcaagtagtttattggcagtcagtttgtaaaaggctccctgggattatctaaatgcaggacgttaggaatggaaatatgtatcattgcctctcctgtcaaaaaatgtaattaacacacatgatatatcatcttacaaagtggatgaaaattccagtgggtgaccttgagtcacagctcctcagtgcacacactgtcctgtacccaagcatctcccagatagcacagaactcccacttcctgcatccctgtacctttagcactgtgtgcatgtttgtgtgtgtatgtgtgtgtgagtgtgagtgtgtatgtgtattttcagttcaaaatctaccactcaatttcactttctttaacaattttggtttggttcaatttgttgcataggtaataataatccatttacagaatacaaaaatagtgtaagtatgtgcttcttcctatctgtatgttgagagattcctcattcttttttatggttgcagataattcattatgcagatatacaatttatttaaccagtcccatattgatggatattaggttatttccagtcctttgatgtgaccaaaaaagattataataaaaaatgctgaaagaataatattgtctttgtcagtttgggcggccataagaaagttccatagactaggtgggttgtaaacaagagaaatttatttccccacagtactggaggctgaaaatctgagatcagggtgtccgcatggttatgctttggtgaggactgtttcggggcttgcagactgctgacttcttgtagcctcacatggttgaaagagagctagctagctctctggcctctttttattaggtcactaatctcattcaggagggctccaccctcaggatctaattacctaccaaacgccttgcccccaaatatcatcacatttgggattagggtttcaacatatgaattttagtaggggggaggcaaacattcagtccattagccatattcagttcacctgtaatatagtatctgtattattttatgtctgtagaataattcctagaagtggaattgctagctcagaattactgtgtgtttctaattttgatagttactgctcaattgactttcttgaaatttgtatcattttacagttatacctgtaaatgtaagaggtatgtatctactctcttagtctaaccatcagagagtattaccaatatttgtggggtttgccaacctgaaaaaatgggaagtttatcagtgtgtttttaattaacatttatcctattatgagggaggatcagtatcttataaacttttaacagtcattttaattttcttttctttgaatagggccctcatatatttgtgcattttgttatggtgttggtgcatttctttattgatttacaagagttctttgagtattaggaacatccttcctttatccgtgccaacagtaccttttattttgtcacacagtttattcttcatcagaattctttgctcttgagaagtccctgtgagagcctgccagccttctacacctttggagggcagtttgttggcaatttctcaatttttctttcacatagaaaatgatctgactgaattttatttctcttgatgtcaactgtgctgaattattgtcttaaaaaattcaccattccattcaggtttaacatattttttagagtgtgattttcatagggtatgttacattcttgatgaatttttatcttcttgacctattaattactaaaaaaaaaaatacagataacgacaacctaaaacaacctattgaaatatctcactgtgatgatagatttgtctagttttccttgtaatttttgttctccatattttaaggctatataatgtgatgttttcaagtacagaattattttaagttcctaatgggttccttttttaatctgatattttataactttttccccaagttttctggtttcccaccataccccagattcttaagtaatttagggcacaataattttcagagaaagaatgattaagaatttatggaaatcttaggaaggtcgaattgacgcagtgccttggaagagagaaatataggtagttgaagtataaggagaaatgcctatgatataaacaaacaaattgcatgtacatgtattaagaagactataacatatatcagttacttcactagatgccagtgcataggcatgtacctgaatctgcgtaactaattgggagaatgggaagttaactttatttttccaagaaaaagaaacaaaatcaatatttaaattttggaaaacataattgttaaattatttttcatattgtgtagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagagtaagttatgatgaatcatattagagcctacaaatgatatcccacttatctttttgtctgttaaatactttaaaaatgttttcagtgatttgtaggagtggttattatcaaatttttattttagaattgtagattattattattattattatttgaaatttgacagactttcctttgttcagatccaagctgtgccgcttattacatgtgtaacatttatcaaacattttagccttctcaaactttaatttcttcttttgtaaaatgagaatcacaatgtctacttaataatcttatttttcagaataaaattagcctttgtcaccttaggggatctatactactattataattggctttggcgagttactactggaagtgcaggggctttgaaacatttttttgccaccactgagccagtatacacacatgcacacatacagagagcagtatgtcttaaaccttaatgtgtatgggattagccagtgatcttgtggaaatataggttatgattcagtagggcagagctgagacgctgcacttcaaaaactttccaggtgatgctgatgttgccggtttgtgggccatcaaataatttggttttatgcttgattaatgaatcacaagccatagttttaaaaatgcagtgctataggagaaaactgattctacatactgttttattttcctttacaaataaaatattaggggaaaaagtttaaagcatcttttcaaaagctttttgaacacaagagctaacagaagtgctgtcttccagtgttaaacaggaatttgtgggattacaagatagatgatcaacccagattgctatgagtgataaccgtgcttcctcctgtctaccttctaccatattcactggtttatggcacctcccacatatgctgctacacaaccaaggcattattaccagggaagtcaattcagccataactctataaagtaaactcctgtgaatagagtatctactgtatgactagaggtatagctaagaaaaaagactatagggagaaattaatattgtaggacaaagcatttaattctagaatgatcccactaaggtaagaccaccgtcatcggttgcaaaattgctgaatcactagggttaatagttacagatcctaaatactcctcacatgttttctttcctcgttacttaacttcccacacccaacctctccatcatcacaagataacttttaaggctttagttagtcccatgcaacatatgtcagatgttttagtgccctgtattttccaaacttgaaataatttccccttgtattatacctcaacatattgtaaattgtctcatgcaaaactaatcattattttatagcaatgtttggatttttcacttgtttaagaaaacattttcaattctaattttggcgggacttaaaaatatacaccaaggaagactggtgtgaaattggagtgaaatttaatctttcttgacagtatgtctatcagagaaaaaaaatcaatgaaaataaattagtgttctttctatcatctcttgcaggaggtagagtgggggttggggtacacatctattatttataactttatcgtacatgagtctttaaaataatgcagtataagtcaacatataaatatgttttttgaaagtactcaagttcaataaacactcatttaaatatataaaaataagatagcaaatttcagctcttcttcatgactcaaaagcaaagcattatacatttatatttaaaatagatttcccagttttaaaagcatttacaaatactactgtatcagctttttaagcaaatatctctatttgtgtctatattattaagtgatgaggttaaatggaaaaaatatttttatactatccaaactccctagccagttccattagttcaaggtctaggtatatcaaataagataacataacaaaaatattttcaaagacactatatgtatgtaacaaaaacaaatagaaggaaaaagaaacaaagaagtaaattggaaaaaggggattcttagtcaaggaactcagatatgtgtccacctacatattctagctaaatctgttttttttgtgtgtgtgtataattggaataatagaactatctaacgctaagatgattatttgaatatgataatgtaaagtgctctgacaattataaaatgttatatacacattaattaaaattttaaaaatagtctagcctccataattatccttaaaaaatagctgggtagattaaaataattagtaacatagctctatgttaacttcatatacaaaggtaattgtatggactatattacatagtaatataaaaatgcaaatgttctgcacaataaacttacagttaatgactttttaattttcttcttaatatggttaaggaatatattgttatgagcacaatttctacccagattttgttggttcttttcaaatccatcaagtaaaacagtgtgcgtatgatttgtgaatactgcagttgctataatcacaataaaagagggtttcttgcaagaaactatgtaaaacaacttttatgaagaatagctgtccttagccccagataaaaactactgtcagccacaggtactctagcatggacttggtgctgactgggaaaaagatatttctaaaatgcccaactagcttaaattaaaggccactcttcctttgggctaagatcacagtgctaagagttactttgtcagttttgtgagtcctcacttgtcctcaagaaacacaaatgtccttcaaactaaggataaaagcagaaaataaagtttttactgaatgtccccttttgttactttgaccttgcagtcatcttaacaggatttctctctggattgctttttgcagtattactactcggtcaaggatatttcagttggagggatgtgcatctgctatggtcatgccagggcttgtccacttgatccagcgacaaatgtatgtatatttataggatgcttaggcaaaatgaagccctgagctgtaaaatgtttcatgacagtctttgctgacagagaacgctgtaaatgggagtcaggtccccacttagacagtgtaacagaaatccatgccagggtgaaataagagctggcagttaggatgatagactttgaaatcagccatcacagtataagaaaacagattagtttttcctttttttttttttttttcaaaaaggctccaaactggtctattttgaaatctctctagctatgacagcctgcctcatgatatagctttagagaacgcctgccatcaatcaacctgaccatttcttttaaagtttctaatcaaaaaattaatgcaaatgagtaaaaaaatgtgcagggaagtaaatatataagtgacaatggaacaggaggataaaatagggcaggggcaataagggggtggagggggtggagtgggtgagagagtcaagagagtactgatagtggcaagccggaaaatgccagaatgctttttgatagaattttttcattaatgacaatgaattaagtgaacataacctaaaggagaagatgaatgagcatctatttttcctgtcatagacaaactggtgaaattcaaactcatctcctgtatagtatatggaaaaatacattgaatagtaagatcagtgaatgtaaatcgggccacagattttttttctcaaatattgtaatgcaaatgacattatactcaaagctagttttctgatgattggattataatgttatctcctaggaagattaaagtacactaacatatttttatgggcaaagctgcagtgctgctttctgcctggtatgggtgctttcttcttttttttgttttccattttttaaaattttactttaaatcctggatactcgtgcacaacatgcaggtttgttacataggtaaatgtgtgtcatggtcatttgctgcccctatcaacccatcacctaggcataattttccacaggctttacagagtccctttgtctcactggctttctgcattttaaaaatccctttactgttattttatttggaggaagtgaaaaaatgcatatgccaccatagaatactacgctgccataaaaaggaatgagatcatgtcctttgcagggacatggatgaagctggaaaccatggtcctcaggaaactaacacaggaacagaaaaccaaacactatatgttctcactcataaatgagagctaaacaatgagaacacatggactcaaggaggggaacaacacacaccagggcctatcagatggagggaggcaaagggagggagaacatcaggacagacagctaatgcatgcagggtgctttctatcaggtgtacagatgatcagtgtttcccaggctttaaaagtccacaagacaggcttggaaggccaattccaggtggtaaattgagactgtattcagagcatgcacagacaggagatttagtcctagagacattagatttctggtttacctgcacccctagaggcctaggaatcaactccctccttcttgccatatccaaaaatattaacaacattttgaggggagccttaaaacaagctaatcgacccccaaaaaacacatagatcccaggcatcagagaaggagaattcagtcttcaagaccactcccagctgggccttcctgctttcttctgagcctaaacccagtgattaaagaaccagcctggacttccttaaggtgatgttgatcaaatatacccacttcaagcctggcaccactttcttcccaggctggctagttttacattttagtacacagtccagatgttttctcttttcttcatagtacctttagagagaggcttcctttatggttctaaatgaggctaaaatttgtgcttcctccctctttttgactagaaatctcgctgtgagtgtgagcataacacatgtggcgatagctgtgatcagtgctgtccaggattccatcagaaaccctggagagctggaacttttctaactaaaactgaatgtgaaggtatgttctttagaagccaacaaaatatgtcattcttcctttccaagaaaaaaagccagtaatgaaaaatagtgaaatggctggttatgcaaatgtgtcaacaaatactcatttatattatcacttcgaagacaacccatatgtctagcttttcctaaagggaaatatctaagaaatgtagcagatgactttatagcctaatagtgacaactggtctttttaggtgacaggtatcatggagaaacctgtgtttctggagattttctcaacccaagaaaagacctaaaaatagtcttgggctgaactgcaaacctaaactagtatgaagtccaattcaactgaatgcaaatattaatattacagtaaatcagccctaaccacatttttttcagctcactaagtatatatggccttcaaaaacagcttgatagacattttaaattaataccaacactatatatcctttgaataacaaattaactcaactcacatttatcatgtacaatgtgtcagacatgacaggtctttaaaactattgaatcataacacaccttaatcacaaaatgttccccacctataagatataaagtcggccttccatatccatggtttctccatccatgggtctaaccaactgcagatcaaaaatgtttgaaaaaaagttgcatctgtactgaacttgtaaagacctttttcttattattatttcctaagcaatataacaactatttatatagcatttacattttgttaggtattataagtaatctagagatgatctaaagtgtacaggaggatgtgcataggctgtatgcaagtactatgccactgtataacaggaacttgagtatccttgaatcttggtgtttgagggaggtcctggaaccattcccatggatattgagggatggctgtattttctttttagtttgagattctgcatatatgctattagctctccttattttctgcactcacttcatttgcttttggatttgtgtctgcctgtttataaagatattatggattagaaatctcccattattacaaaagcatatctggaggcatgagccaccattggatcatcactcaccatgcatggtaggggaccattggaagcccagccttttgtttccttcaactacttccagccatgttctggctaatcccttagttctccacagcttctccatagagaacagacatttgttcttaatagtgactttaaatgtaatgccacccagggatgtttgctctcgagctcctttaaattttaattaaatttctcttctgtttgtagaatatcagtaatcataagtgggagcagcacttgaaggtaggggtcttcctgttgccactgacatgccttcacacagtgataattgtgtaatgttaagtggctctgcaaaatcctttaccactctttacttgtgtttctacgtttaaatacaaaacaaaaacaatcgagcaacttgttagcaatagaggtagactaagcaaggcaagacatttcaaactgctactgtacacatttttaaaatagtggaattgtgaaacactttttttctttccctgtagggaagaggggaggtcgtatttccaaactgaaaaacaaacattttaaaaacgcagaaattcaagatggggatcttagccataaagccatacataaaaatcacactttcagcaatgagtacattcctgaaagcttaagtaaaaattttcttttccaagttgaatcatattccaatcaccttaatatttagaaaaatccttccatgacatgacaaatccctccataaaatgaataatcacattctaattcatttgagtttaatttggattttcatcaatctagcttacataaggcaagataatatctctaaaaagcatagaatattcattcagttgctgagcctttactaaacaacagtttcatatgatatatcttggacattctgtgaaatagtaagttgctgatgatagagaaaaaacatggctttgtgatcagttactagccatattcttgaaggttacagacagagcggggtaggctgcagcctacagacagaaagtggggctgtaggtgtagggtcctggctgcacagagtgtgtgatggaccgtttatttggcatcagggttttacatatagtagctcatagttctaaacactcttgacaacacgaattctaaatagtgtgagaataagtctatgttactttatgttttcctctgcttatactggcagcagaagttttgactgttttttgaaatacactattacaacaaagcttttaagaattcatagccaggtccagtggcatgctcctataatcccagctactggaaagaagctatggtgggaggatctcttgagcccaggagtttgaggccagcctgggccacatagtgagaccctgtctgtatcactccgttttcacactgctgtaaagatactacccgagactgggtaatttataaaggaaagaggtttagttgactcacccttctgcatggctaggaggcctcaggaaacttatgatcaaaggggaagagggagcaggcacatcttacatggtacaggagagagaggagaaagtgaatggggaagagccccttataaaaccatcagatcttgtacgaactcactcactatcatgaggacagcatgggggagctgcccccttgatccagtctcctccctccctccatacgtggagattacaatttcaaatgagatttgggtggggacacagagccaaaccatatcactgtctttctgaagaaaaaaaaggaattcttgtatgttgccctaaagatataaaactgcttacaatgcctagtgatttgtattgattactatgtgttccctaaagtttgaaactctccattaacatagcaaaactactatattctaaatcaaatgtcagcaggttgggaaaggtatttacaacaaacatgacaaggggataataacctttctatattaagagatcttacatatcaataagaaaaaagttaacctgttagaaagatcaaaacaggtattcctcagaaatgacatataactttgtaaaaagataatgacactcataatgaaggaagtatcaattaaaacaatgacatattatttttcacctatcaaagtgtttattcttctactcaacaaatatttgaatgcttattatgtccaggaattgtattcaagggttgataacacacaaggttggtggctatggagaaagtgttttatcatatctactagaggaaaagtcatttgtcatagcgttcctggaggggaattttttaagcgattaaaatttaaattttacatatcctttgactagaaattatgcttccaggaatttaccctatagatatattcatatagatgtacaggcatattatcatgatcctcgtcattattatacaagtgctaccactactgctactaacatttattgagctcagtatttagtatgtttcaggcattctgctaagcattctcaaaacatgtatgagacaagtactaaagtgatgctaggactcgagtttttgcctcaaagtcactcaactggcaaataggaaacttttctaacattagagcgcctccctccacccggcatccttgtcctcccagtatgtgtgtggtgttatttgtaaagggagaaacatggaaactgtgtaactgttcattaatagggacctgataaataccttcattcaagtagtaccctgtgtacccttaggggatacacatgctaatatggaaagggctccatgatttactgttagtaaaaagaaccggttctaaacagtatacaaatgccccttcccttttgtagaataaataaaaagattgagctgtatgcatacaagcacacctacacacacacacacacacgtggaaataaatgtaagtactcctaagaaactcaacatgtcaggtaggaaggagactgcatcgatatatttccctggttctatcctaatataaattcttcatatttagaagagtcttacccaatcctttctggagaaagtgatttttcacttcttggaattcttctaatgtaacatgaaaaagacaaggaggaagaaaagaagaaaaatcaattgctaacttctttataagacattacgctaatgatttcacatgcattatctcacttgtgcttttaaatatcccaatctagtaattactattgaccactccatgtattatatggaaactgagccttcgtgaaattaagaagtttccaatgtcatatgactgctaagtagaggagagcacacccacatccaagacagttggttgcaaaatagcatgatcttagccaccagtaaactagctctcggtttgtcttaattccttggcacctgccatgtatcttatttcattcaccgggtaggatgtgaagagattctggcagtctttagcagtgcagactctggagtctggcttcagaggttggtttccaatactgattagaatatcttttacacgttatttcacttctctggactcaggtttctagtatacaaaaataggttaataataataatacctaattcctaaaagcatttttgaggattaaaatcagtagcaacaaatatggagcatttagaacagtgtctggcattgagaaaacctatgttttagttgttattagtattaaaagaaaggaattatattatacatacttttctttacccacaggctctaatacagaaatttccatatggtagtaattcattacagattacctagctgttaatcattcagtgccatcattgaataatttattatttgttataataggaaattgtaagttgaaccatataaaattgcacgttagtcaaaaccaaatattggcaattgcatatgattgagcttaatttatatgttttaatcatttcaaattctattaaaatgtgtgaatttattaatacctccaatacatccagatactttctggatatgtttgtgtgtgtgtacgctaaatgtaatttcccgtatggtataaaagtctaggccgggggcagtggctcacgcctgtaattccagcactttgagaggctgaggcgggtggatcatgggtcaagagttcaagaccagcctggccaacatggtgaagccccatctctactaaaaatacagaaattagctgggtgtggtggtgcatgcctgttgtccccagctactcgggaggctgagacaggaggattgcttgaacctggaaggcagaggttgcagtgagccgagatcgtgccactctgcactccagcctgggcgacagagtgagactctgtctcaaaaaaaaaatctattatgtataacagaaatgatttttaaatgtatctgaaatcaaattgatgtttattaatttatttttccttaatgcagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtaaagtatgctttttctttcataaagagttatttttttgctttttcatacaaaaatgttttatacaaaaaaataataattttgaaagcttctgtaaacagttgaacttcaaattaaaaggtaagtaggaacatttcgtagttgaaactgacctaaatctttgaggatgtaagataaaacttttccatcactccagaaagttttatcatggctccttccagtcaaggagtggacccctaggcaaactctgttctgatttttagaacgtaaattagttgtgcctcttagagaatttcataaaaatgaaatcatacagtacatactagtgagtcttttttcactcgacataatatgttaagatttatccatgttgtttgtgcatcagtagttctttttcttttgaaagaaattgctgagtagtatttctctgcacgaacatatcaaaattttaaatccattctcctgttgatagaaattaggatcatttccagttttagcttagctcctacaaataattttatactagttattttatagtcatatttttatttaccttgtgtaaatacttaggaatagaaagcttttttcataggataggtagatgcttaactttataagaaaccgtcaacattttgccaaattagtaataatgtataaaatgttcaccaaaaagttatatgagtttcagtcattctatatcatctctaatatttgatgttgactatctttttggattttagtcatctagtgggtgtgaaatggcatctgattatggatttaattttaatcgtaagggcttattgaccattcctgtatcttctcttatgaagtagatgttcaaagtctaaatatttttttatcctaaaaaccaaaattttaacttatagagctattacccatatcaagtaaatgtttgtgtgtggtgtgaataagtaaccagatttatatggttaacctgaagttctagcaccatttgttgaaaaatcaattgatcatattacatggatcaatttctagaacctcagttatctatttttcctagcatctatttttccctctgcgtgctaataccatactatcttcattgctttagtaagtctagaatttaggtaatataatgtaccaactttattttttattttcaagattgtctatagtaggggcttttttgtgtgtgtttctatacaattttagaatcaacttgtcaattacagaaaatattaggattattgcttagactctatatacaaatatggaaaatggagcttgaggagatgttggtcaaagaatataaaatttcagttagatagtaggaatacattgaagatatttattgtacagcatggtgactgtagttaataacaatgtatttactcttaaaaaatgctgagagtagattttaagtgttctcaccaaaaaaattgataattatgttaggtaatatgttaattagcttgatataaccatttcacaatttgtatatatataatatatatatacaatgatattcaaaatatcatgtcacacatgataaatatatacaattttgtcaaaaaggaaattaaactttaaaagcaaacaagtattgaggaaaataacatcataataatattgaatcatttaaccaatgaacatagcatatctctccatttatttctatcttctttattcatgtcagtgttccagtacagagatcttgcatgtcttttgttaaattaatctttagaattttgctttgcatgactgtaaaaaaaatttttaaataattttccaattatttaatgtaattgttaaagaattttgaatattgactttatgccctatagccatccttaatttctttttttttttttaaataacttcccttttaaaagttactgagaataaagaatacagaacatggttataggcacttacattgctatcaaatgcaggaattcacttcaataagaagtgctttctctgtaagcatggttcatggcaatagaagctccaacttaggagaggatgttttccgtgacaaaaataataacaacaaaaaaaatggtggttgaaggaaaacagtccaaatttacagatgctttaaacttcttttggccttggcatcagctttcatgttaaaaaataaagctggtggggaagctatctcacttgcaaagtaaatggcttgtatgagattggcgaatcttggtcagatattgcatttttaaagcacaaaaccaccggccaccaatatcttcctgtgcatgcatataaattattttcttctaattcaaatggcaacagaggaatcctggcgtgcatgtgcatggagacacacacacatcactaaggagacaggacaaactatcataaactaagcagtatcccaaacacatcatcatctataggctgttttacaaaggtggaatacaaacgaactgaatgtctcaggtaaaaggcaaagtctatttctccaactctgctgcactcatttatcttcttaaggctttcacagaaagcaccgttttatgaacaggcaattcagtacccagagcttgactggagacactaatcaggattgaagtcttgatgcagttcataaaaacccatttaaaaaaaggcatcaaaaaccacatttaaaataaagttgtccatatataaagaatgaagtgtttagaagttcccagcttgtatcctaataagagtactgaaaggtttaatattagcagcctgtgaacacgtagtgaagaaagagtctgagaaccaagttaacatccttattccactctaattccacccatgccatgggtaaaaacagttcttgcagtctagagtttctcctccgatggtttaaccgtcagatttttacatcttgggattcaaccatcttggcaagcgtcttcttaattctcaacgctgtgagtctgggggctggattgtgggcccagcattctgacattagcttcaaaactgctcgtagacattcatcactgttccaccgattagacacaattggccgcaaacgtttgacacacacaacctcacgcatatcttcgtatgacggatcactcggtaccatgttataatatggcaattggtagtcttccacgatccctcctgtgatacaacgacgagccatctcccaaatgattaggccgaagctgtagatatcagccatgatgtagggctggaagtggtttttgttcaggctttcgtccagcacttctggagccaggtagcgtttggtgcccaccctggtattcaagggcacatcaacttcatttgtgtcactgttgaatttaacagcaaggcccaggtcagcaatgcagcaactcccatttttcttgatgaggatgtttttgctctttaggtctcgatgagcaattgcgggctttccttgggtgccatacgtttctgtgtgcaggtggcacagaccacaggcagctgaataagccaatttaagcagggctctggtgtccagcgtagcacatttcaggaagtcatagagagatccattttcatggtaatcagtaatcaaatagagctgagtccaggaacctgtacctttaatatctgccgctatgaaaccaagtatgttttcatggcgcattagcacagtttggtagatttctgtttctcgaaaccagctggcttcttcagtggtaaagaatactttcaccgccactctttcgccatgccatttgcccatccgtacttctccatatcggcctttaccaacttgccggaccatctgaatctgtttggcaatagttcgctgaaccaataaaggtagtccagacccactaccagaactttgtgactggtcaataaggtcttttagtgattttccaactggaataaatgcttcatcctgttccaaatcacgattgtaacgacgtctgcttgagatgctcttgcaataatgtttgtaacaaaagcagctggagaagatgatcatagcaattatgcagacagccatagaaatgagcaaaaccagccatcgaatgctgccatcaaaaaacggacctatgacaacagggggcatgtgggttgcaaatactggttacataaattggtccgacaacattctattgtccggcgtagctgggcttttggagaatctttgcactgaaaatcagatccttcatatttcatacaccctgaagctaatgtggtttctccctggtcatcttcttctatgatggcaaagcaacgtccattagttatgcatgtgttattaatagcatcatctgggcagtgccctcagcaatagcacttgaaaaaaggcaaggtatcctctggtgctaaggttactccattttctgactttttctggtcggagtctgatttcatcccagtgccgtggagcatactatccagattctgtccttgaacacgagaaatgatgaacaaataggctcccaataatctgatgtaaatgtatagctgagtcattgttcaattgtaatgtttcctgtgtactgtcacctttagtaattggtcttgctacttcaccaatttaaatgactgtcattcagtgagattttcttgtaaaagatcgcaagcacttgacaatgacttcaactcccactgctttcttacgactcctccaagatgtggctagataaaactgtacttccgattttctccaaacagctttgacctatgcttccatctcatgaattccaagacagtattaaactgatgcatattttcataagtcgctcccggcgtctcttcccgggctccttgccagcgtgccgaggcgcaggcagggtgatggaggcgccccggccgggaggatctgccggggagagcggctttcctcatcgattcgggagcacccaccatgcttaatttctttattaattctagtagttttaaactacatgctttagaaacgtacacataaacaatcattttacctgcaagtacattcaggcttacttcttcctttgcaatctttatgccaaggttaactaaaaatggcgagagctgacatcttcactttgttctgaattttaaagggaaacctaatatttcactatggagtatgatgtgaactgcatatttttttatggacaccctttatcagattcagtaggtcccctactattcctaagttgcagagagtttttataacaaaatggttttgcattttgtcatatgcttttcgaaacctactgaaatgaacataaggattttctcctttattctgttaacggggacaatttatgcaaattgaattttaaaatatgaaggcagctttgcatttgtgaattaatctccatttggttatgatatattatcatttttatatattggatgattcaattgactaatgtttggttaagaattttgacatcctctcataaaatatattggtctataattttattttcttataatgtttttgtcaggttttttattggggtatactggcatcaacaaatgatcggggaaatgcacttcctcttctgttttctaaagtaacttcagattaaaattaattctctttaaaatgcttgataaaatttcctagtgaaactatctgagtctctagttttcttcgtgcattgtattggctattttttattagacatagggttagataggttttgtattaatatctttagggagggtcaatttttgatatattgtatttttcaagtaatttgttcaattcatctaaattgtcaaatcattggcaattggcagttttaaaaattgccttattatcttcttgaagtctatagcatctatatagatatcccctgtgtaatttttaaaatgattaagttgtgcttttctccttttattgatcacttatgttaggggtttatcaattttcctaatcttttccaaaaaaacttctgcctttttattttttgtgtttttattgattctgttctatttattatattattcatttgacctgttttggttttaaatttcattttctttttctacctatcaatttggaaagttaaattatgattttacacctttcttcttttatcatataaacttttaaatatagatttccttctagcagttctttagctgtttctcatgaattcaggaatgctttatgttcattgtcatttatttaacataacttctaatttctcttgtgatttattttttgttaatttccaaatatttgagctttattaaatattatatttttgatttctacactggatgtttatgatctgagaacatactctctaagatgtcaaactttagaagtttattgaaatttaacttatggctcagtgcatggtctctcttggcaaacaaataaatgtggatttttccaatctgcgattatggattcctacctttctttcatttttttcagtatttcttcctgttctttgaagcactgttatgaggcacatacatatttagaatattttgaatctttagatttttatatcttataaattaatattttgataactgtgaagatctccacttaatctcagatatcactttttgtcctaaagtctactttattttttattaacattgccacagcagttttcatatgcttactctgtatggtatgttttttctgattttgtttaactttcaacctatctttattttcatttaaaagatttcttataaagagtaaaatagatggattttttatcctgacaattactgtgtgtttagtccctaaatttaatatagttaataatatgattgggttttgctatttgtttcccatttgtgtcacaaaatttttgttcccattcttccttttctgtctacttttatgttaaacaaatatttttcagtattccattttatttcctttattatctttttagcagtacctctttgtataattttccattccaacttttattttaggttcaggtagtacatgggtaaattatgtgtcatgggatttggtgtacagattattttgtcacccagataataagcataataaaattttcaatcttcacccccctcccacccttttcaagcaggccctggtgtctattgttgccttctttgtgtccatgtgtactcaatgtttagctccactcataagagagaacatgcagtatctggttttctattcttgcattaattcacttaggataatggccttctgctccatccatgttgcttcaaaggacatgattttattcttttttatggctgtgtagtattccatggtgtatatgtactacattttctttattcagtccaccaatgatggtacctaggttgattccatgtctttgttattgtgaatagggctgcaatgaacataggcatgcatgtggctttatgatagaatgatatatattcctttgggcatatacgcagtaatgggattgctgagttgagtgctagttctgttttaagttttttgagaaatctcccaacggcttcccacagtgtctgaactaatttactttcccaccagcagtgtataagtgttccctttctctgcaacctcaccagtatctgttatttttgactttcagtaatagccgttctgaccagtgtgagatggtagtattttaagctcatgatatagtgatatagtcctatcttttggactattgttttcatatattgcacataatttgtaagccagcaatacaatgttgtcatttttgtttgaagtcacaaaactatgaaaacaatcttaaagaaatgaaaagaaggaaaaaaatttacattaaccatacctttcccattttccatactctgtggttctagcttatatatattgccctcctgcttgaaaaatttcctttaacattttttttttggtagtgcagagctgctggtgacaaattttctcaacttccctttatctgaaaatgtctttaatctactttcattattgaaggatattttccacatagttacagaggtgtgtgttttcttctttgtttagcactttaaagatgtggcaccattattttctggatttcattcatccttatgacaacatagccattatttgtttctttgttctatatatatatatctttaattcactagatgatttcaaaaatttttttatatctgccttttgacacttataccatgtatgataaaactttggcccgtagaccaaatctgactcatggcctatatttgtatgatctgtaagcaaaggatgtttttacatttgtaaaggtttgttaaaaggagaagtagaagaaggggagaatgaagagaactaggaggggggggaagaagaggaggaagaatgaagagagtctttatatggcttattttactatctggccctttacagaaaagttttccaacctcagagttaaataaactatgatgtgtctatgtttggctttcaagcttaccttgcttgattcacaaagcttctaggaactataaattgagattttattccacatttaggaaattttaggctattttttttatttttacttattttttttaggcttttgtttaaaacctgttttttgaccagtgtttttccttctctttctaggactccagctgcatgtgtgctagggcgttcattgtatctgaggcagtgctaagtaattttttttctttctccgttctttagattggatcatttccattcatctgtcattatactttggtctacatataatgtatctttaatttactagctgattttaaaatattctcattaggccgggcacagtggttcaccccaggaatcccagtactttggaaggccgaagcaggcaagtcgcttgcggtcaggagtttaagaccaacctggccaacatggtgaaaccctgtctctattaaaaatacaaaatttagccaggcatggtggcaggcacctgtaatatcacctactcaggagactgaggcaggagaatagcttgaacccaggaagtgaggttgcagtgggtcaagcttgcaccagtgcacttcagcctgggcaagagagcgagaccctatctcaaaaataaatacaaataaataaataaataaattctcattatatttacttttaacaatagtatcatgtttgagaaaactttggcctgtagaccaaatcctggcctatggccagatgactacaaaagtagtcattaggttgactactcttcctcctatcatctctacctgatgttaagcatatccagtgaattattaaattgaggtattttacttttcagctttctggagttcttatgttccttacagcttccatttctctgaaatactccataccttcactcattataaacattgtttcctttatattctcggacatatttacagaacttacgttgacttccttgtatgctaatttcaatatctgggtcacctcaggatctgcttttatcaacttctttttttaataaggtcaacattttcctgtttctttcctgtatatctaatacagtagtcctcctttattcacagaggatatgttccaggaaccccagttgatacctgaaatcacagatagtaccaaacctatatatactatgttttttctatctgatacctgtgatgggactaagtgactaacaggagggtagtgtctatacagcatagatatgctggacaaggggatgattcatatccctggtgcgacagagcaagatggcccgagatttcaccacactattcaaaatgacatgcaaattaaaacttttcaattatttatttctggagttttccatttaatattttcgaactgtggttaaccatgataactgaaacctcagacagcaaaactacagatgaggtgaggactactgtaatttatcatctctacaggacatttcggagaatacaatgcagacactggtttctgttatgttcctctgaagagtttgaattggttctaattagtaataaacttgctgagtgatcaccatgaagtcatgaaagtttactttcatactttgttaggacagattagtggaaaactccaggtattcatcaaacatttctaatgtagttaacttaaagtctgaattctctttactttatggttggtagcacctgaaaactcttctcaccttgttcagtttccagcggttgctttccactgaatttcctagaatctcctgagtgaatatacaataaagggatcagttaaggctgggaagggtattgttatgcaaattttgtgaattgcagtttaacagctaaagaatttatctctatgatgttcataaaattattgtcttaaaatttgattttagatttttccacttaatgacatttaatttatatgtgtatataaaatatgccttacctattctgtgcacagtcccaacttcataatgggggaatgaatgaatgtatcttaaacaaatgatgattttgaaactgacctgtgaacttagttaattgagattcagtgaggtatataaataagtctaattttaacactctgatttatagtagcaaacaagttttcatttgtaaattaagcctagatatatatacatatgaactatattgaataggtgggcatttcttgggcaaataatttagttttttttttttttcctattacatctggaaaataaatcttgtatatacagtatatgaacacagtgtagttttgtttaagtaaactagctttgttgatatactatgtatacaagataaaaaggaataaaacatgaaaatatcaataagtattgaatctaagtaacaaatatataggaatttattattctattatctttacttttgtgtaagcatgtaaaagaactggattttagaaattataaacatgtattaaaggtaattcttatagttttctcaataatttgctgctctgtattattaaaactactttgtctataaaagtttgctgaagtgaaaaatattgctgtttctattacacttcgttaaattcattttaatatttttgttaggtatctccaaattatccaaggccatgccagccatgtcattgcgatccaattggttccttaaatgaagtctgtgtcaaggatgagaaacatgctcgacgaggtgagagctgcagcagaatgtcactgctctgataaaaggacaactaaaagccaaatatgattattttcagaagaatattttgcagtaaatgttattcatgtaataaatttattctttaatctatcagtgtattagcgttccctccaggaagtagtttttaaactcatctcaataattactttcatgtttaattataatgttttcatagcaagaagagttgaattatgtattttgagatacacacacacacatacacagagataaagaaagagagagagtcaatcacaaatctgtggtatatgtaattttttcatatcgtgttatttattagattgtttgtagcttctatgagttctagcatgaaatgccagcgttcactgaggaatgtgtgtgctgtagtgggaaaagcaaatagaagaactcacacactgagatgtaggcaataatatagaaagcaagaagtgttcataaaggactaagaaggtagtagtcatgaattaatgaacagaaagaggctgacactaatttaagctaaagccttcctttgaggaatgaaattcatgaactccaaacattaagaaatcaaatgccaacataactccttgatataaaagcgtttgggagctacttccagggcagttgctcgccaagtttaagtaggaaattcatagaatgcactgggacgcttcttctctagaaagactaaaattaatcaaggctacaatgtagtgtttttttccctaatgactttagcgttaaaagaccagcaatgtttcttaggtacaattcttgttacctgctttctttataaaactgtaggattatcaatctgagcattacatgtagactaaattttgaaatattaaaaaacggatacgttttgatagtcgaatgatgaattactgagctcacttttcgttttaagccttttctctttgtgtttacaagtaaatcacaatgttgttttcattaatatcatttaactcttccctacccctttttgagtaatgagtatatgatcacagaataaaaatggaaaagtagaaaaataaatatacaattcagtggtaattcaggagagataccactattaacattttcatatatttctgtcataatgcatacaaaaatttctgatattgctcctcttaactttatgtgatgagtttccccaaaaatctatgaaaactttctctgaagtctggcttcagcacctaaataacacattattatatggtcgtgccataattatttaccctctcaactttatatggacattaagattgtttcaaatttttgtttattttaaccaatcctttaataatacttattccatataattacttttcaattattgtaaaaacaatacatagtaaaataaattcttaatagtaaagaaataaaataataagtgtcctcttcaacctatttatcccagtcttacttccaaatttaaaaatattgagccttttttccgattcagtttttattttttttaattatactttaagttttagggtacatgtgcacaatgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatagcattgttcaattcccacctatgagtgagaatatgtggtgtttggttttttgttcttgcaatcgtttactgagaatgatgttttccaatttcatccatgtccctacaaaggacatgaactcatcattttttatggctgcatagtattccatggtgtataagtgccacattttcttaatccagtctatcattgttggacatttgggttggttccaagtctttgctattgtggataatgccgcaataaacatacgtgtgcatgtgtcttcatagcagcatgatttacagtcctttgggtatatacccagtaatgggatggctgggtcaaagggtatttccagttctagatccctgaggaatggccacactgacttccacaatggttgaactagtttacagtcccaccaacagtgtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccacttgttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagttctcccagcaccatttattaaacagggaatcctttccccattgcttgtttttctcaggtttgtcaaagatcaggtagttgtacatatgcggcgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgttgttgttgtataagaatgcttgtgacttttgtacattgattttgtatcctgagactttgctgaagttgcttatcagcttaaggagattttggactgagacaatggggttttctagatatacaatcatgtcgtctgcaaacggggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattctgtatgatactggctgtgggtttgtcatagatagctcttaatattttgaattacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcctacttgatcatggtggataagctttttgatgtgctgctggattcgttttgccagtattttactgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgattttagtttgtatttctgtgggatccgtggtgatatcccctttatcattttttattgcatctattagattcttctctctttttttctttattagtcttgctagcggtctatcaattttgttgaccctttcaaaaaaccagctcctggattcattaattttttgaagggttttttgtgtctctatttccttcagttctgctctgattttagttatttcttgccttctgctagcttttgaatgtgtttgctcctgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcatgggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtttattaggtccgcttggtgcagagctgtgttcaattcctgggtatccttgttgacttcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatgtttgttggtttaaagtctgttttatcagagactaggattgcaacccctgcctttttttgttttccatttgcttggtagatcttcctccatccttttattttgagcctatgtgtgtctctgcacatgagatgggtttcctgaatacggaacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagcatcgatggtctttacaatttggcatgcttttgcagtggctggtactggttgttcctttccatgtttagtgcttccttcaggagctcttttagggcaggactggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttccggcttgtagagtttctgccgagcgatctgctgttagtctgatgggcttccctttgagggtaacccgacctttctctctggctgcccttaacattttttccttcatttcagctttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctacatttttttcaaagttttcaacttctttgcctttggtttgaatgtcctcccgtagctcagagtaatttgatcgtctgaagccttcttctctcagctcgtcaaagtcgttctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttcgtgtggatgtcctttctgtttgttagttttccttctaacagacaggaacctcagctgcaggtctgttgcaataccctgccgtgtgaggtgtcagtgtgcccctgctggggggtgcctcccagttacgctgctcaggggtcaggggtcagggacccacttgaggaggcagtctgcccgttcttagatctccagctgcgtgctgggagaaccactgctctcttcaaagctgtcagagggacatttaagtctgcagaggttactgctgtctttttgtttgtctgtgccctgcccccagaggtggagcctacagaggcaggcaggcctccttgagctgtggtgggctccacccagttggagcttcccagctgctttgtttacctaatcaagcctgggcaatggcggcgcccctcccccagcctcgctgctgccttgcagtttgatctcagactgctgtgctagcaatcagcgagactccatgggcgtaggaccctccaagccaggtgcaggatataatctcatggttcaccgttttttaagcccgtcggaaaagcgcagtattccggtgggagtgacccgattttccaggtgccgtccgtcacccctttctgtgactcggaaagggaactccctgaccccttgcgcttcccaagtgaggcaatgcctcgccctgcttcggctcgcgcagggtgcgcgcacccactgacctgcgcccactgtctggcattccctagtgagatgaacccggtacctcagatggaaatgcagaaatcaccgtcttctgcgtcgctcacgctgggagctgtagaccggagctgttcctattgggccatgttggctcctctccccgattcagttttttagtgagttacctttagtatctaaataatattcttatcagtacttttatcaccattacatattgcctattgactctccgtcttgaaaggtgaagaaatgtatcattcacaacacctccctccttcattccaccatccatacatttttattatgtgtttcttctacgatatctttatcatgttcaagagagcttacatgtctatttcatcaatgactacatttagactttctcttgaggtcctactatataagatgtgataaagactatcatccctacattcttcaccacttgtcagtgtctgtcaattacatatctttgaaatcttttcaaagattttcacagttacattcagctctggaccaataattaatgcttataattcaaaaatagaaatataataatcaagattgtaatactgtaattagatacatattatttgatacaggctcgaattgcaaaattggacacatatttgtaggtcatttttatcttcatgcttgctctgataacttatttaggaaagagtgtaagatgtggtctcatggtttgcacttcttcatcagattacataaccagatagtagaaaaggatattttagtgtattactggcattcatttgattacgagggaaatacgatgtatttcttctctgatttttcttttagttttcttcattttcttttagtagaaggaagttttctcccttgtagatttgtaagagcactttaaatattaaaaacagtgatagtatatcattttttaataatcagttttcagatttgctttgtgtctcactactgttgataatttctagtgcacaaacttcaaaaattttatgtaatcagctgtcaaagttcaggtaaaattctttacttataataatgataccaacccatgattattatatattttgatttttttgtgtatttcttacatgctttataatcctagaactctcatctatcccaagattagaaaaatgtatttgttttcttcatttgtatgatttcattttataatacttaattttttattccatctagaatttattttgttatatttcataaggaaattttcaaactacattttgttttccaatactcttttttactcatctacatttaatattactttcagctctttagacatattaaatatatttattttattttcggaatctgttagaagcactctgttattgagtctgagtctgcatttttatttctcttctaactcttattcatatggacttcattttcttatgtttcgtaagtgtgtgtgtgtgtgtgtgtgtatgtgtgtgttttgtggatgtatgcgtgcatatgtatttcttagtttattctttcagaagccttgaatttacatgaagttatgtgataatgacctaccttatataggacctagaattttttgttgttcttctgtaaaaccatgctccctgaactgtagtctagtcatcagaatttgccagtcaactccaggaaagacattgttttaaagaatgacgtaagctttctagaagtcaattttgtagtttctcatctccaaggggtttctttatttcttgccagcgcaacgattctgttatctgccatctgtctttcgatctatctacctacctacctacctacctacctatctatttttctacgtttaattttattctgtatcttcaactgttctgaacaggaggggttttttggacatctagtctacaatacttccagaaataaaagttaagatagacattgtttaatacatgaagtacttctacatttagcctcaatttctggaaattttaacatcagaaataatgttaaactatttaatgcctttgcaaactttattaaaattatcagatttatttcccatttggtctattgggtaatctattagaaacgaacttactaatatcaaacaatatttattttaccagagtatgttctacttggacatcatagaggatccttttaatgtactttaggattcagtttggtgttttgctcatctggattcataagttaattgcctgtgactcagacacccaccagttgtgctcctttggcaaatcacttaatttctccatgccttagttacctcatctgtgaaacaggaaaaataatagtgtctatctcatatagatgttttgagtactaactgaattaacccctgtgttttgtgtaatgctaagtataatgactaccataagataagtgctatttgagtcttagaagttttgtttatttggggttatcatttgcatttgggtatcaagttagaatttgcttcataaattgaattacatagctctccatttttatatgaccataagagtttcaagttttgaaaacagtctgtaaaaattaactagcattacagaaaaccaaacaccgcatgttcttactcgtaagtgggagttgaacaatgagaacacatgaacacagacaggggaacatcacatgccagggcctgtcagtgggtgggggtctaggggaggaacagcattaggagaaatacctaatgtagatgacaggtcgatggctgcagcaaaccaccatggcacgtgcatacctatgtgacaaacctggatgttctgcacatgtattccagaacttaaagtataataataaaaaaaattaactatcattaaaacatgtttgtggtagttctttgataatttgtcctcttttgatacccttgattagctttgtttaccgtttccttttgcttgcttttctttttttcaaatctctttacttcctgtggtgtttatattttctcttttttatacttaaatgaattaaattttaatttatctatttttaaaataatggactatttaagcctataagtttacttttgggtacagtttttccatactcaacaaaaattaagttccttttttactgctattatattctacctagatagctatttatttttaattgaagtcttgattttctctttaacccaagagttattaaagagaaatatttaggcattaatttttagaacagttgaattttgcataaaattctctcatcatgtttgatattcagaactaatttaatcttaatttttgtggcatttgatacacatctaaaagtagtaatttatgttaagaaaataagccttagataatttctgctttgataattgagtattttttatagtcaatcacaaactatggtaaatatttagttatataccacataatatgtaatttgatattattagattattcaaattttctgttttttcttacttcatctgtaaatacttaagatgagtaagttagcatcattttcagccattgacttttaaagtttttatttccaatatattttgttgtccacatatttttgtactgataattagtgcttatttgaagcataaacataataatttaaatcatgtttttattatatttttatcaatgtaaaatgagagcttgccttactgaacctagtttatttgagttctactttggccctatttaatatttcacaacttttttttcttttccatacgctttcttgacacacattcattttcttttacttgtaatattttatttgcaatattcctgttcattttgtttatctcttgtgcacattacatgtttatgtttttaataagaacagtaagactgcttaactcattagtatgtatttagtatgcatttctgacactaattctgtcattctgctttttgctttctctccctaatgtttccttgcctttttttccctcctcctttcttctttctgatggactatatatattactgatttgcttttatctttctccagattttgaaggtctgttagttgtattcattcatcctgtattatttctattttttaatcaaagacatgaataaacattgtgttttgtatttctgtatgttaaaaaagtaaatttaaacttttcattcccctcatctattgcttcttatccccaaaatatcaattccaatgaacacctttattttctttagtaatactgccagtggcatgttcttagagtatcattgttaaactgttattttaagtaatatgtctttattcccaaggctactttgcacctgtaatagtctggtggagcaggcttgttccgtgagccactagttttgcatttgttactgcttattcttctcaatgtagcatcatcagcattagcgtttgtggaaatttctccttggtcattgttttctatagccatagtttggtagatgctttgagatttcatctttcttgtttacatttttaatatttctattgacacttagaagatgctatgttcacgtaatcatagaaagcttttaattaaaccctctactctttggttttaacttttctttattgatatatataaaaaatctatttttgtgtcaaaatagcattttaaaggttactgtcattaaaactttaacaactaaattatgtacttgttttagaaatgttgatatgtggctcatctttctttaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggtacattgtttattccagtaatgtcccactgtcaagacagaaggttatttttcttggcttctctgttgatttccttggcattaagcaattttaatgacttctggaagtatccataatctattctacgtgtggtgacccaccaggttcactgtagcaggatgtttataaggcacttatctaaaagcctacaaatgcacggaggataaaccacgtttaaaggcttgttattttataacaaaaacactttcaccccattgcccaactagtgtgttaatttaaaaatatacggcactagaaatagcaaccctttaaaactaaagtgcattcaaatctacctttgcatctaattcagtaatgaattctgtcaagggttttattctgaatttttaaataatcttctaaagtttgaacccagataagccttaaaatactcattatattcaaatttttctgttcaattataaaaaagtacaaagccctaatggaattaattaaaggctcaatattttcttccaagattacttttagaaatgcaactttatttgttgtacatgctcacctaataacaaatcatgttaacaccaagggatgcattacctctgcagcttataaacattatgaagcatacaggcatgcacaagtgaaaaatgaaaagactgatttactttacctatagtaatgagttctataacattctgaccagacggtgtataactacattagctgagagaatgaaccattctttgaaaaagttagcataccatacttatgtaaaaatgaaagttactacttttttctttattttcaattaaagagggacccttattaaaaatatttttattaacctgttagtcttatcttggcagctataaaatattatatagttatatttggtacatgtgagcatatgtgtacatatacaaccattaagccataatataagtagtaaatattagttttaatgaagtgtttatgaattgggacaagaatgtctggaaatatcaagctaaatataataataatagttacataataggtatatgttacatcaggggcaatttaggttcctattttgaactactgaaataataaaactcctgtggacacagtaagcagaaaagtccacaagcccatagtaaaaagttgccatgtcctggaatgtagtaaattttctaatctattacatttcattccaatattatctgaaatgaaaaattgcttgagttgaccaagattgtgtagcagtgtgtgagtgattgcttgcttaaggacacctcccctctccatcttgtatgtctctgtgggcaatcctgcaggctcttagtgcatcttctctagtatttatcaaaacatgtcttgtgtgtgctttattctcttttcaaaactccacagaaatctctaacctttaccacttgctcaaataaaggacagtcaaaactaagcttaaaatggaaaagaaacctcctgagtttctagaatatataaaatcaaacagggaagaaaaacaagtgcttttctacacctaccactcatacagtggtgatgtctggtatttgcaaggaaagggagtaataagcgagttaattttctttggtaaatatagcgagaaaggctggagcaagagagctgtagtgattagcagggctccaagggaaagccccttgagctacttactgcctgctctcagccgaactcaatattgtactgagaattattataatcctaataagaaagatgcctcctgtgtagacacttgaagctctacacagacaattaaaatgcaacaataaacagcaattaagaaatcataaaagagaatgaaaattaagtaaatagcattattaaaataaatgcctttctaccatgtgatatcttaaatagaaaactgtaagttcttataaactaaattgtttcaggattaaaaacttgcagaaagcaagtttcataaaacatctacataattataaaaatcacaaattatatgcatataacatgaattacatcacagaattatatatcacaataatatcacaatatgccacgatgagttatatcaaaatgtgcatgcaatgtactacaattaagtgcctacagtctcttgtttaaaaaataattaataacctagcatttcaacaaaatatgcatacaatttaaatactgaaaagacacttagtgtagtgtatttaaatactgaaaagacacttagtgtagtgtatttaaatactgaaaagacacttaatgtaacagttcatactgtttcacaaaaacatgatttgacatagatatgtcaactgattgtaaaaacagcatggatcaaaatgctgcttaagaagcaaaattttattgaaagactaaaatattggagatataaattcaaattaaatgacaggtttttagcagaaggggaagaatatatacataagtgtccatatatttctatccaagttagtaactttaaataagtatttatctgtaaatagaaataatataaatcacatatgaaataatgtgtatataagtattcatctccaaaatgcttattaaccttaaacatttgtacctttattctcttatactataacatatgagtttttaaatagtttttttttatcagaaagaaatatcttactgaagtgtgaagacatttttaaaaagagcttcattaggaagtcttgggcctaattgttttttgttttataaattttaaatgactgctctgtgatgagcccatttcagttgaggctgtattatttttcctgtgggtaaaatgacatactgagctgatatggacatcacttctcccacttttgctattttaaaaatacagatatgctgcataaacatagcaaatagatttataaacatttagattcaagaaagaaagggaaattcctagatgtcagaccaaagagggaaatctaagttaagcataagcaaaagctcaagctaaactgagcaactggggtcatggggtggagggtgggagacaagtcttagttctaagatcagggctaaagtttggagttttaatgccctcactaggacttgacactaggatttggacccacagacggaaattgcagctgaactccctgaagcagggacactagaaatgctttcagacagtgaaatgggggctagaaaattcttcctgcaagcctacagaggcagctagaaaatttttctcttaggggctctgggtgggtaaaagttactaccttgtgtaggaccgaatccccaaacctgtgtgccacgtgggaatgggatacatttttattctccccttatgtgctggcattcttcaacaagtcaaggaaatgatattcccataggaaaaataatacagcctcaactgaaaatgatctcatcacaaagcaagtaaagtacacaaaaggaaaataactacaaaaggaaaccagtagccacaaaaatgaggatatttgtacacaaagaactagaaagggtagtctgaaataaatttgtattcataaaaatctgtgatcatattcttatcacataaatcataaaaatatgtttaaaatgtacaattataaaagcatgattagaagattgaagaataaacaaagaaggaatagaaaaaagtaatataaaatagacgctatattaaaattcaaaagtaaccaggtttggaaaagaaacatgtataatttacttccagaaatgaaaaaaatatgcagtcattgaaattaaaaattcaatgattgggttaaacaagagatgagaaactgcaggatagaaaatcagaaatataggcctgaaaaaattacctataaattgacatagggaagtaaataaatatgatgctaactgactcacagaattgtaaaattgaacagaagtttagcagaagttgccaaagaagagattagaagaagttgagggaaacaatattcaaaaaaataatgaaggagagaagaatgatcatgagttaaaaactattataaatcctcagtttgaggatgataaaaaataagtctacccctagtagaaaacctgtcaaccagcaagacaaagagaaaaatattaaaactgggggcaaatatctttattgtgagtgtttaccactcacagtccaacttcatggaaagaatattaaataatatatgtcctttagtaagaatattgaacccataagacagtttcactagattatagtccagaagaatcaatctataaaaagcagtagtatttctatatgtcagtgacaagcaaataaaaaatgtaataaaaatacttagaatagcaagaaaaacttcatgatacctaaaaataagtgtttgtaaaattgagataatttttaaaggttattgaagaacataaaattctaaatgaggagacagctgaggatcaccaagtaccagtgaaaatctgtgaaatttgaaatgtttaccatttctattaatagagttaattagtaccacaatttaggagggcaatatggtattatctagtatctttgaaggtgataaaaccctgtcaaccagcaattccacatccaaacatttaccccaaaaaactcttacaatgtatagagaaaaaccatctaaaatgtgctcaacgtaaatgtacttactatgatgaaaatgagaaaaataaatagcaaaaataaattgtagtgtttcctttaatctgataaaagaaacagttaaagtggttgaaatagatcttcatgtataaaccatgataaatttcagaaacttcaggtggaaaaaacaatgtcattatggtattatttatatcaagttgtaaaacataaaacaatgctacattgtttgtgaatacatatattataattaaaaaatttaaatacacttgtagggtaagtactaatttcagaatagtagttacctctagagaaacaggaaagggaataaaacagaagtgaaatgagattcatttgtatctaagtatcattgctttaaaaatatatctgaggcaaatataaaatataaatattttgttacctctaggttgcatgggtaatgcatgttatatgtgctttttgaatgtcttaatataatttctaatttaaaatttctttaattgaatgtaaaaaagaattccagatttaaaaagaggagaatgaaatttttaatacaatgtcaactacattattacattttacacataagattttctcttcaacaatgatgttaatgaatattatcatcattatatttcaaaatgtgaaagcagtgctagctcaagacactcaaatgtttataatatttttgcattgttaaaaatgttgaaatttctctcacgaattacaagaggcaagtcaatctcagatatatgacaagtcattgactataagtgctgtctgactctcagtatttgtttatttcaagtaccatatgctagaaattggctcttttgcagtttggtgtcatattatttatgcaaaatcagttggtatgtagaatctcacacataatataaattgacattgatctagttaggaacatgtgcttttatttttatcaaagtcttataatagaaagataaatagtgaagtagaagactagaaatcaaagtctgtattttcatcttgttttgctttgtttttattgcattttccattaagtccttacaggcccacgagactatgtgatctggccttggcttacctctccagaatgttcttgagtttcagtcactgtttttcagctttgcttaaatttcttgagtctcttagttgtttgtagcatctggaattttataagttctattcagatttcttgggatacctcatttctagccctattcctttgcttagccaggcatttttaatggctcggcttaacttcaactttctcaggaaagctgcccctgcatcctcaagtcatatcattctcatggcataatcacttttcaaacctttttcttttcttttatgatctcataatgagtaattctgttttatgtctatcttacctctggtgatgatatggaccctatatattttctttaccattgcacaataagaagataacacaatgactcatacaaaagaaagaaggaaggaagagaactaaaatctcgtgaagctttgacagtcatttagcctttccgattctgttttataatctatgaaatggtgttattgaatcttttctgcctctcagtaggtataattatcacactgaagccctgtacaagtataaagtataaccataaatacctactggattactttttgttgttgtttatattgcttttcccaagtagagataagtttctgttctttttccctgaaaggatttttatggtgtgttaacatttttattggttttggatttccctcttctttttcatttgtgtacaggaatggtcacttcattaacttgtagacttgattcctgggcatttttacaaatggacttcaatgtgtacatttaatcctgaatctaaattacagatgtagaatttttggcataaaaggttcatgcatgaatgaatttatctcttgcaacccctacagttcaaataatattatgttagtcaattttttacatggacagactctctccttgaccaaattttggaaagtcttctctgagtcctctttttgatgaggcctcatcgttgacccttgtcctcaaacctagcttggttaaagcaagaattctgctaagtcagtgtgttaagaacaccttacccttgatatctgatccctctggcctgtcttcaacaagaatcctgttaatttggtttagcaagaatcccccctacctacccctgatgtctcctcttaatgattgttcgcccctgatccttgctcgtggctataaatctctacccttttccttggcactgaatccctacttgttcatgttgtattgggaatggaggctagttctttactaaggttgctttttctctattgccatagtttctcactgaagcctattttcatcgttttaactactgtccagctctggttctctttcacaatattaaaagctgaacttgtgaaaattgagaactaatgtttatgtatttccttctccctccctaacccatcaactattatctagccttggaaaagtgtgttttaggagtaagtcctcaacaaatactgctaattaactaattatccttcttttgttaacttattttaatactaggatgcattagtctaaaggtcataacagaagaaaacctgtaattaactacaaactaccaaaaaaccaagcatgactgagaaattcctgaagcaattatcacacaaaaaaaataacttaaatgtcactggagctattcctggtaactttgtcagtagtactcccagctgactaacaatcacagttcaatatgtactgctgaagttgtacctagtttataaagcagtagcttctatgagaaagaatacaagaaaactacggtgactatttctccagagaaaaactgtactgaggaaactatagcaaaaagaaaattgatgtcaacacaatagtatctcacttcaagaaatcaaaaacaaaagaacttagtaaaatttttctaattcaactttgtttttaaagggaaaagagaactaaagaaaaaaaagacagccatgattttttgtagcgtaggccacaacattgagctatgttcaaaggaaatagatgtctaaagcacacatttcttcctaaaagaatgaaaattggttctttgggaacaaaaatatcatattgattttatgtaaaggcaaacattcacatggtgcatctgtacataaaatatatctggagtattaaagtttcatggtggggatgattatgaaaaaatgactatataggctccatagggacatgatgataaaaaatagattaagtagattgaaaacactagtctaaagtgaagtgatgtgttttaatatcataatatgtgagaatataaaagtatttacgtatggattatttacaatggaaaaatgactattatagttcatatttcattttattaatgtaattgattagaataatggtatagaaatagcaaaagcagaatatttggttttaagaaaatatggtgatataagggaatgaatattaatttctagagtggaagtctgtagcgttctagaaattaccgtgttttataggctgtagtgtgaaaattatcattaaatacgcaaattgaaaagaatcactaatggactctatacaaataaagtgttaaaatgaatttattggatcaataggagcttcccagtaggaatgctgagaggtttaatagattagactccattttgtttagattaacagttaaaacaactttaaaaatttttattaaattatgtttttgcaaccattgaagtatagataaacaaaaaaagaaaaaaattaattatatgttaataactttttaaaattcatcagtacaaataaattatagaatcataaaggaaaatagaaatctcatgatgattaaaataacattcagtctggaaggtacaaaacttttaccttcatcattcgatatttaggttcaattatattcccatctatgctttagggactgaattggatggtggtaataaggtataatatatggtctgtgccaatcttatggatggcaagaaaagaacaaaattatggttttactgtgtgtatttatttatttatttatttcaataaatgccctttagtagatatttttacatctggagacattctcacatctggaagaggacactgcaacagtagcctattttaatcttgtcatgaaaatcttgggatacatcttttttgctcaactccctggtttttctgtcttatttttttcttcggggcatagtggacactggtgatgaatttggtgtcagatccagaacatgttgtctgtacccctcttacagcagtgattttcttccaccttgtaatataattatctgaagtccgcctcatcagaaagtacatagggaaactatcgtgactctatttctccaagtagaaactgtgctaagggaactaaagcaaaaaagaaaattcctacttcctttgctataatcctcttgagggcatttttatattccctgtgatatctcatatgtcttgtatatagtagttcagctatgagttgatgaacgaataatataaagaataaagcaacgataagaaataatgagcagagcatttattaataatttgatattgataacagaggaagttaaattattcaaagagctcaaccataaagcagatggcttcactttcaagctgggaatcaaaaaactttaagtgctagaatattcatgtcaagaggatcttccaagaataagccaggaatgcaattaggggctgactcatggatgacaatggtcgatgagtcacaaagaaattttgaaaaaacaatgatgtccctggggacacatagaaagaattggaactagactgtcaagatcatatatattaacaagctaatagaaggcgggaaattttggtctctatgaaaatgtgcacaaaagtcccagaacactatacttctgtgtttgaactgtgctactctaaattatataaaatatactctataatgtagtaaagaaagatttctttatgccaatgtctcacattttatagacattttacctgctactgtcaacttaagttactcaagtatagttctgttgatttatctcctaatgaacaaccgctaatgacttaccaattcctaaggaatatctcttaggatggactttctgagggcagggccctggatctcaagtaccaagtgaagttctagcatacaggaagtattaaatacaggctgagtatcccttatccaaaatgcttgagaccagaaatgtttccgatttggtattttttcggattttggaatatttgcagaatacatactggctgatcattcctaatcagaaaatccaaaatctgaaatgctctagtgaacattccatttgagcatcatataggtgcccccaaagtttcaaattttgaaacatttaagattttggattttctgattagggatgctcaacctgcacatttgtcttgaaaaataaataatgaataaacctccaacttttaaaatgaattcttgttcccaatgtctttgctaacatcggtctctcattctatctatgtccacaagttgaatttttaaaccatgcttcaaggatcaggtcaaactccactcctgtcataaagcttccttaagccttatagcaaaaattagtgcttcctctatgttcccgtaattatttatttctcagatgcacttaccatattccaccttgcattatagttgattgtgagtatatctttttacccaactagatattggcctttaaagacagacttatttaaagacagaccttgacttatttatcttcatagtgcctagaattcctaccctaatgtgttgcttcaggttattaaataaaattgaatgtgaaattatttaatcatattttttcaaggtcattttactaggctaaaatggagctaaggaaaatgtagctaatgtctgcaaatttctaattgttgaacttagtctgaatctcagaatagtggcattataagctttcaaattagagtaaatgaaaagtagattagaccaagcgcataagaacacagtatacagaacagctgtactgtgtcctcaacgggataaactaaatcataattacagatatgtttcatctttcttgcctttatactcttttgaagatgctctcaacttcagtgctttggggatttatttgtcactgtaagtctgaaattagtttgattagttttgctgatatctatcatttcaaaatgtctgaaatctgccttaaaaagtaagctggcacaaatcttggggcagtgcttattaaggttcccacatagaagtggctgagtttgtaaatgagtcatagaaattcagtatcaaaaagttaatttaaaacaaattattctcttggatataaggaggactgctttgtttattcttaaatttttctccttacttcttcatgctatttttctcttctcttctgattttccttatatgttctcagattttatcatccctatcttctgctcaatctgggtttgtttaaagtgtttttattcagctcgtactatgcgtatagcactttgctatgcatgaaaaacatgactgccaagagatttatttgaacttaataaattttatgaagctaatgctcagtgctgtaccaggaaccatgttattttctcagactataaagttagtaagacagaatttctacctctgaatagattatggtagatagctagagagaacaatctttgagcaatacttttttgtggttgtgatagggtaatgtatacagggccacgaaaactacatggagagagaagttagttgtccaagggaattttttaaaaagcctcagtattgataataagggaattcaaggaagaggggaaatgtagagaaaatgcgtatgtagggaatattacaaatctgtttcctggaaagcaggatgccttcctttagaattattagttaagattaaccactctttaaattgagagattatatccttccctgtttttcattatatggtcagctttcactggcctgagtccacattttaagctcaactatatacaaataatttttcagtatactgagagtaggattaatgaaaccagtctggagagcagtcacagaatgagaatagatctttcccatagtatcactatgtgactaactgattgtactgatgtgttacagaaaacactgtaaaaagttaaccagaggaaaactttgctttctactttatctgatctttaccccagtttctctacctgtcaaattcctatgcttgcctcaaatgtacatatttttaatctgaaatgtgaaaagtatttataactggtgtaatatcaatgttctattatacatccatgcattaatgtctttaattttaccatgaaattaaatgaagtacctcaataacagaacagtgaactttaaatgaagtagctcaataacagaacagtgaacctaactggccccattttagtcaatctaatgcattcctgcacaggtatttatcatgacatttactctacactcaacctacatgaagatcaacatagtcacttttacgagagtagatttgcatccatccaataatctttctcaccagtgtaattagaaaggatacagcttaacacatagcttttgagcagatttttaaaaatatcattatacgttaaatatagttgagagggtaaaatgaagaatgtacagttaatattttccttatacagacatggacgcagctcataatgttgaaggatacctctgttgctgatacatctctttatttgcaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaagtaagcaagcaccatttggttctgtttgctgccccagcagccttctttgttgctttcatcgttgttcttttgtatgaacagtttctgatagtgaacttctacataaagttacaggaagaagtaatggaattttcttcaaatgctgttgtgtatttttgctcaaagcctttgaggttgtatttgtaatattgtgtagactggaatttcttagaataggtagacatagtctttttagtgtccatgattactctatgaaacaataatgcaattaaggtttcaactccaagggtgcatgatttaagagagaaaacactacattgtgatatgaattatattttccattactagtatgttcgtatgcaagttgagaaaaactctgtatcatctgtatacataatacatattatccaccaacgctttagttactatttgatgttgcctaggctctttcattattaaaaggggacattaaatataggcaataccttcattctgagttggtttgaaaaattattacttaaactatttaatagcaactgaaattttctttctttaacgtaaatgtgtttacctttctaacttcactgcctacactacccactgccttttcaaatctgtgcaaagagcatgttgtctccctatacagaaaagtgtcagaggaaaatgggaccttctgggaatttcacacagcctgtgtggctggacttaagagtgcagaatggtaggaaatgggctggagagagaaagaagtctagacgggggaatgagaatctagaacttatagggttgaatatactaagaatttgagatattttacttggagtgtcattgaagaaatttaagctaaagactgacattatcagagttgtgttttataaagactactatttagataaactatttcctaaacacttcttcctttcaactttaatcagtgaactaatcctgaacagagctataaaatattttctctgcctgcagtgcttttaagtcaagcctcatattatgaaatattatctatacgttatcaactgtattgctttcagagcagacttcaaagaatcaaccacagatggacatctagtctaacttcctcttttgtttataaagtcccaccccaccctccagactgccccactgatagatcaaagtttcatagccagccaaggggcagagctggtactcaagctttgatcatcagatgctagagacacagaatcccattcaactgtcttacaatgcctcaagggtgacgttagaaagggaagaaatgcaaggaatatattacttgttgtccagaaagtcaacaggttgtacctggtttctatttctcatttaactaagggaattgcagtgattccacagctttgggataagcagagtcaaatagtctatgaagaaattttaaaaaatatttcagccacatagagtcacccttagcattctgcttcccatcacccacaacatgaagcagctcatgcatgtctagtaggttcctggtagctggtaccctaagccctcagtaatcagtgttttgtcctgactaggtaggatgctttaaattagaggtgtagctgtaggcctgaccttggctgaagcataaagatgtaaaaacaaatcattatgcattcccagattcctcctttaaggttccttccatttctgggccagggatctaggctgtaggtccccacagcacttctgaccctatctgaaggaatacatacagtattgccaggtgttgtcatagcaccaaggctggtgggttcaaatatccttaagcctcaaagtagaaattttaaaaagtgggaggggtggaaatactgaatgaaacaccacctttcaggtacttgcatagtttctttctttttccctctgcattacaaatacatacgcaatactttttcaggttgttttttccaaaagcaacaataaactactagtggagtaaaaaatacggaactgaaagtccaactgtttgattaagtgtatgttataaccattgtatgactttgagtgaatttctatttttaagaaagtggtatttggaaccacaattttttaaaaagcataggttcaatgaaaacagattattatagaataccttggaaactcctagaaacatcaaggaaaaaaaataaacaatggaagcctatgtgagtacatataatatgtctaatgatattcataatgctcaggtttttttctaaatgtttgtggtttggttttttttgtttttaatttccaaaagtggacacgaccaggaacatgaaagagaaaagcagctgatagatattttttaaaaattaatgatgactgtgtgttttctctaagatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaagtaagtccacgcttgcttcccgctattctgctttaactgactgatcgtgagaatgggttttagttggtaattcttttaaagaaagacaaaatcaaatacacactgaattggattgccagaaccagctaaatcacattgagttgggcgtttcttccatgttgcacaagaccttaaagagccacggcatccttaatatgcaactttgtatagctgatgttctatgtaaactttttgaatgggcaaataaattaatgaagccgctagtgtattttcgtaaagcaaattataggtattggaagaaactgtgttgtgtttatgtgaaaagagctgttttctggagttgtctgtggtgggatacttactaaagtttttctcatcggtttctatttcatttcaaaactgatactcaggagatttacttttccttctacctgatatgaatgttaattggaaaagaaatgtattacataactaattaaatgcttgccatgaggcttatgtaaacaacatatttgctggagctcaggcagaaactaccctaaaagtgccagattggaagcacgtttgttttaaagcccacacatatgtaaaaacatacacagataaacaaatgtagcagcctcagaaatacaggcttatttttttctgttgtggattacttctatctagatagatatcctggggtttagaattttattttatcttgcctaatactttgttggaaacaaaatttggtgacttatttataaacgtgaatacttgcttgttctgtgaaagttaataccttctcagctgatagttaaaatacctgatcacaccagaaggtgtgatgggaaaatcccttcctaaattaatgttgtttaagcctagtttacacctaacaaaatatagcattatttatgaagaaatcataattgattaagcaaataaaagtatgtttatagtcagtggttttcttgcatgacatgtgagtattgaaatagaaaaacttagtatctcatatgctactcagtgaatgggaactggtggtgttggctggttgaaacacttttaacttatggccagtttcttatatttaacagaactctgaatgctattacaaaaaatgtgtaaatgtctaaaagacattttcaatgaacatgtattttaagagacagagtatgttgcataaaattcaatagctgtaaaataaaaatcgaattaaacttttatttgcaaggccctttacagcaagaagtcattttatcctattctatttaggaaactctggtattcccaaaagaacaaaacagcacataagacttgaatttctactgcttaaaattgccaaaaaaatataaaaatatactgtcaatttaaaaaaaaaacaactgagagctccaagaagagccttaggtcaaaattggatgaatttcagaggccttatttcttatatgatggcaacacttaattaaagtagcttataatagaaatattctttaccagattttccatcctttcttctttggtcatatgcatttttttttctgttggctgacaatcaaactgacagaaggaaagcaagcaaatggaatattcggtagaatcagaacaaagaatttggacatcccattagtagttgttggttcccgaagataacttcccttatcctggctgaaatatttttcttataacccacagtgaagctcttcatattcccctaccgatcattttcacatcaaaacactgttcttgcctgtactgccgtttccattcagtgaacaaaataacattaacagggtgtgcaaattgtttgaatacggaggacatttttaatgtaacgtggaagcccttggtggtttactgtcaggcatctcagtatgaatgaaacaatttgccttaataactgaaccatgtaaatttttgatactacaataatactgcaagctctcagaaattaccacagtacatcttaactgtcatgtcacatcacgtaaattatagtcatgatgacatgcttagcttggttgatttaatatcttgctaaggaagtggaaaattgtagggccttgttggtaaattcaataaagccacttttctaaatagttgaggctaaattctttaccagtaattgctgttcgaatcagaaccattgccagaatctgacagaaatagcgtatcaagatacaagtgcatctgcttaaatattgaattttatttacatccatgaccaggagtctatggtacataatccttcctctgcttttttagtgttatttcctaattggaaaaaattatgagatgctattagcttttcctaaatatttatatacagactttcaaacattttccaagttgcttggttataaggcttcttctaacagaagggcgatatgctgtgcatgttctcttataatggagatgccacatgctgttattctttttttaggagcctaatcccaaataataaaagtggctcacatgggacacatttttgctaacatggatgtctgcctggttgtaataaaactcaagaatactagccaatttagcaaaggagtgctttgtatcctgtgaaacatttttcacatttttactgttttggaataatgaagtataagtaagtgattataagtgtatgtgtggataatggatgaggcctaggaaaacttagcacgtttttatactttctatttttgaaattcccacagtctcagctaggagttgttcctccaattttttcccctatgtaccagtgaatatttggcacaactggcagaatcaagtgttaattttcccgcctcgttcttgatagtcaaagagaattaaatcaggcacccacagggctatcctaggtgcatttcattttcaaaatgcttggcaaatgttaatgcttggttttagggcatttgtttaagcaactaggcagcagtggaaagagctagaggacaaagaatcctgctggtttgctgcaggctacagctattcagaaacagtttgggaatttcagagttgggataatttactgccctagtaaactaagtgctactggaacattgcaacagtcatttgcttaaggttgccctagtggtctgaaatagttgaggcagcttccaaaagcaattctctttgcatctgtaaagttctgggagaagctagcttggcttgtctgctgttcctgcattaccattaaggtttgaaattctctctctgaatattattaaattaatcttatgtgatttgttctttaccaaaacctgcttattttctacagcattatgctatctttctgtttctagcttagagaagcctttaaatttgttcatatagttgccaagaatacctatagtctagtttaagatgcacattaggagagtctgctgacataatagcatctggcttctaaaagtaatctctggtaaactcttttgttttgttgttcttgcttgactttccattctacttcacggatctcaaattaaagctatagatttgaagaaggaaactgatatttgagatttgtaggacagggtagatctcatcatataaaagaagctcaacaaataccttgtaattgatgctacatgcttaacacaaacaaacaaaactctaagaaattgttttttttaggttgctcagaaatgcccattgagttggatttgtgggagttgaaagatgaattctgtcttgctttacaaaataattaaaaactcgctaacaaatatgttccactctcctttgagcagcatattttgtgacttctttgctccatagtcctcaaaattattcagaagtggagttcaaacccctcctcgccatccataacttcctcctatttaaatcttggattaaatgggttagttaagaagatcattatgcaagtgaagaatggtatggctataaaagtaaataggataaatcaactgtggttgattttttattccataaatcagatcccatcaagactaacttggcaatggagtagaaccaggaagaaggtttgctgcctagaataaactgaatgaatttgtaaaccaaaaataaaattctaagacccctgactgaacggacccccttcttggccaagggaatcccaaagaaacctaaagaaacctgaacatcatgggaagggacgattacacattcctcattataccctgctccctttggagtttagacaccacagaccaacagtaacattaaaacagagattttaaaactgactagacagacactttacagcaacaagataccaaattctaacctcactctggtatagcataacataacagatagcaggccctaaaagaaatcaaagtattttataccaaaatatatttatttgacatattctgaaatgaccttgcaaagctgtctcttggggaaatttgcattctatagagaatctccttcccttactaagtcttttctggagagtcagataccttttaaggtctggcaagagacattcaccatcagcctgctactttaccctactaccttgaggcttcatctacatgacaagaaccgtggcttccacaacccactctcttaactcaagctgacttcaactgttcaggcagaattttactctttcgaccaattgccagtcagaaaatctttgaatccatcaatgacttggaagcccccacctcgcttcaagatgtcctacttttctgggccgaaccaatgtgtaacttagtactggtgtatgtctttgcctgcaactttcgtctccctaaaatatataacgccaagctgtaacccagtcatctttggcacatattctcaggacctcctaaggctgtgtcacaggccatggtccttaaccttgccaaataaacctctaaattgattgagacctgtttctgatactttttggtttacaaattgttaaggataaatgagaaaataagtattaaaaaacaaaaaaaatcaaggactcatttatttcccatagctatgatagaatctgctgtgtaaaagtaacacaaatgcaggagctcaaggtcaaacatagaaacctctgtcttacatatccgtcataacattctcttgacgtttttcctaattaaatttataaagcattagttctaatgttaaaaattgttatataaaaagcattttaatattcacatgcatctgtctacagtgttttacattttgtttataattcgtcaactgaatgaatactagataggagaatgttccatttaataaaaactcttgagaaaaataaaatagcttacttaacagtaatttcaatgtgagttggtttgtgatgtggttggcaacaaaacttacgtaatctagggctacattggcaggaatttactggtcaggacaaaggaggtagtgtttatacagattctgcacaaaacgcatgtcacctaatattattattaaatattattaaatattattaatatttagcttacttgtgaatttctctttttatctttgttaatatacatgacccaagtcatcagctaataaaccaagaaatccaaattaggaagaaatagagccaggattacaatccagatgtgtctatagcccattccagttaagcattttttcaatcagttaagtttattagttcttgcaaggcattgatctttggaatagagatgctgaagcagcttattcaaaagaaagggaacgacaaagatatgaatttataaaaatacaaatgaatgagatgaataacaaatgtcaatagaggggacacaaatccaacaagttttttaaatggtttcaaagctctggcaagattaatcaagcaaaacgtgggtaaaacacaaataaacaattttagaaatgtaaaaatgggcataactgcaattacttcaaaaataaacaaataaggaagtatcagaaaataaacaaattaagagtattatgaaaatttacacacaataagaatacaatttagaaaaaggaatatccttctaggaaaatgcaacttaaaaaaactgactcaaagaaaaaaaatctataatgtcagataaacattaaagtaattgaatcagcagtcaaataaaccttccaatgaagttaactccaagcctattgatttgcaagtaatatcaatcaaaattcaaaaatttttaaaaatgcaaaattatacaaactttccagagaatagaacaactgggacgtactcctcacataattttatgtggcttgatataaaatcttgacaagaggactatgaagaagaaaacccctacccaaagtcactcatgaacgtagatgaaaatatcctaaataaaatattaacaacccaaatccatcagtttataaaaatagtcaggctaaattggccaagtggattttatcatccgtgtttgaggttactttaaaattagaaaaccagtttaagtaattgaccatattgactgattaaaagagaaaaaaatcaattatctcaatagacacagaaaaagaaatgggtaaaattaaacattcttcatgtctgaaaaattttgaaaactagaattggaaaagcactttaactgatgaaggctatctacataaaaatcaatagcaaatatcttatttaatataaaatgttcaaagtattgtttaagatcacaaacatgaaacaattctcactataacgactcccacttaacattgtgctagaagatgtggacagtgcagtagataggaaataaaatatatagggatcagaaaggaagaaataaaactcacttatagatgatatacttatctgcttgtaaaatcaagagaatctacagacaaattcttaatcagtgagtcaataaggagactatatgcaaaattaatatacaaaagtcaatcatgtttctttatatcaacaacacttttcaaaaaaaatttttaagaggccatgtataatagcaatacatataaatagtaccaaggattaaatttgtagggaaaagccaatggccaagaataatcaaaagaaattatagatggggtgcgatggctcacatatgtaatcccagcactttgggaggccaaggtaggtggatcacctgaggtcagaagttcgagaccaccctggccaacatggcaaaaccctgtctctactaaaaatacaaaaattagccaggtgtggtgacaaacgcctgcaatcccagctactcgggaggctgatgcaagagaattgcttggacccaggaggcagaggctgcagtgagccaagattgggtcactgcactccagcctggggcatagagcgagaccctctccaaaaatatatatatacacgtgtatatgtgtacacgtatatatatgtgtatatatatacgtgtacacatatacacgtgtatatatatatacgtgtacacatatacatgtgtatatatacatgtacacatatacatgtgtatatatatacgtgtacacatatacatgtgtatatatatacgtgtacacatatacatgtgtatatatatacgtgtacacatatacatgtgtgtatatatatacgtgtacacatatacatatacacgtatatgtgtacacatatacatatacacgtgtatgtgtacacatatacatgtgtatatacatgtacacatatacatatacgtgtatatgtgtacacatatacatatatgtatatatatacatgtacacatatacatgtatatatatgtgtatgtacacatatatatgtgtgtgtatatgcatatatgtatatatgtgagtgtgtgtatatatatatatttagaaattctaaaggaaagaagtggggctttttggaaagggattaggtcatgagggttctaatctccatgaatggaattaatgcccttatgaaaatcttatctgatataaagagttaggacttactttaaaagatataatgactaaggcaaaatgctatcagtgtgaaaataaaccaatagacctgaaaaaatagcccatagatatcacatacatagatgaatacttaacttttattgaaataggcattgcagatcaatgacaatgggatagaccctatacagtaaatggtctggtaccactgattatctagagaaaaaaaataaaatttctgcatccttactccacattatacataaaaataaactccccttgaaacaaatcataaattttcaaaaattatgctaaagacaaacctttataaagacaacacattgagatttctgctcctgaccataattgaataatagtatctagatttccttatctaccttaaacaacaacaaagcctgagggggaaaaaatgtggaacaacagtttttagacactcttccacagatagcataaaactgtgatctctgaaaaagagaaacaaatggggtgaggtttacaattgccccaagattattgcctggggacagtctccagggtgaagtgcattggtatattgagaaaaaagccaaacacagcctggccttgccaaattgaaagacagaggttagggttcatggaggccaaggcagctagcatttgtgaggcagcatacaagggaagaggaacctgacctgcacagagagagagacgaggagagagctgcagctatctgcaaagagaaaccggagtactgagttgcaaatatgtgaaagaaaactacctaaggctaatgaaagaatcactaaaaagtagtaagagaaacaattcctgagctgatacagggctgctaatagtttattttcctaacacccaaagtggaatgtcttcataagagggactaaattagctccaaactacaagctactctaggttcaccccaacaaatcttgaaaacagccttaaaagaagtcaacttattccaaataaattaactgcatgccagaacaaagtccaatactatttaattacaacaaaatccagcactcaacaatgtaaaattcatgatgtttggcatcaaatcaaaaactaccaggtacataaacaagcagagcatataagccactaccaggaggaaaatcaatcaatggaaacagaaccccaaatggcaagaaaatcatgtcaagatatatcagaatcaaattattaaaaagacagataactggaaaattgtaaaagcaatcagaaaaaaactaacatggccaggcgcggtggctcatgcctgtaatcccagcactttgggaggccaaggcaggtggatcacgaggtcaggagttcaagaccagcctggccaatatggtgaaaccccatctctactaaaaatacaaaaattagctgggcatggtggtgcacacctgtagtcccagctgctcaggaggctgaggcaggagaatcacttgaacctgggaggcgatggtttcagtgagccgagatcataccactgcactccagcctaagcaacagagcgagagtctgtctcaaaaaaaaaaaaaaaaaaaaaagaaaagaaaagaaaacacaacaggtgcagaggaacaaagataaggaagaatagtttcttgtcagaccctatatgctatggtccaaatgttggtgtccccctaaaacttatatgctggaacctaatgcctaatgtgatagtatttagaggtggggcttttgggggagtgattaagtcatgagggctctaatctccatgaatgggattaacatccttacaaaagaggttgaggatgctgccttgccctttcctttacgtgaaggggcagcaaggaggtaccaccttggaagcagagagcaagccctcaccacacatcaaatctgctgatgcctggatcttggatttcctagtctccagcactgtgagcagtatatttttaatgcttaaaaactacctagtccctgttattttgttgtagcagcctgaatgcatcagtacactttgcaagccagaatacaatacagagatatgttaaagtattaggaaaaaacaacgcaagcaatcaaatgaacaaaacaaatactatcagtctataattctttaccaggcaaaaatgtcttccaaaactgaagaaaaaacaaagattgtttcagagaaatagaagttgaaagaatgtgtcacagactgatgtacacaagaagaaatgtagaaagttcttcaggcaaaagaaaaatgttaccagatggaaatttactcctacaaatagaaattaagtgtatcaaacaggtgaatagcaatgctttgtcactagtgctagctgtcacaagacctctagccagtcatgttttcagctgtagggcctaacaccatggttaaggaatggttacctaaatacacaaacttaaagtagaacttcaaatacttcctgtataaaattttccctctgaagttttaaaaagaaagactgggttgtaagaagagtataaaaaaggcttgcttctccagctctcatttctcatttcaaacttaaagaaagaaaaccagcaccaatttgaaagtgtttcaataaactctcaatgtaaaacttcacgttgttttctgtagcttttcagtaacttcttacactcatgttctatgtgcggctcagtggggaactatctgtatccagtggattgttggttctgacacactagcctacgtgcatatggggcaacccccaacatgctggcccctgccacttgcaatagatcagacccaccccttgtggttgagtgaggcagtattatgtcaattctaaacctggcattttgtttactgttgttgagtgttgttggtagtgggagaagaaaataggtcacagacagtgtgaagacacaaggagaagacagccatctacaagctaaggagagagggctgcaacagcttaattccttgtagtgttcataaagaaccaatcctgctgacagcttgatctcacatagcaaaataatacatgactttttttcctccttgatttccatgagaattgggtgaaagctattactcatataagcggatgacctgattctctcatttttgtggttacctttgattagtgttttggtctttatgcgtttcacagacctgattcaaatgctggatctctgctttattagctttgtgatcttggacatatcccttaatctagttgagccagattctcattatctgcaaaatgaggcttctagcacccctcagaattgtacaaagctctcgaaaatgtccttagcacacagaagctgtccgataaatgccaattgctttatgaatttctgtagttgtatgctgcagtaatttattttggagatcttccttatatcagtaaaagacgtttgttaaaaaacactttgtcacctgtctgacatagtatctggtggtagtaaggataagacatcattaaaaataaaaattgacaatcagagagagttaattttagcaagtacgtagattatatgcctttaatggcagctttgcagcaaagtgcaaaacataaataaatcagttaaccagatttgtgaaatacccgcagagtgttttagactttattttgaaggtgccaaattagagctaacatgcatcgcttcatgtcttcccaagaaaattacatgacaaatatctatctctgcttcactgacaacctggcagtgaaagggatttgaggtttgtgcccatcagtaactaattagagaagtaaatgttataactagtcagtattctgtggctacaatgtggcaagttaaaataatatccttaaggtgggcgctaacgcaatatgactggtatccttatgaaaaaaaaaaaaaaggacaatttggagataaacacaccgacagggtaaacaccatgtgaacatgatgatggccattcacaagcaaaggagagaggcctggaacagattcctcttagccctcaaagggaactaaccctgccgataccttgatttcagacttgtagcctctagaactgtgaaacaatacatttctgttgtataagccacccagtctatggtattttattatggcagccctagcaaaccaatacaaatcataaaacatcaattatttttaaaatctcataattttcattcttgttatatatatataaaacaaataaaaggtgactctctctaatgtataaagaagttaaagaaattgataacagaaaggccagcagtccaacagaaatgaatgagcagtttatagagaaggaaatttaaatggctcttaaatgtatgaaacggtactcaacccgactcatagtatgctaactacactgagaaatcattgtcttctaacatataggaaagtcaaccaaatgaataacacatgccattcctgtggcttcttcaggaacaaaggtcctcctaaattggtagtgtgaatatacattgatgcaatccaaaaaaaaaatccaaagttatagctgggcagggtggctcatgcctgtaatcccagcactttgggaggctgaggcagatggatcacgacgtcaggagatggagaccatcctggttaacatggtgaaaccccgtctctactaaaaaaaatacaaaaaattagctggacctagtggcacacgcctgtagtcccagctacttgagaggctgaggcaggagaatcgcttgaatccaggaggcagaggttgcagtgagcagagatcatgccactacactccagcctgggtgacagagcaagggattccatctcaaaaaaaaaagaaaaaagaaaaaaaaatccaaagttataaatgcacagtcttacatacttctcttctgggaatttattctgtaagtatatatatatatatacacacacacacacacacacacacacacacacacacacacgtgtgtgaaatgacatatatgcaaagtgattcattccagaaatgtttgtaattgtcaccacaaagctgccaatcactgagagactgattaaatgagttttggtacactcgtgccatcaaacactataaaattattaaaaaaggaaggaagatttttgtataataatatggaatgatccaaggtgtattttaaataaattaaacttaggaggccaggtgcactggctcacgcctgtaatcccaacacttttggtggttgagacaggcagatcactggagaccaggagttcaagaccagcctggccaacatggtgaaaccccactctactaaaaatacaaaaattagcgggtgtggtggtgtgtgcatgtagtccccactaccagggaggctgaggcatgagaatcacctgaactccggaggcggagattgcagtgagctgaaattgtgccactgcactccagcctgggtgacagactgagactccatctcaaaaaaaaaagaaaggaaaagaaaaaaaggaagggaagggaagggaaaggaaaggaaaggaggaaggaagggagggagggagggaggaaggaaggaaggaaggaaggaaggaaggaaggaaggaaggaaggaaggaaggaaggaaattaaacctaggaacaaagtagtttatctatctaatctatatgtatgactactatttgtcttttaaagtggagaaacgaatatgtccttgtaattataaggtgacttagctatttagagtcacatctagcatttgcatcaaggtgagtttgtctcaaaagctctgttctagtgccccactcaagaacagatattgtcaaatttgtaaaagatattttaactggaatagacttgatttttattgctgatttaatctattacaaactattgcttttctattctaagctgttgtaaaaattattgctttaatatgatcacttaataagcattaaatgccccaatcctatctgctaaaaattgtttggcatgtttaattgatcacaaggatttgaatagcactcttatcttttcaagtatcttcaagaaattcttattttcagcagggcatgttgaggaaacataaagcttacattttttattcctgatgtcttctcatcacttccaacagtagccactgagtcaaagcagttgctctctttccttactttttctaaagctctccctctatattagctgtgtctgagattgcaggcagttaaaatccaacatttggcacactgaaaaaggggctatgtgatagggcctccaactgaaatgtgatgaattattaaacaggtagtttgttgggtgattgaaaattacctgtgaaagagtgcttatctccttgaggcacatcgaaagctgacggaattgagccaattagactgactgtctcttcaatgagttgtgacctatcaatggtaatagcttattatgatgataaatgaacccatctctcaaactgaagcctgagtacacacttcagcagttgccttgaatcatgaggccattgcctctcaacttcagatcgacagcagtgacagccacaggagcagagagcatgcatgactagacacagatgattgttttactcagatgaatatatttacagctatttccaaagaaacgggcccttcttttgcattgtgtattcgtatctgaaatagttaccatatgacgtttccttcattaggaagagaacccctccctggctgtagcattctgaaataactggattttgaaggtcttttttttttcttcactttttgtttattgtttacaatgttttaatttctcattcttgtgagtaataactcaactcctggttaagtaaaatttcagaataaaaatattgttttatagtaaagatgcttgtaatatcaaaacaagtatgtttttaaaaaattaatttcatcctattacatttcacattttatatttgatgtgggttggaggagccccttagagattcttttttctttgtagagaagttttgtagagatcaatagtgtaagaatcatacaagtgtaaatagttttgtttccttttaatttttcaaaatatttgaaaattctttaagtagttactgaaatttggtaagttccatgtgctgctatattgatacattttgttttagaagaattaggagcaaaagggttatttttataatgaaatacaatcttccagttcctaataagtattagacacctgttagctgccaacttcccaaaaatacccctgagaaaaaaaaaaacctgttggtcaagaaagttcacgaagttattacagtaaacaagaacatcaccttgatattcttagtaatgtctcagaaggtgagggtcaggggaagatatttacaggctttagggaaaaggctggttgatttcaaggcaaatcttgagtgagagggaactggttgggattctgcagggtttattatataatagttttggatttgtcaccagagtgaacaaacattgaagaacatgttatgagtctataaggaagttagcttagatggatcacagagcagacaaggttttcttggagattgctcacagcattcttaaaatagggggtggacatttttcttactcccagcattatttagcacaggaaaggaaattgtgttagcgttagaagaaattgtgtttgctttagttcttacagacaatatatttacttaatcttctgtgacactgtttcttaatgtataaaatgaaaataatatgaatacctactttatagtgttattttgagggttaaatgagttaacacatatgcagtactcaagatggtgtctgaaaatgataagcatttggtattagctattattattaactccaactgggcttaatttgaggtcaggcattattttgttgaaattttagaaagactcccctcacacataaacagacagaaagagagagaggaagaaagaagaaaagagagagatagagagaggcagaaagagaaaaagaaagaaagagagaaagaaaaggaagagaaagaaagaaagagaaagaaagagaaagaaaggaggaaggaaagaagagagggagaaagaatggaagaaagaaagaaagaagaaagaaagaaggaaggaagagagggagaaagaaagagaaagagaaggaaagaaagaaaaaggaaggaaggaaggaaaagggagggagggagggaaggaaggagggagggaggaaggaaggaagaggaagcagggagggcaaggaaaggaaaacaatggaaagaataaagaaataaatgcagcaggaaaggaaaaagaataggaagaatttgctcatatctgtctaatttttagggtattttgatatacaaagtaactgactgtcaggacctgtcttagagatgatctggtaggacagtaaatggcttttctttccagttttcatctgggactgggtttgaagtgatcatcagcctcagtgttctggaaataagtcatttataatgaaatggaactggaaataacccacagacaaaaagctttgcaagccattgaagttcccctaggccatttactgccttaagctcgtttttactcatactgcaggaaaaaaaagagtgagtagggaggtggtgttcttatatcacataattttaaattaagatgtgatggttttatataaaagcaaaaatgctttattttgctttttttgttcaagacaagtacagggatgaaatgtaaatatgttaatatctaatcttaagtctgctcttgatccgaaactcttttgaaactttacctagaaaatgatagagcaatttaatgtgtctcacaatctagcagagatttggagggtgatggatagaataagggcttaacacaagaaataatttctgttgtacaaagctcatgagcttcatgcatggtgaaagatatttaggctaaagaaaatgttaactatgcagggaatgaaactcgtgacagcttgatcccataaaactcagcaaggatgaggtttgactctgcatccctgatttatatagtacagtatgtttatttaaaggagataagccaggttaaggggttcagcaaaactgttaaattaactcctttaaaaatctagttattgctatgaaagtctctcaagtgcggtgctcaggcttttttgcatcagtcatctggagtctttatttaaaatgtttattattggccgggcgcggtggctcacgcctgtaatcccagcactttgggaggctgaggcgggcggataacgaggtcaggagatcgagaccatcctggctaacacgatgaaatcccatctctactaaatatacataaaaattagccaggcagggtagcgggcacctgtaatcccagctactcgggaggctgaggcaggagaatgacgtgaagccgggaggtggagcttgcagtgagccgtgatcgcgccactgcactccagcccgggcgacagagcgagactccatctcaaaaaaaaaaaaaaaaaaaaaatttttactattgacccttactctggattcacttatccagaagatctggggaaatctacgtttttaatcagctccccaagtgattatttacccataagaatttggggggcactcttttatgactacttttttaaattactgatgattaattatctgcagatagttccctagactttgactttccaaggctttaaaaaaacaaacaaacaaaaaaacctgcagtatgcttttagtctgaattcagggattgactttcttatccaatagtctatcctgtacaagggaaccctaaaataacctcgttagccaccaccaaagactatgtaaatacaaatttatttatcaatctcattagaaaccgaaccacgcatgtgcacgcacacacacacacacacaccacaccaaccacacatttacattggaataaaatgaatcttagaaagcagctatttttaaagaaacaggaagtctaacatgtactgccattaatttggaatgggagagaaaggagacttggcagaaccagaatattgcgtgaggattgaagatagcttcagattctagaagagtttctagctctttctgaatatgtgttaacagtttcgctgtttgagctctgctacccactagccagttataaacacaggtaagacccttaacttcacagggcctgttgggaagaggttataattttttagcaacagaacctgtttttcaaacaaaatcctaattagaacacccaaaaacaaacaaaataaaggattcaaatgggtgacatggccagtcctggttacagtatgagacagatgccggttacggtgggcaacagaacagatgctggctacagtggtcgacagagttcattttagttcaagcagaaggtagggctggtgcttgttacagtggccagtaggcctggtttctggttatagcacatggcagagttaggagctctacctacattatgtccccacggcctcatctgtggtttccccataagaaaactaccttttgggaaaacatgatacaaacagatcaggtgaattagaaggtctcctgcagatttaaaattttatgaatataatgccaaatataatcttacactcagttgactactaataataaataaccctacaaaatatggtaaagtgactccatgacaacaattgaaaagaaaataattgcactcagctgagctattgtccatatctagatgcactgatgatacacaaacccagccacagaaaatgtggcatgtgtcagagcaaagcaactagaatgattcaagacactgaacagccagtgttcaagctacgtaatttcttacctatattacaggaaaaaaccatctaactctttttctacctccaacctccctcctctgaaatgttattcacatacctggtggagaagaatctttataaaactcaaatttgattaccttagtcctctgcttaaaatttcagtgtctttcaatgaaagctcagagaccattctggacttataactcccttgcagctcagaagggacccgtggtccagtaattaaaatgcccgtggtaagtgttcaatgctctctcatgcttttcttctcacaatgtcccttcagtacgggatttctttctaccattttcctgagtaattaccttctagtcatcattcaaaaagcatttaagcattgaattctataggaaatgtttctaatcaccctatcccccagctctggctgagttaggccttctctgcacaattcccatgaaagcacctaccacccagcaggcagaaatatccctctttgactttctcactaaactgcaaattcctggtgagtgacaactggattctattcttcttctaacctctagaacctagcagattgctttggagaccttaggaacttaataattctttgttgagtgaataaagggatgctttttgtggacagcagttatttctgtttacacaaaagataagagaaaatacaggtaaaattatcctaaattttaaaaaatttgaaacttacaaaaagtgttggatttaagttcctttgtctgtctggatttccgaaatatttttaaaagattttttctgggatcatttaaggcctcatctgttcagaaccaaggggaggaccgaaatagtatgccaaattcttttccagccctcaaattttatgagcctgagttgcattgtgtgggtaaaagtcttgtgctctgtggatcaggaggaagttagatgttttggatatttacatagaaacaaagaatttgaagactggaaagaacttgagcaggactctattaaatgtgttttgtgtgagatggttttcaccctgtgttcttgtggttcctccatgctaggggcaggaggtaggatggagcagatagggagtctcttttcctcttaaaccggatgttttttttaaaatcagttttatatgttgagagtccatggaatggaatgtggaaactgagaccctgaaagattaagtcacttgaacaaagatatacagcttctccagagaccaggcagacactaggtttatgatttcctgacttccactgcagatctcttaccatttttctatgagagtcataaaaaaagaatcagctatttactttctagtcaaggtgggttaaaatcaagccacttgttttcaaacatcgatttcgggttcatgccatcaaattaaaaaattcacttaactgagtttaatttgctttcacttaggaagcagctgcctttcaagataataaaataaacagatacaataatatttggtcagctgtggcttttaatttaaatgtttgatttaatgttgtttagtttgctggattccaaaatattctctgcaagagaagcatacacattctaaagcatttcaaatgtttattatgatgtcctagaggtggctgtctttctgttgctgtgcataccctgagcagacttgacattgctttggaagcacatattttctgatagacatattactctcataatctaaaatttttcagaagtgacaaaagtggggttgaccattttcttcttcgctgtctccatgattttgctttttccaagatgtcatgtagttagaatcatacaatgtgttgtcttttcaggttggcttttttcacttagcaatatgcctgtaaggttccgccatgtcttttcttgccttgataattcatttctttttagctctgaatactattttgttgtctggatataaccacagttgaattatccatttacctcctgaaaaacatcctgcttgctaccatgttctggcaatatgaatcaagctgctataaacacttatgtgataagtcttgtgtggatataaatattcaacttatttgggtaaataccaaagagtgcaattactggatcatatggtcagagcatgctagttttgtaataaactgccaaactatcttccaatatggttgtataattttgcattctcaccagcaatgaacaagagttcctgtttctccacattctcaccagcatttcatattgtcaatgttttagacatcagctattctaatagatatgtagtggtatatcgttgttttaatttgaaattctctaatgatgtaagatgatgagcatgttttcatgtgcttattttccatctgtatataagctttgctgaggtatctgtttagattttttccaatttttaaatttattttcttgttgttgagatttaagagttctttgtatgttttggaccatatcaggtatatcttttgcaaatattttcttgcaaatggtagtttctcttattctcttcacagtgtctttcacagagaagatgatttttaattttaataaaatctaaaatgaatttttatttcatggatcttgactttagtgttatatataaagagttactgcaaactcagggttatttagattttcttctatgttatcttccaagagtcatagttttgcattttatatgatccattttgaggtctatgatccattttgtgttaatttttgtgagggtctatatctgcatttatgtattttttcacaagttatctcagtcaattttctgttgctataacagaatacctgagactaggtaatttataaaggagagagttctatttagcttgtgatcctgggagcttgactaggagatccaagttaggacaggtgcatttggtcaagttctggtgagagtcttgtgctgcatcttaacatggtggagaagtggaagaaaaagtgggcatgtgcaaaatgaccaaacacaagagggagccttcctttttaacaacccaccctcgaggtagctaatccagtcctacaagagcaagaactcactctaagaaaggtattaattcctttttaaaaacctaatcacctctccaaggcaccacctctcaacatcaccccattaggaaccaaacctcactatggattttgattgtgacaaaccatattctaaccataacacaaatgatgtccagtttttctagtgccatttgttgaaaacactttcctttcttcattgaattccctttgctcctttgtgaaagatcagatggccatattcatgcgggtgtatttctgggctggctattctgttccattgatctaagtgacttttttctgaccagtactatattgtcttgataactatagttttatactaagtcttgaagttgggtagtgttagctttacaagtttgttcaatattatttaatgatgtgttggctgttcttggtctttcctctccatataaattttagaatcagtgtgttgatatccaaaaaataacttgctgggattttgactgggattaccttgaatctacacaaattgggaagaactgacatcctaccttgagtcttcctatttatggacatggaatacctctccatttatttaatttttctttgatttctttcactggagttttatagttttcctcatatagattttgtacataatttgttagatttatattgaagtgttttgtggagcatgctagtataaatggtcttgtgtttttaacttcacattccaattttctttgctaatatataggaaagcaattgacttttataccacctttttcttcagacagatggaatcaagtgacttagaaattggctttgttgctctgcctgagtatcttgaaaattctcatcttccttctgagaaccataacctacatatctcaaggttatagataaaatgctacctacaaaatccttgtaatgcttacagtctaaaagactaaataaggcctcaagagattattcaaaatcagagttgttgattcccagtagagtcataaagggctatgttatgttagctgcaattctaatcctatatcaaagcttctgacttccactcccccatatctaaggaggtttccctcaacagttgaaaaataactgcagatactgctttgccatcccatgccacaaaaatgcatttctgaaggatgctgcagagagatatatatttcttaagcccagctcatatctatttctcaaggctgtgtgatatcatagaatgaatgatggagtcaaataaataaatatttatttatttatttatcagtcaaataaatctgatttaattttttagaacttaacatttagtagctgtgagatcttacagagatttcttcaccttgtatcctttgtcactttatctataaaatggagagtgtaaatactacttcttagagttatcatgattctttaatctaataactcatgagacactggatatgtaataggaactgaataattcttaacccccttgctttcccttgacatttccagaaaataaaacttgattgagtatctaagattatataacagatcccactagactaagtgaatctgagggaagatgtatttgtcacttttcttctcttctttggtttttaaaaagtatcattagaaatagaatcagtaactataaacaaatttctgtgtactgatccagtattaacagagaaaataatggttgactgtgccttactgtgcaaggcaaaaatgagctcaagatattatcaaagtcatgaatcagaaagagaatttcgttttacaaatgatggatagccacaaaacaactaggacatacaatctctgattacacaactgcagtctatagctacattctgcagattaaacaccacagtagagatggaaactttattgtttatattttatgaaaactgttctcttttgtttttatgtcagtttgagagtagaagaatatccttgagggcaaaacatgcctttcatacattagagctgcctagagcatagtctggcacattatataaatattaaataattcctataattaaactgatgttctttggaatgaggatggagacacatagttatctgaattgccttaagctagttttgcaataagtagatttttactattctagaatatgtaatgaatgaatcatgctatgttacaagtaagtattaattaatggttgaagtacaaaaacatcttccttgaattatatgataatctacatcacagtgaaaggaatttatcatgacaaatgctagtcaatgttgaatcacagagggctatatgagatccattttcattcttaaagaaaattattatatctttttattaatatggtggatatttactcagtaaataataaagaaaactaatatgaagtgcaatttgtaatattctatttatgatgcatgatttttgttgcacaattagaaaatacttaagttcttgagaatagttggaaagggttgtaatgatcagaaacacatattatacctaaacatgtattaagaccttgttttaaaaattagatcttggagcaagaaggtaagctgtatcattacgttcttagaatacagggttgggcgtgggggctcatgcctgtaatcccagcattttgggaggctgaggcgggtggatcacgaggtcaggagatcaagaccatcctggccaacatgacgaaaccctgtctgtactaaaaatacaaaaattacctgggtatggtggcgtgtgcctgtaatcccagctacttgggaggctgaggcaggagaatcgcttgaacccaggaggcggaggttgcagtgagctgagatcgtgcctctgcactccagcctggtgacagagcgagactccatctcaaaaaaaaaataataataataataagggtaaatacaaggagtgtgttttgaatacaaaatatctatttttagaatctcaaacccatgagttactttcttccatatataagtcccaacatgttttctataatcagtctatgtctattagatgtgtaattatattaattatgtaaatgcacatgaataccaaattatttggttaatcttcgaatttcttttagcaattatatactctcctccaggttagattgagctttcccttcaactcagagaaatcagtgtcaacaggctaccttctgtaagactaccagagagctatgcattactctgtacaaaggatatttctcctataaatagtgctttcaatagagaaaatctgttatcatgttgtcagtaaattcaaatattttctcttttggaatactctgttcctattaaaacaagagctgtttccttctttgaaacaagttatttatatttatgtggttaagatatcctatcttaaaccataagacctttttgaatacttcacatacagaaaaatgaaaaaaattaaacaaatatcagagttgctgggaaccccaggatataatctactgtggatagtcattcatagacaaagacacctcctatttataggcttgggacagttcagcttctccaacttgaagagagttttgaagatcaaatacaaatgggtcttgtgaagtttcaaaaaatgtttctcaaagtcctttgagaaaaataaacttgggcctgtagccaatagtttgtattccaggcttttaaaaaaaattcaaatacagaaacatcagattttcattgccataggggtcatgacatcttttaacataagtgcagaaactatctgtaatgaatcaaaacttaaatcagatgacattaagaccagctttgctattaccacagatggcatcacaattaacttttaatatatcaaaaatgtgagtgtactcatatattatcagtcatttgatcatgatattccaacattaacatctcagtgtattgtgaaaatgattcatttgtacaatatttttcttcttctagacttttaatttcttgaaggaaggaacgcattttactcatcttgtagtgaccctccctgtacatgttgcctgagacataataactattcaaaaatgtttacagtattcaatgaaattatataaatcttggtttaaaaagcttgatatacaatgaaacatacttgggcaaattataaagctgttcctgagaatgagctaatacatatttagttgttaaaattctgaggggaaaatgtaaattagatgtgaactacctctacaatataagatagcagtaggctgtaagttaaaataatcatttttctcatttttcagtaacattcattaaatgcctgatacaattctgtactttctgaaaattgactataataaagaaatcctggccattataaaattgtcatccactcataggtagaataaatgagagaattatggtgatctaaatatagaaagcatttaaattagagaacagctgaaattgtgcttctaaaacatttcagtgttgttcattttctatatgttatattgaaaaaagtaatatggaaatgtaatgttttcatttgcagatgcttaaatttagatacatgtttaatactgtaatcattttgatcaaacagcagctattatttattattcaatatttatatgtaaaacctgaaactttcatctaccttaatgatggtattgtgataaaagtacccatgtatcaccaagatttgccaattctttttattccttaaagaatatctgacaatttgctggtttgtataagtttgagttaagacaccgtaataatgtcctgcagtatatatgtcaaaatacatgggtcaaaaagacactctaaaatagcagtctccaagaacccaggaagtatgtgatccataggagtgtacatattttattttctttaaaaaataagacagacacttctcaaaagaagacatttatgcagccaaaaaacacatgaaaaaatgctcaccatcactggccatcagagaaatgcaaatcaaaaccacaatgagataccatctcacaccaattagaatggcagtcattaaaaagtcaggaaacaacagatgctggagaggatgtggagaaataggaacacttttacactgttggtgggactgtaaactagtttaaccattgtggaagtcagtgtggtgattcctcagggatctagaacttgaaataccatttgacccagccatcccattactgggtatgtacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaacaaacaccacatgttctcactcataggtgggaattgaacaatgagaacacatggacacaggaaggggaacatcacactctggggactgttgtggggtgggggggaggggggagagatagcattaggagatgctaaatgacgagttaatgggtgcagcacaccagcatggcacatgtatacatatgtaactaactggcacatggtgcacatgtaccctaaaacttaaagtataataataataaaataaaaataaaataaaataagaccattaaaaaaaagttcatcgtatggattgacactgggctgctccctggtggagtaccagctcaagatgttttgaggaaaaaatttgcatttaccaagtgggaggatttatagtggtgatttcacttgttcattgatttagacatatgaaatattatattttttgcacaactaagttggctttcagattatatgaccatatttttaactaaatgaagctttgctgaataaatacatgacttaatatattccttcaaaaaacatatagtgaaataatattaactacacaaagataagcaatgagcaaaaaaacactagtgcttaccactgctcttggtaagagctttccttcaggcacaaaatgagataaaagtaatgacaaggtaaaactggatgaaaattggtcaacaagtgaggaattaactgccttgcaaaagcagtttttattatacagaaaccattttgaaagcagttattcagaaagtttctatcagtatatgatttgtagctcaaattattgttggtctatcaatcacaaatactattttctgcataatatagctagaaaatataattatctaacttatttttaaagtcttctaaacatgaagtttcagtgagctttgaagctttttgttaaatatgttaaaatgtcatactttccaaatagtttccaattataaccaattagcatcagaaaatttattagccaaatttcaccaagaacctaatttgtgagagaattgaaaaatgagtaccataatttagtatgctcagccactgatgtaatgcttataatgggacctgtgtattttttgtctgtgctgtatctcttttcagctgtgaaaactattattactaagtattaaaacaaactgagggcaaggcacggtggctcatgcccgtattcccagcactgtgggaggccgaggagggtggatcacttcagatcaggagttcaagaccagccttgccaacgcggtgaaaccctgtctctactaaaaatacaaaaattagccgggcatggtggcacatgcctgtaatcccagctactcgtgaggctgaggcaggagaatcgcttgaacctgggagacaagaggttgcagtgagccaagatcacaccactgcactccagcctgggagacagagcaagactccatctcaaaaaaaaaataaaaattaaaaaaaaagcctgaacctagaaacggacctacaaatgtcaatacttagtaatatttttaattattaagccaagatttccaaaaataagaaaagcataattgattatactggtttctttttttttttttttcatttggaacatataattgagaaagctttagtatcaagcatatgtaaagactcataaaataataaggaaaggccaaactgcctgatagaccaaaaaaaaaaaaatcaacaataaacattttacagaggagaaacagagaaacatatacagctaaaaacatatggaaggatcttgagtcttatagcaatattgatgagcaaatcaatatgtagaatagcaaatcagtatcattatcaaagagataatggatatctctttatactcaatttattggcaataattaagaatttaaactacagaaatattgaaaagtatttgaatcaaccagatttcttatatagtgctaatataaattggttaaccacttgacattatcttttaaagtttaatattcacacaccctatgacccaacaattttctagatgtatatactaaaggaaattattacatttgtgcacccagataaacacataaaagtgttcataaaagtactgtttatattaagaagagccgacagcagatgcctatccagaggtaaacaaattgtaatatatctggaataacttgttgcaatgaaaataaatgaactacaggtatacgtgataatatgatgcttagtgataggttctcagatgatcacagcatgatggtctttataagcaataacatttttgagcaaacatatatttgctgaaattatctttttaaaaatgtaagaaaataatataaacacaaaattcagcatgtcagggttatgctgcagggtaacggggtggtgaggattgtatagatagttgcaaacattgctcatgttcaacttcttgggttgggtagttggcttttatcactaacaaagtaataagccagggaatacaatgggtaaatgaaaaaataaaatagagtcacgattagaccaatgatgatagtatatcataaatcaagtcttctcatctttaaaatggaattagtaggagtacttagcttcctagggttgttatgaaggttgaaattcttagaataatgcctggtacatagcatttttttttttaagttaagttctagggtacatgtgcacaatgtgcaggtttgttatgtatgtgtacatgtgccatgttggtgtgctgcatccattaactcgttatttacgttaggtatatctcctaatgctatccctcccccctccccccaccctacgacaggccccggtgtgtgatgttccccttcctgtgtccaagtgttttcattgttcagttcccacctatgagtgagaatatgcgatgtttagtttgttgtccttgtgatagtttgctgagaatgatggtttctagcttcatccatgtccctacaaaggacgtgaactcatccttttttatggctgcatagtattccatggtgtatacatgccacattttcttaatccagtctatcattgatggacatttgggttggttccaagtctttgctattatgaatagtgccgcaataaacatacatgtgcatgtgtctttatagcagcatgatttataatcctttgggtatatacccagtaatgggatgactgggtcaaatggtatttctagttctagatccttgaggaatcgccccactgtcttccacaatggttgaactagtttacaatcccaccaacagtgtaaaagtgttcctatttctccacatcctctccagcacctgttgtttccagactttttaatgatcaccagtctaactggtgtaggatggtatctcattgtggttttgatttgcatttctctgatggccagtgatgatgagcattttttcatgtgtctgctggctgcatcagtgtcttcttttgagaagtgtctgttcatatcctttgcccaattttgatggggttatttgtttttttcttgtaagtttgtttgagttctttgtagattctggatattagccctttgtcagatgagtagattgcaaaaatcttctcccattctgtaggttgcctgttcactctgatggtagtttcttttgctgtgcagaagctctttagtttaattagatcccatttgtcaactttggcttttgttgcccttgcttttcgtgttttagacaaaaagtccttacccatgcctatgtcctcaatggtattgcctaggttttcttctagggtttttatggttttatgtctaacatttaagtctttaatccatcttgaattaatttttgtataaggtgtaaggaagggatccagtttcagctttctacatatggctagccagttttcccagcaccatttattaaatagggaatccattccccattgcttgtttttgtcaggtttgtcaaagatcagatggttgtagatgtgtggtattatttctgagggctctattctgttccattgatctacatctctcttttggtaccagtaccatgctgttttggttactgtagccttgtagtatagtttgaagtcaggtagcatgatgcctccagctttgttcttttggcttaggattgacttgggaatgtgggctcttttttggttccatatgaactttaaagtagttttttttccaattctgtgaagaaagtcactggtagcttgatagggatggcattgaatctatgaattaccttgggcagtatggccattttcacgatattgattcttcctatccataagcatggaatgttcttccatttgtttgtgtcctcttttattttgttgagcagtaatttgcagttctccttgaagaggtccttcacatcccttgtaagttggattcctaggtattttattctctttgaagcaattgtgaataggagttcactcatgatttggctctctgattgtctgttgttagtgtataagaatgcttgtgatttttctacattgattttgtatcctgagactttggtgaagttgcttatcagctttaggagattttgggctgagacaatggggttttctaaatatacaattatgtcatctgcaaacagggacaatttgactacctcttttcctaattaaatacccttcattactttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttggcatgaagggctgttgaattttgtcaaaggccttttctgcatttattgagataatcatgtggtttttgtttatatgctggattacgtttattgatttgtgtatgttgaaccagccttgcatcccgtggatgaagcccacttgatcgtggtggataagctttttgatgtgctgctgcattcagtttgccattattttattgaggatttttgcattgatgttcatcagggatattagtcaaaaattctcttttttgttgtgtctctgccaggcttttgtatcaggaggatgctggcctcatcaaatgagttagagaggattccctctttttctattgattggaatagtttcagaaggaatggtaccacctcctccttgtacctctggtagaattcggctgtgaatccatctggtcctggactttttttggttggtaggctattaattattgcctcaatttcagagcctgttattggtctattcagagattcaacttcttccttgtttagtattgggagggtgtatgtgtccaggaatctatccatttcttcaagattttctagtttatttgcatagaggtgtttatagtattctctgatggtagtttgtatttctgtgggatcggtggtgatatcccctttatcattttttattgcatctatttgattcttctctcttttcttctttattagtcttgctagcagtctatcaattttgttgatcttttcaaaaaatcatctcctggattcactgatttgttgaagggttttttgtgactctatctccttcagttctgctctgatcttagttatttcttgccttctgctagcttttgagtgtgtttgctcttgcttctctagttcttttaattgtgatgttagggtgtcaattttggatctttcctgctttctcttgtgggcatttagtgctataaatttccctctacacactgctttaaatgtgtcccagagattctggtatgttgtatctttgttctcattagtttcaaagaacatctttattccagccttcatttcgttatatacccagtagtcattcaggaacaggttgttcagtttccatgtagttgagccgttttcagtgagtttcttaatcctgagttctagtttgattgcactgtggtctgagagacagtttgttataatttctgatcttttacatttgctgaggagtgctttacttccaactatgtggtcaattttggaataagtgtgatgtggtgctgagcagaatgtatattctgttgatttggggtggagagttctgcaaatgtctattaggtccacttggtgcagagctgagttcaattcctggatatccttgttacctttctgtctcgttgatctgtctaatgttgacagtggggtgttaaagtctcccattattattgtgtgggagtctaagtctctttgtaggtctctaaggacttgctttatgaatctgagtgctcctgtattgggtgcatatatatttaggatagttagctcttcttgttgaattgatccctttaccattatgtaatggccttctttgtctcttttgatctttgttggtttaatgtctgttttatcagagactaggtttgcaacccctgcctttttttgttttctatttccttggtagatcttcctccatccctttattttgagcctgtgtgtgtctctgcacatgagatgggtctcttgaatacagcacactgatgggtcttgagtctttatccaatttgccagtctgtgtcttttaattagagcatttagcccatttacgtttaaggttaatattatgtgtgaatatgatcctgtcattatgatgttagctggttattttgctcgttagttgtttcagtttcttcctagcatcgatggtctttacaatttggcatgtttttgcagtggctggtactggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttccggcttgtagagtttctgccgagcgatctgctgttagtctgatgggcttccctttgagggtaacccgacctttctctctggctgcccttaacattttttccttcatttcaactttggtgaatctgacaattatgtgtcttgaagttgctcttctcgaggagtatctttgtggcattctctgtgtttcctgaatttgaatgttggcctgccttgctaggttggggaagttctcctggataatatcctgcagaatgttttccaacttggttccattctccccgccactttcatgtacccaatcaggcatagatttggtcttttcacatagtcccatatttcttggaggctttgttcgtttccttttactcttttttctctaaacttctcttctcacttcatttcattcatttgatcttcaatcactgataccctttcttccagttgatcgaatcagctcctgaggcttgtgcatttgtcaggtacttctcgtgccatagttttcagctccatcaggtcatttaaggacttctctacactggttattctaggtagccatttgtcctatcttttttcaaggtttttagcttctttgtgatgggttcgaacttcctcctttagctcagagaagtttgatcgtctgaagccttcttctctcaactcctcaaagtcattctccatccagctttgttccattgctggcaaggagcttcattcctttggaggaggagaggcgctctgatttttagagttttcagcttctctgctctgttttttccccatctttgtggttttatctacctttggtctttgatgatgatgtacggatggggttttggtgtgggtgtcctttctatttgttagttttccttcttacagtcaggaccctcagctgcaggtctgttggagtttgctggaggtccactccagaccctgtttgcctgggtatcagcagcggaggctgcagaacagcagatattgctgaacagcaaatgttgccgcctgatcgttcctctggaagcttcgtctcagaggggtactcggccgtgtgggatgtcagtctgcccctactgggtggtgcctcacagttaggctattcagggctcagggatccacttgaggaggcagtctgttcattctcagatctcaaactccatgctgggagaaccactactctcttcaaagctgtcagacagggacatttaagtctgcagaggtttctgctgtcttttgttcggctatgtcctactcccagaggtggagtctacagaggcaggcaggcatccttgagctgcagtgggcttcacccagttcaagcttcccagccacagtttgtttgcctactcaagcctcggcaatggcgggcgcccctctcccaaccttgctgccaccttgcagttcagtctcagactgctgggctagcaatgaacaaggctccgtaggcatgggaccctccgagccaggtgtgggatataatctcctggtgtgccgtttgctaagaccattggaaaagcgtggtattagggtgggagtgacccgattttccaggtgccgtctgtcacagcttcccttggctaggaaagggaatttcctgaccccttgtgcttcccgggtgaggtgatgcctcgccctgctttggctgacacttgatgggctgcaaccactgtcctgcacccactgtcagacaagccccagtgaggtgaacctggtacctcaattggaaatgtggaagtcacccatattctgtgtcgctcatgctgggagctgtagactggagctgttcctattccaattatactggtttctaaaaaagattgtaatatattgttgagagtgaagggagttttatatcaataattaaattattttaaaatattgtttatttcatttctcatacttcaaattacttatttacattttaataatatattagtatcataacacatgtgtataatacagctagaaagagagagcatatataccctgaaggcatttttaattataatattgtaaaaccaaactctaaagactcctgttctaggtaattgattagtccagtaaatgtaggcataagaaaaatgtatgaaatagatgacgttaatctttcatgcacaataacacctttctccagctgtggctctaactgtcctgatggattctttactgctctcagctaatccattatatggttttagacatccaggatagacactgaaaggaataactattacaaaagtaattttaagaggagcatttgattgactgatgctcctcttatgtattcattgtgtgtatgtattgaatttgtgtattcattgtatgtattcaatattcaatgtatgtattcattgatcctgcatatacttgatgatttgattggtggtttgattccagttatattaacttgccagaaactttctagtttccaaacagtgaatacaacttagacctcatgaagcttacattctagttagaagagagaatattaattagataagcacataaaatatacatgtgttagatagtgataaatgacaagaaaaaaagtagagcatggagggcctaggaaggatgatagtggttgaatagactttaattttatatagaatattaggtcagagatctgaaggtgactaggaaaaagttatgtgggtatctggagcaagagcatcttaggacaaagagaaagtaagtgaaaaggccctaagatatgaatgtggctggcatgttcaaagaccctcaaggatggggtaagagtggggaagagttgaaggatatggggaaggggaaaatatcgtaggtctttggcacactgtagttaatgtcttcacatttttcttgcaatgcaatgagaaacacagacatgtaatgatctgagttatgttttaatagggttagtatgattgttactttgagagttggttgaatgaggacaaacagatagaccagttaagagacttggcattcatccagtcattagctgtgaagtcttggaccacagtgataatggtgaaaatgatcaagtgtggtttgattccagatacattttgaaggtaatgctgaaaagatatgctaatagtttggctgtggaacatgaaagaaagaggagttgaggattatttcccaactatggacctgagcaactaaaagacttgtcattgatttagatggggaagactgtggtaaaaacaaattttttacaggagatcatgaactcagcttagctaattatataaagttagagatgcctattatatatcgaggtgtaaatgttaaagtgatagctagtatacaagtctgaagttcattgggtcaggaacatctgaactgaagatgtaaaatgtttgaatcatcaatccatatgtcatttaaaccagaagactagatgtgataaccaagaaaatgaataacgagacaaaatatgagatctaaggattgggccctatagcaccccaacatttagaggttaggaaactgaggacgaactagaaaggagactaagaatcagtgaccaaaaaagtagaaggaaaaccacagaagtcatgtattgaaagtcatttgaatgaatcaagtgatcaactttgtcagatactgttgatgggccaaataaggtaagaaatgagaattgaccattggatatagcaatgcattcgaccaatgaccttgagaagagtatttcagtggaatgaagggcaacatggaaactagagtggatttaagagagaataagaagaaagaatatggagatagcaagtgtagacttgtctttttctagaaagaaaataagggcatagatacttttatgggatgtggaatggtgctgggacatgtggaagtctcttctattggtctgtatattcttagaaaatagaaaataattgagtatgagaacatgggaggaaaatgctgaagattcaaggagaaaagagaaagtatgaaaaagtatccaggaacatagcaaagaacatggaccagacagcattagggatctatgtgagtttagtaatcatgaatttgaagcaaggtcagtcaacaggtactatgagtttcttcagatgtatccagctcagcagttgcaggtacagagaagatagaggttagatttaactgacgttgtggttaagccaagtgaatacagtaaaactagagattaaaataattgaccatggaatctaagacagtgatgagaaaccctcaagctacagcgatttcccattgtctccctaaatgctattagtactgtagccaagacaagtctttcttttataggactatacaaggccttagaggatatttagtatccttggcctaaaggataaaggtaaagtggtacagtacacatttagtgtgctgtacactaaatatcagtagcactttgccacaaattaaaggaacagtatataatccttgacagtgctttaactccattgcatttccttcttttttagaatggaatttttttctatatgttccccaaagcaaggctagtttatataacattaaattacttatgcaaatgcaaaaattaatctgaacatctatttattatatctagcacaaaacatagaaacaaagaaggcataggttattattttgaaattatgctttactgaacacataggaattgctaccaatcgtttaaatagttgccttatttcttagacaaatagtaactgaaatgtatggagcattcatgcatatatttggaatgtattaagtgttcatgtgtatacctggcgcagagttaattgttttgcctgcattatctgatttgattttcccacagtgccatgaagtatgaattatcattatcactattatatagtaaacagtataaaaatgtgtctatgacttggagaatggaaaaatgttttacaatattacattctggttgttcacttcccttccattcatgttgacattgaattgttctaggctgctaaggcagcactgtcagaagccacgttttttctaggcatacacacactttattcctttgtcctttagttccttaaactacccatgcactttcctcctctttctttttacattgatgattaaaatagtgagcctgaatttttttaaataaaaaccaactaagttttttattatttattatttggaggaacatatgccctccaaaatatcatttagtgcatcttagacataaaacaatttaactgcttgaagaaaatgtccagcttctgaaatggcatgccattagatattagtgacatttgtttataaacaaataaatgtcttcaacctctatgtagttactatcaatatagccatgcaatatatatggagttccaaatacctttcaaaaagtaatgttgatacagtagtgatcacttatgtccttttgattgaaactgcattatacgaagttctttcctttcagcacaataacctgaaaaatatagctgtctatttaaagaagacattttcttgtttggcagaatattatcatcatacagcatatgtacaatatggtcctaatttgtgtcgatatgtgctaggcttagaaaactcactttaagttttactaaatttattttggagtttaactcttacttttgacatgatttatattctaaggagatctcagcttcttcctgcttaaatgacattacatagatagaaaggtatatattcttattatagcagtgtctgccagggctgcagtcctgttgttagaaggctgtcagaattttaaatgtaagccttcctttcccaggtgttataatttaatcttctaactcctattaatttctgaagactgtggggccatcctatatcttagaacaaaatatagatacgtacattcctgatttttttctccatatttaccttcccccaaatgttttaattttattatttcaaaattataataatagcaatggatttcaaattaaaattctggctagtgaatccctcaggtatttctttatattgactgatttgtatgttgtaggctaaataatgccctcctccaagatacccatagctgaatttccagaacctgtaaatatgttccctcttacatggcaaaagggactttgcaaatgtgactaagtttaagaaccttaaggtgggaagatgatcctgcgttatccaggtggaccgaatccagtcacatgagaccttaaaagtagaagagggggtcagagtgatgaaacaatggaagaagaggaaggagaagtttgaagcatgaaaaatatttcattcatcatttctggctttaaagatggagagtcccttgaaccaaggaatgtgaatgacctctagaacctggaaaagagcattggctgacaaacagcaaggaaatgggaacctcagttccacaaccacaagaaatgaattctgccaacaacctgaatgaacaaggagatagattctcctctagagccaccagaaaggaatgtatccatgccgacaccatcattttagtcattttagctaaaggagacccatattggaatattcgcctacagaactgtattccaacaaggatgcatatgttggaatattcacctacagaaccatgagataatatatttgtgttgctttcaattgctaagtttgttacggtagcaataggaaactaatgcaatgtacagttgacccttgcacaatgcagggattagggatgctgacctctacacagttgaaaatttgtttataatttttagctccctaaaaacataactactaagagtctactgttgaacagaagccttactgataacataagcaatttattaacatattttgtatttcatatgtatatatgctgtattcttataataaagtgtgttagagagaaaagaaaatactaagaaaatcataaggaagataaaatatatttgtgttaatcaagtgaaagttgatcatcttaaaggtcttcatctgcatcatcttcatgttgaaaaggctaaggaggaggaagaagaggaggggttggtcttgctgtctcaggggaggcagagacagaagaaaatccgcgtataaatggaccggacttgcacagttcaaacctgtgttgttcaggtgtcaactgtatatgaaggctttcttctttaaacagaaaggaagtattttgtgcccaagatttggagaaagcaatgggataaaaatatcatagagattttatggtatttgtcctttttttccttttccccttcactaagggtcttgaaaaactggtctgaaactccgctccagtagagcaaaaagaagaactgaaagttaagaagatatttttgtgaaaaatgttgtgagacaaattttgacacagggttgaggaactctttttttccgcatctgaccaagggcaggcttgatatcctgaaggttaagagcggctttgcctgaagcaaagttctcactatgggaagttgcagccgagtagtgaagagttatcttgatgggaggccggaacaaatttgctttggagacgtaaagggaactaagaactattcttactggactccaatatgagactttatttctatccattggtttgcaaggcctggagatatatgcattagataaaaagactgtatttgtaattagaaaagcctccagtaattaatgtccaaatatgcaaccaatttaaatgatgtctacataataccacacatagatgaaaatccaaaaagtcaaacattcattataataattcttccaatctagttgttgttatatagaagcccctcagagggcaccccattttgctgaatttcttgagttttttacttatatcacagaatcaggatgttcaaagtataacaaagatgagaagtaagttgaaaaaagaattattagtgatatttcttctaccatatacatgttatcttggaattggaattttttcataataagaaatccattagcataaatacagtttaaattgaataagtaaatttcattaaaaacaaaatatttatttgggggtacattttataaatagctgcaaaatcaaaactgcatttttgaaatgtaagccatattgatgctagtaagtcaatatgctcattatcaattgtgtatgtacttttatgttatttagaaaatttaattacacgtacggtgtttcaagtattcaatagataaaccacctaggaatataacagggggcataaaacatattatcgactctgtgtctttatgaaactagataaagcaaagaaaaatctgtcaattactcagccagtttcatcttagtagcctactgtaaattgaggtctatgtttttgagtgaatgaaatctagtaaattaagttcaccaggtcttattctagtttattttagatggaaatgtatgatttttaaaagtgggagtaaaatcttacacatatttctgaaatgttaagaagataattttataattcaaacctgtacaagaacttagtttgcctatctgagcaaattttacattcactagtgaatgcccatgtgaaagacaagcaggaaacttccaggggccaaggggcttagaaccaactgaactggtacaaaataaacattaggtatttcagtacgtagagtttgtggacaaaaagaataggctcttaccaattactatgctactagaatatccaattttgcttttaccaagccttagtgaaaagtgaatgaattctaacaagaagactcaaagacactggtgctccccctgtgtctcccttcacttattctgcatggtcagcacctcttcaaaagaccaataataatggtcccctacaagaagtatacaattgctcctctgatgtgaaagcatatgaagaaaataagtgtccaaagctgcataaatatttgcacccctttgagagtatgagaaagtgtgtgttttatgttgtgattgataggacaactttcatggcccactttgaactcttagcaggaactttggaatgtcctgagggtctgtctgcctttgtatggcaggaactctgttttcttagaaaatagtaaagaacagtttgtactcctttgttctaaagggtacctatagtttatgggaattggggaacttagtagaaaaatcaccaacgctctcatgtttctcataaaaaatgctcagctttatttggaaactttggccattgttttctttttcttctttcttcttctccttcctcttttgggttaaaaaggccacagtctgacctacttatatgtgtgatgaaatgtgcagactctgccaaggctatttattctaatgatttatctactcaagataaaaagaaataaagtgaagacaaatctgaaatactgtgcaatgtacttacttgaaagcagtaagttctcatgttagaaaatttccctattaagcaagaaatcttgaacacttcattaaagtcatatgatctgatttttattatcatttaagtcagggaattttagaactaaatgtgtcaattataaaactgtacatatgtatagcctccaaaatgtgttaaacattagttcatatgaatctcaaaatactgtaacacagtaaaatgagcaagaaaatttttgaaatttgcacagtagagacgatgctgttaatgttcaccgaggtaaataatttgtccaaagttctatttctgtgagatactcaactgagacataatctcagcttttttcactttcatattctatattttggttttcattttgttcttaagaaacaagtatttttaaaatgaaacatctggtttcggcagtgctggctaatgctcagaactcccttcccttgttttcttcaatgtcacccttctataaaaacctctgaatatctgaatacgttttaagagcaccccttataaaacactttttgctttgttatgtttcattttgcaggtgccaaagtcacaaatatttcacctcattcagatattccaggtagtaaggctgatatttttatgagtcatttcatctgacaaaattaatttaagaataaataacattgaaatagtaagtagcatgtattttggacttaactcttattttccctatttctattcttccatgttttaatagattaatatatactcatgtgtatatatgtacatgcacactcacacacatataagtatatatatatttatttttcctcatcttatacaagtggaaacatactatacacattataagagcacagtataatttttatgtaatataatttgaagttaattccatattggatagtttcttcattatatgtgtaagtatatgtaatatatcatatgtatctatgattgtgtatttcattgaatgaatgcactcaaacgtgttcagcaatcagcacagaggttaaacattgactctagtactagactgtgaaggttcaaatcctgctttcaccacctgccatctttgtaaccttgaacaagttatgtaagtactcaatgcttcaattccctcatctttaaaatcaatgtaacagttataagattcttaccacataaggttgtgtgtggtgttttgagaatgtaatgaatgaacatatccaaagccacattgtagagtgcttagcacttgcaaagcataatgtcagtgtgagttgtcatttccatcatcatttttaacatgtttaattgcaacccctattgatggacgtacggacattttcaatattttttactacaaacgttgttatacattgtttttctgttgttgttgttgttgttgttggagatggagtcttgctctatcacccaggctggagtgcagtggtgtgatctcggctcactgcaacctccacctcccgggttcaagtgattctctgcctcagcctcccgagtagctgggattacaggtgcttgccaccatgcccagctaatttttgtatttttagtagagacagggtttcaccatcttggccaggctggtcttgaactcctgaactcatgagtcacccttctcagcctcccaaagtgctgggattgcaagcgtgtttcagtgaatagccatgtgcccagctgtttctcacatgcacccttataactgtgggataaatctctgaaggtgaaactgctatgtcaaagtatatatgcatttataattttaacagatattgccaaattgaacccatatattttagacatgctaccaccaatgcatgagagtacttgtttccctaaacccctctctaatagagtatattatcaaacttttgggtctttggcaatccaatgggtgaaaaatgacattttgggctgggtgtggtggctcacgcctgtaatctcaccactttgggaggctgaggcaggcgaatccctgaggccatgagttcgagacctgcctggccaacatggtgaaaccctgtgtttactaaaaatacaaaaaaaaaaaaaaagccaggcatggtggtgcacacctataattccagctacttgggaggctgaggcatgagaatcacttaattgcttgaacctgggagacagaggttgcagtgagccaagatagtgccattgcactccagactgggcaacagagcaagactccatctcaaaaaaaaaaaaaggaagagagacaattatatttttttccacacaagcatttaaaatctaattcaaaaatctattctgaacttactgaatcccaagaataattaggagaggaaaagaaataatgtttaaataaattctatctgcctgttactatagaacatgaagaatgggttctgtgttcctcttatgaatttctttttaaaacccttcaaagtaggtattttcatgcccttttagacataacataacgtataattcagagttgaattaattttcccaaaatcacacagcaaatatatagactacaattagaaagtgggtaagtctcattcttaaacatatacttttgcattatagtcacatgaaaccactgagcgtgttcatgtgtgtgtgtgtgtgtgtgtgagagagagagagagagagagagagagaaagcccaagagtgagagtttgtcttgaggagaagtgtttaaaaggaatatataaatcaaggatgcactatagtatcaccaaagtaacagtgtgaacttgaacaatttaacctcttagagccacgattgctccatctatacaatagaataataataataaacctacattatacaatttccggagattaaatgaggataaagagtacttttgaaattctaaagttccatgaaaatgttagctttgattacatatggttcagcaattgggtctccttattttttgagatctaccttttttttttgtattatctgtagcttgctaaaataacataccagatgtttttgttttcaaattttaaaaatccagatcatactgatttgttgccatggtatagtagtcagagaatcttgctctgggcagttacaatattttggagattgttttacataatagcaacaataacaggaacaatgataactgctaacttgtttacatttacaaaatgtcaaatactattctagattattcaattgaatcatcacaacaacgctatgaggtagttactgttatattgttttgatttccctgatggagacttgacacaaagagagactaagtaattcactcctgtcacacacagctaaaaagtggcagagctgagtgttttgccccaggtagtccagttctagaactgtactcttttccactatgctataccatcttcctaatactatctgtacaagaaattttctcctaatgaaatgtattgctgtaccctatataagctttagctctaaaattgcagagcaggaagcaggtggataaagctaattgctattctattaccctacaatagaaatttcagtggactaactctaatatttaaataacccactgttaataaactggcatggtgcaattgcatgtttcccagtgagatcagatctagtccaatgtctcagcagatataggaattccttttctatcaccccagacaggtggatctctactcatgtatcttcagagaaatggataccctacaaagcagcacattccattttcaacagctctagatattattttatttatttattttagatgaagttctgctgtgttgtccaagctggtctcaaacccctgggctcaagcaatcctcctgcctcagcctcccaagtagctggaattatagttgtgtgccactgcatctagctccagattttagaagttaattcttacacagggttttctggagggacagaactaataggattgatgtatatatgaaggggagtttgttaggagaattggctcacatgatcacaaggtgaagtcccacaataggccatctgcaagctgagtagcaagaaagccagttcgattcccagaacctcaaaattagggaagccagcggtgcagccttcagtctgtggccgaaggcccgagagcccgtggcaaattactggtgtaagtgcaagggtccaaaagctgaaaaacttggaatctgatgttcaagggcaggaagcatccggcataggagaaagatgaagactagaagactgcgcaattctagaccttccacgttctcctgcctgctttatcctagccacgctggcagctgattaaatggtgcctacccagaatgagggtggttctgtctttcccagccctctgactcaaatgttaatctcctttggcaacaccctcacagacacactcaggtacaatactttgcatacttcagtcaagtagacagtcaatattaatcaccacattctccaacgctttctcatacaggttctatttctccactatgaacagtgagattttttttctggtatacttgataggccttcaaatgttccaagaaaacaatcatgcttttcctaagtcttctctttttaaatactcccattacctttccaaaccttttgttcagctgttgggaccatcaacatcctggtcacacctctatggatgaagtctaatttgtcaactactctcttaaatggtggtgtcatgaattgatcacagtgctctggatgtgctctgactagctatgactgctcctggatcgccgtttcctttaatctatacactatgtgtcttcctaatacagagagtatgttgtttgcctatatatcataacaaattgaaaatgcatttataacttataaagtatatattactaggtgctagaatttacactattatcctaatatacagaagctgggaaaagtaatgccatagagttgatttatgtgtgtaaatgtctaagtgacttaaatattgatttttctccttcaactgcagatcaaacttcccaaacactaaagcttccttattttaaaacaaatgcatttgtggttcaccagtctgcagtacagtaagctttttataggtaagctcaaatcacagaaaagctcaaatagatacatctcctttagcctatttttaggactgataaagctaagaacagagaaaccaataaagacatattttaatgatggcagggtatctcatggggtagtacaaatttatcccagttttttatgccttctctatgtgtaatacattgaagtgatatatggtgttgaatgtgattaaaattcagcagatacttatgcaagatctactatctataagatgcttatgcaaaattccatagggaaacattaagacgtgaataaaatctgaattgggccatcactatgatctctccccaaaacgtgggattttcaagtgcatttagaattatgaaataaaccactaggtttttagtgtgaaatgtttacagtattttaattttgaaaactatacttattaaaacagtatgacaacatttattgaatacatgttatgtgctaggtaccaagtggggagttttatgtttattttctcatttcatcctaagagcaaacttcggaggtaggtgtgattcgtctcattttagtgaaaattcactgatgctctgaaagcaaaattaactttcccaagggccttgtagtgcttaaaggcagaatcaaaatccacaaccagctctggaaaatctccagaaatgagcttaattttttgtgtgatttatatatgactccaatattaacagacatgtcaaacaactaacacaaccctttacctgtttattttggaagaagacacttaaaatgtattttattaccctgttgattctcctctggagtgtgacttagtatccattgcacctttgggattcttatcttctaaaattcacaaccactttctactgctgtaagaaagaatcacctgcagagttcacgaatgagggaagagtgaaaagggaatagtggcagatcaataccacttggcatcacatcaaaatagtattccaaggttggtgttctggcttctgcttttctgggaaatacgttgtctgctatttcaaaatgccctccatctgaataatgtaacctgaaattcattcaactcatatttagcactttaggccatatccagggttgtggaaggtgtacgtaagcaatgaggattgcctacaaggcaagatgagaactctgttttctatactttctattgttcctccctttgcaacagaagtagaaagggccataccatagccatctactgtccaacatgatgaatatccttaaagacaaaatctttaagcagtaagtgaaaggttaactacaattctcatttaaaaagaaaattgcattgctgatatctctttgttacataaattttccacaaggattatacattttctttttattcatttgttatctatttgacaatagcaagcctgtttctctttagcttaaaggaacttggattaaaattttttctgttattttaatcagcattgatgttgtatattatgagcgtgtggctttttgttttcttggcagagaccttgaaaaaattttgaaccctagtcaataagaaatctctgtattaatataaaactataacttatggtttatttgattagatcaatgtttaattatggataacatgtattttttgcactgaatatttacacacaaattaatctagcccatagtaaaagtgctaatggaatgtttcatccaaacataagttagtaaatggaaaacaaacagctgttgcaaagaccctgtttttgggtctgggcctaacagcacgaagcacttcagagaatttcaccactaccatttactcacatctgttgagattgtactatttcaactcaagatttgatcagtgtatgtcataaagtaacaagtagtacgctaagtcagaaaacttaaaggaaacattaaatactcatttcctatatggaatgttgcctttctaagcacatcatcttcttctatgtgatgttttgcaaatctattcataggagatttatattttcaagtgtgctcaaatggatctgtgttggggaaagatacgtgaaataagaaaataaaagctaatccatttgttttaaaattttgtctgcctaccacattttgttggacttcttgttatatgagaactcctaattgtctggttttcaattgcagccaaaagcattcttacctgatcaaactcttcaaattctatttactttgaattatagctgagtacatggaaagtataattgggccttactttgttacacagcagacaaaacatatgctcaagataggtcagtgctattccagtgaataaacattttaacaaaaatttgtatgagaaattcatgttggcctctcattcctctctatatgcctttcacagttactctttttccccttgccaatcaaaacactataatgaatatctcttggccttaacgataagaaacactgtatataaatattgtctaggctgtattttatgagaatgtggagttatatgaaatgtaggaagaaaaaatatgagtgagtaatcctgtgagcagtggacgggctgagcttctaggacactgataagcaatcagtgttagttacacttgaggcagtatctctggtggtctgttccagaactatgtccttgactctgtcacattcatacttttcatcactactttttatacttctgcaatttaggtcacccaatacaggttatcttatcaggttaaactgattgtagtggtcacattgaaaaagaaaaaaaaaatcccaaattcaggacttttcccaaccagttctaattaatgcacgtgtgaaaggacatagttattgtgaaaagaaatgctatcaaaacagtctaatggctacaagaagaaaaagaaaagaagaagaagaaggaggaggaagaggagaaggagatgaagaagaaagctaaggagaagatgggtaacaggaaaaaaagagggcaggaaaagcagataggaaggaaaaaaaaggtggaagagagaaatgaatgcaggcaggcaggatgttttcctcgaggttttttatttatatcccctggactgcataactcagtttattcccttctaaaccaacttttctagaatgtgttgtctctgttcgacacctacaactctggttcattttctatgcattaaggatgatgtaactttaaaacctctcatgtaaattctgcctgttttctaattctacaatcctcttgtttatgttctattctaataattatcgagcttttaaagaagagaaatctgttcttaactcaaatttatacatacactgaaggaaataacaaaaccttgaagtaaaacactgtttctatgataaaagagagctctacaaatagatgcatgaataaacacttctatgggagggataccttttcagagtttaaggctcgcgggctttgggatctaagaagatgaatcgcttgccctgtttgtgatcctaaatggaaattgacagatatgtttaatttatcctgctcagtattataaagcctttttctcatttgatttttgtgtatccctcctgaaatatttgctctggtaagcaaaagcaaatattaggttttacactccatttagtgaaataacagtgatgataatctgacatcagagaaccaaatgttccaggcttatttcatgaaaaggatttcctctccagaaacattatcctcaataggttatcccatccttcattcctcaattcatatttcttgagattgagagggaaaaaaaaagaggccagaccacaagtagcctactgctaaattcttttatgaagcttagttttatgaattaccttttagccttctccagtcatgtgggaaaactttcctgcctcattaaatctttaatgcaatgtgcaccatgcacactgtattgttatttgtgacattaggttatatattgcatagtaactataatattacttgcaaacaagctggtttttccccctgaaggtagaattaaaacaggtactcatgggaaacagctacttgtgttcttcttttcttaatggggtgaagctgaagaacaggaaagtgaatggcttagcctagaaccatctccaggaatggaggtaaattttttcctgcagtgccttctcaatttgatatctgaatctccctgaagagaatttgccttagtagatatggagaaagagggaaaaggccaagcctttggagacccttatgaaatggaatgaaccgctctcactaaattcactttctctttgtattgaaaagagatataattttcatccctagtaaatatagtcgaatccatccagtaatataagaattgcctcaaagtgaactaaaattgcacttactcctacctgtggaaaaccatatttctctagccaagagaacaatgacagattagttcctaaatagcaggagaaaatgaaatgttctattggctgaacacacagtgctctgtaaaatcagagaaatcaatattgtccccaaaatgaactaatttgaaagtctcaaagatgttcaattttatgaaagactcgtaaaattaataaatgagtctgcaaagtccaaaaatgtggaaaattacagttatttgcagtacgtataacttaccaagaccacttatattttgttagaatttttcaatgaatgttaatggatgaatttttttatatagagttctccctgtttggaatcttttagttcccttatttactgtggttgccactgactctgcatcaggctttggaaatatcactaaaaaactgttttttctttagtcttcttactagtcaaatatcagctaaacaaacaaagaaaataagtgtttgaatggtcagagaactataagaatgagaattctggcaggaaaattcatttttaaaaatccaagtaacagaatggataaatataaaaagaggctagatcagacatacccagacattctcagttcagaatgttcatagcgtattcataattttttcatagtgcctccttgaccaacagaaataagccacagttctatttcttaagtagttagtgccaaacaacttaataaatattcatgttttaacaacctagcaattgtttaaaaagaaaatggacagaaaataataatttttttcataaataaccagaatcacttactgatgggatgtggtacctttggggtagtatataccttctcaaacttgagtatcagattggataatgctatccttatttccttttccacattgacttttgtgcagttcttgcttttaattacagtctcttctgaaaacctttcttaataaagatataaagtggcctaaagtacaagtaagcagaaacatggctcaaaatgttgagaacattcttaagtggaatatagcatgttctaaggtttcaacttgtgaaccaccttgaattagttattgcagtgcccaacagatatttagtattgctgtgtgtccttcaaatgtttacaatattccactgtgcctttgtgagttcactgcagcaccctggggcacctctacacacagtttgtgaacacaggggtagatagatcctagaggcattgaaactacacggaaacttgaatgacgttagggatcccagagccactggggaatcttcattagggaagtgcaacaacatatgaaatagctcattaaactttccctatcaaaaaaactgaagtcagagagatgaattcagatgcttgatgagaacctacttggtaatggatttgaaggagagagtaaacgttaggatactgaagggattctaagagagtgcagaagcgagggcaaggaggcacaaaacgaaggcggcacctggaacatggaggagtggacagatggagaagaggcagagaattctttatctaaagcaagaggaaagggcaacgtatactcagaatattctcaaagctttttccctgaataatagcatccttcagaaaagaagtcttgtaactgactcattgcaaagtctcttacacaatggtatgtactctttggggaagacacaactggaaacaacaccaggaaaagcttgattttacagcttatggaaagattgtggagttgaaggaaaaatagaaggaaagaaattttaaaaagaataagttaatattcctaggggtgcatcctctaaattgcagagtgatatcttaagcaatccttttaagaattacttaagagcctgagcgtggtggctcacacctgtaatcccagcactttgggagacggaggtgagtagattgcttgaggttaggagttcaagaccagcctggccaacatggcgaaatcccatctctacaaaaaatacaaaaaattatgcagtcatgatggcacacacctgtagtcccagatactcgggaggctgaggcacaagaactgcttaagcctgggaggaggaggttgcagtgagctaagatggtgccactccacatcagcctgaatgacagagcaagactctaggtcaaaaaataaagaaagacagaattacttaagtaagtacttgactaactggttatataaatgtgatcataaacgcatacctttagggtaaatgaaaaagacattgattctaatattgtgtaaatgggtaactgtggcttgggaaaaaaacatctagtaacagtatcctgaaaattgtttaaatggtccgtgtttcacacaacttaaatggaagtaaaacagcttcgctcatgacaattttcaggcaattcaaaatacgttgtaataatggcaaacatgagtatcagagatacacaaaagagtttagaaaaaaatcattttatgaaatatgagctaaaacaatgttttactattatcgctattattattagccctcagcagaatagggtaaattatttctattccttagttcatgttttatattatcgctgacctgcatgaggagcccctatttttctgcgtatttatttgttcctcttttcccccttcccacctctaattcctctctcatagtattttagtttatgtcagggatccccaactcccgggctatacaggtctgtggcctgttaagaattgggcggcacaacaggaggtaagcatcaggcaagtgagcatcactgcctgagctctaccgcctgtcagatcagcggtggtattagattctcacaggagcaggaaccttattgtgaactgcgcatgcgagggatctaggctgcacgctccttatgagaatctaatgcccgatgatctgatgtggaacagttttatcccaaaacccctcctctgtgtccatggaaaaattgtcttccacgaaacccatgcctgatgccaaaaaggtggggagtgctgcaagtttccattatatgtgactttattataaataggtatgaaaaacacattagcaaatcaagtatcataggtgatctttttctacttcatctatagtcgtaacagctttgacattcaaattatacacactttgactctttttattgacaaaatggaaaattatccttaattcaaaatgtattttatttgagcatatgtggtgatttcatatattaagttgatatttttctttcctttttagagaagccatattcaagaaaaatagcatgtaattcaaattttaaataatcaaaatagatttgaaagctcaaaattttggaacattataggcctatgtcccaatattcttcccaaacctcctttcaaacgtatttattaatttagaaaattctaaatagttcagtccttgtttgaaatatatacaacataaaacttttttttctcctgcctttctagaatccttttattgagaaaatgtgtagctgatctgaagaagcatgctgtgtgaaattttgaatgtttatcttaatagaacctaaaatcttccacataggttcacccctcattactcacaataatgccaagtgctgtagtccaggcagatatttattattttatatgtgaaaagacattcgaataaggccatttctcagtggattaggggaatcagagttttctgaatttaagttccttatagagccccatgtaatgagctcttagaagacattgcagagctgcaatttaaaatcctgtttaatcagccgtagcgagctatgtgccattctctgtggaacactaagaggaatcagggttcttcctcctccatccagtacattcccaaccaggaattgctgtctggtcagggttggacgtgaaaggccatagagagccaaccctgcgaagccaagtctctgcatgtcagcacagagcaagcagcagaatacagatcatcagctttgttttatgaatatctctatttacagtgctggagtggaattttaaaaaaaggattgcagcatttgcattgaatctgtcactcacagcttcaattttgattcctgtcctataaatgatcttgctttcctatttttttctgaatttctacaaggtgactgtcaatgtcagaaaatgtaaacctcaagtgtacattgcatggggcttggcatgtatattagaaagaaagaagtttgcttaatgaaaagaggataatatttattcaaactaagcctatttaattgcacagaggaaagtataccttctttgcctgttttgtttgaattttaatataaaataaaatttgctgctaaccttttgtttttctttgaccaataacatttctcagcttagtgtatgggctatgtaaagtgcctgtcaaatggagggatgtctttgttgaaagaatccagactcacagaaagtgagtgactttctggtcagatggttagaactctcccaattttgacaaagatcgttctctgtttgggatttgtaaagctcaaactgtagactaagatgatgacaggaggatctgctgtttggcttcatggaacttaacctatttcagcaagcctgcaatactggggaaaataatacatatatttatgtttatgtcaggcttgcagttgatgggtaaggttcataaaaggttactcctaaataaatgcctatcattcccactccgtactccagtgatttctgcgtcttgcaaatactgccctatagaacaataaaattcgtatacaacagtaagtaaaatatgatttaatagcccatctcctatcccgtaatgattatgcatcttctgtcttgtagctcccagcagtaggaggacagttgacatttaccatatcatatgaccttgaagaagaggaagaagatacagaacgtgttctccagcttatgattatcttagaggtagagtactgagagcatgttcacccgtgttacttcctgatgttacttaaggttaccagtactgtattttttacctgcctggtttgacactgacttacaggactactaaaaaaaaatataccttaggagatttttgtgccactcttttgtttcactctgagacatatctagaagattgagtatatttgttgggtttgaatgataaaggagaactttagaccagacttgaaattaaatttcaaacataaggaccatatttccaaaatttaaatattatgaaagtgtttaggtacatgctaatttacatggttgtgtttttcctgttttctcttgcttccagatagattttattgtctactcccttgtttatattagataaaataaaatgaaacaggaaacttgtttatttagctatagttaaatcttgacttcagaatcctgttttaggtaagaaaggtacaggagaaactgctttcaagatttgaagggccataggcaacttcaaaatgctcaaagcctgaagtttccttagaggctctctgccaccctttcttatcatatccattctttccaataatgtatctcctccccttgacactgatacgtattcagaggcacacacatacatgcatgttcattattccaaatgggtagatgttaatttagcaccaggctctgttgtttcctgtcttgaaactttcatgcatgtgaatctatgacaaaatgaaaaattcttttctcaaaatggacattttccagtattggatgaagtggtctgctctctctctttctgtctctctctttctctctctctctgtctctctctttctctctctctctctctctctctctctctctctctctatatatatatatatatatatatatatatggcaactagatgtatactttggaattcctttaaggtgaaaagagttctctaaatgtaaagtgttgagtgaaattatttagcattcatgtgaatgaactaagacaagaaggattacctaagtgtcataggtcattcaatatactccttagatgccattgtcctattttgagaattagactgcagtcttttttgttgtttgttttttcccatgtagtaagttcctttaaaataatagcttaattcagttttaagtttctttccctattgttctacacaacccacatccatctacagtttgaaatatgtaactttcgtgcacttttttcaattcaaggtgtttgtaatcacatatatgtttatgagttgtcaggtagctattattttagttaacagggaactaaggtcatgccaaaccaagaagcatatgcttcataatgcatttggctaaggctaatattgaaattgcattgccttcccttcatgtataccacaaatatattccctgaatgacagggaaagccaacctgaaaataaaagtctactaaggccgggtgtggtggctcatgtctgtaatcctagcactttgggaggctgaggcaggtggatcacctgatgtcaggagtttgagaccagactggccaacatggcaaaacccccgcctcttctacaaatgcaaaaaattagccaggcttggtggcaggcgcctgtaatctcagctattatggaggctgaggcatgagaatcgcttgaacctgggaggcacaggtggcagcgagccgagatcgcgccgttgcactccagcctgggggatagagcgagactctgtctccaaaaaaaaataaataaataaaaaataaacataaatttttaaagttaaaagtctattgagggtggaggatacaaatatagatatgtttgacacttttgtaccctcttttcagttttactcttttttatttcttttttttccccctttagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggtaaaatcaagaactgcagctccaacgttcacacatttactttggggccaaggtgcaggagccgccccaggagtgaattttttaaggcacctaggatttgctgtcttcaaagagcagataagaacggagccctagttttctgaaagatttttctcttaaacctttacagttttaaatatgcagaataaatttgtctcggtttttattattattgatgattctttcacaattgtcagaacatgtgatcaataacgattcctatattgagaaatgttatattggaaaataaagtctcctttatgatggctcatagcgtgggaagctaaaaagatataaattccagggcacccctatttggaaagtggtttttaaaatatttccttccagtagttgttaactagtttctggcttaatagtatatagattgtaataagaaaagtaagtcttttcatttaagtgaccacccatctcactataaaacactttaagactataacagccatatggtataaaggaaagaatatgaactttggagccaaactgaatagaaattcaataagctttattgcttattttatgtgtgacctttggcaagtgattaagccttgaggaacgtttcttttcagtgtaaagtggatatagtaatgcctacttttcagggtctttgttaacatgatatgtgatcattaggaaagtactcatcacctagaacactttcagtttttttcttgttctccccgccccctttttttaaaagagtgaactacctgacttgaaccaaatatgctcgggtctgattaactgctgtaaggcggctttgttttttttatttttaaaacaatgacatttttatctgacagaattttaacttcaactgtgtctgaatgagctctttacgcttctcgttttctactctaataataaataacacaaggtgtcataggaacttccttctaaatcaggttaagttagacattcaaatgtgaccccagcctgacaacccggtatacctttaatgaaagcaatgtctccaatattggagtttttattgctgacaccaccacctctcacctccctgtccctcatcatttccctgtgctgcctagtttgcctttcactggtaatatttcaacttagtctaatcatcattaccatttcccaaaggagagaactgcagaatcataaacagaaccattgccaaacaatgtacctcttttgcataggcaattcttctagaagctgggttaaaatgccatggagatgagaagcagcacttaggaattaattatgtttttcacatttagcaaatagaggttgtcatgatgtttaaacagtacaaagaaatgagtcctccagctttcaaaatgaatgacaaccaaattgacaaaaaaagtgtctggggggcttatatatttttgtcagcattgcttttcaggctagttaatacaaagacatttccccctgatttatgttggacagtttcagtgtctacccgtcttaaaatcactggtttcatttgcagtcttctgaggtttcgccatacaggaggaatgcattcacagcgcggctctgtgaaatgacacaagagctaatccaagtaggtggctactttctgtcacctacattacctaaagcactgtggttcaataagtaaaagccaatgtcaaatttgaaactcctacccactcaggtgagctgaaagtcggcatgaatctggagtcagtcagtaagcttgttatattttatctttgatctactagtagattgagtcatatttgtaaaacatcacttgaattgatttcaacttgtcttgcacagtaggctttcgacttggtatactgtttgtgtacaagcacaagtaaattgaagctcaacaaaaattcatattcagacttatttacagtggatttacttccatggcagttctttcagcaaatgggcttaggttcctccagttagttatatgattagatggaattgtataacagaaggagaactggactgcgggtcaagaattttgacttttgttttcaactcagctatttaatagttgtaaacataagtatggctttgacctctttggacttcaatcacttcatctgtaaaataaggaggaggacaattgctctgccagcttcaaaaagtcaccgcaagaattgaattagagagctgcaaaagcacttggctagtggtaacccagcacacaaatatgaagcatttctatcttatctacttcatcccaaaggatcacattttctccaaataccattaagacttagagacctctaaagaaaggcacatactggcatttccatacatatgacagttcttactatcatttttatccagaatgctgagacccattagataaaattaatttattttcttctcgctgtcttcactaggaagatgaaggcacaagtagaaaactcttcattcttcttttaagaatataagagaaatcaacctaactgaactgtgcatctttcacctttaaattatccaagacttggatttagtaacatccttggtctttaaatcaagaaaggcttttatgaagcacctatattagatatagaactctgcacaaagtgtattttcctctaactttacagtagacattagtagagttcaccaaatttccaatctcatctataggggatattgcatttctctaatcctggagggtagatgtgtcacatgacttggtttagccaatgaaatgtggtagaaatgatgtatttttttttttcctgaggtaaacattgaatttccaatgtgagactctctgcagcttactcagcaatcagaagattaaaaaacagcctggggccgggcacggtggctcatgcctgtaatcccagcaatttgggaggctgaggcaggcagatcacgaggtcagttgttcgagaccagcctgaccaacatggtgaaaccccatctctactaaaaataccaaaattagccagacatggtggcacgtgtcagtaatcccagctactcaggaggctgaggcagtagaatcacttgaacccgggatgtggaggttgcagtgagccgagatcgcgccattgcactccagcctgggtgacagagggagactctgtctcaaaaaaaaaaaaaaaaaaaaaaaaaaaaaagcctggaatactgatttagcacacagaggtcagctgccctaacagtcacccaggcctgtagaggattttacatgagtaagcctttgttttctgttaagccattgagattttggagttgttaccacagcataaccgagtccatcgtgacttcatcacgatataactcatgagtattgcttgaaaataaatacagaatcttttcaaggcaagatatttttacacaacttttagtgtaaattttgcggtttgggatcaaaaaagattatacagaatttatataataaataatctagaaaaattcctttgtaaacaaaggagtctttgataatcatagaaatagtattgataggtacacagtatacctctgccttctgaagttaatgatttgggtaactacattttgaagacattttactgataacactaggacttaaaaagatttttgcagctcacttggcatccggccattggtaagaggtgcagccaacattttaccctacgtttccttcccattatctttgactacctcccaatgctattccataagtgttggattcgttcagtctgcaaatatttactgagcaccttccatgattatctctgtaaatctcagttcctcttgtatacaatggcagaaacaatgtctaaatttcaattggcaattaagtgaaaacataatgtatgttaagcacctgaaatagtatctaacatatgttgggaggcaatgcagggtaacaaggagatctttggttttggagtcatgcttgggtttgaatctatgctgcaccctttgctaatggtattatgttggacaaggctctttactcctctgagcctcagattcttcatttgtaaatgtgaatagacatgggttgttacattgtttattgatacttaaatgaaatgtctttccagcctgtatcatagtacacagaaaatagtagacagtaagtagtaactattaaaaagcagtcattctaggctaggctataaggatacaaaggtggacaaatgatcattcagttcaaagaaggcattgtacagtagagaagacagatatacatatacatactgtacatttatgataatataaatagtgcagaagaagtgtgcacaatgcatataaatagtgcagaagaagtgtgcgcagtgcatactggtagaactaagaaggaagcaatgaattcttgtgttagcatttaatacacttttaataaatagctgcaaaagtatcagtttctgtcagttactgctcttactcgatgtgggattgaaaatgtttaaagaaaatatcttgctatatatatataaaaaacaaattatatagcatatatatatatatatatatatatatatatatatatagtgggtagaaaaaagacaattgtaacatcaagggtatttttgttgttttaaagtgtcatgttttgtgctggttgttttagtgtaatatagcatatcttactctggtgggaaatgtagtaaaacaaaaatattgagaacaatctttaaggcagcaccaagacaacgtttctgaaatagttccaatattattcatagtggcttgtataattatgtcctctctcttcatccatcatcttttctgtattttcaaggcataaaaataagagggaagagtcagctaaagcatttgacttagttgacaattctttgatagctcatgcatctctaaaatttagtactatattattgccaacattatgtatttaaatgaatgcagcttgatatcaagagaatgaccatactgaaggggaaaaaaaaataaactgcagccttcttcatgagtaacacttgaaactgttaaacacattaaaatcccatttaacaaatagcagaacctaatgaacattgggattgctcagtgagtactaatgtggaatattactgggaaagatgtttgagtgttgaagtttctcatagctcagaatggttacacagattaaggagaggaatgtctgttgttcaaaagacaaatgaaatttgtcagttcactgaaaatatttttgtttttgtatcttttttaaaactgtttcttaaagtagtcaactgctcattcttctattttgaaatttccagaactctttgtttaagttttgcatgtcaattttatatgagaaattcttggactgtatctagatacagttaatcaatctgctgtttagtaaattgtggtgatctattgtatgataatcaactagtgtatcaaccatgaaatcatctaattctgaaattaaaaggatcagaattataggtttatcaagtgacagtccattaattccaggcagttagatttcacaatacattcaggcgagttctggtctctggcctcaagttctaatgataacagtttccatttatcttctatgtcaaatcaaacaagtaatttgtcttttacttttctgattttattcatctgaaatgtggctagtagtctttattgtatcctttgccatggagtttgttagtcattgtttgtaatagaactgttttccattcatctattcatttattatttaagtatttagtcagttacttttgtatacatttatctgtctatctacccatccgtccacccatccatccatccatccattcatcaattcacccattcgacaaaagtctactgaacatgaacatgtatggagatgatcatcctgcatatatagatggcaagataggtttctgttctcaaggagtagcccataagctcatgccaacataagtactggctttagtaactcttcaaaaccccgttgtgttaaggagacttatcaggcccagaaattctgtttctagatatatatccaaaagaactgaaaataggtattatgtgttcatgaatatgaatagcaatattatttatgatagctcgaaggtagaaacaatccaaatattcatcaactgatgaatgaataaacaaaatgtggcatgtacatgcagtgaacattagtcattaaaaggaatgaaatactgatacatgctgcaatgaagttatctagaataggtaacttcatagcaacaaaagcagattgttagtttacaggggttagaggaagaggggaaaagagaatgactgcctaatggattctgggttttcttttgggctgataaaatgtcttagaattagatatatgtcgtagttgcacaacattgtaaatgtactaaatcacagaattgtacaatttattttttaaattttaaataggtttgaaaattttcatcctaccccaaatgtcaaagttcctctctatgtacaacttgaaatgcttaattttatatgatgtgaatttcatctaaactaatgacaagaaaagtaaatgcctgtgacactgcatttttcattgacagggttcctcagtgaggggggaaaaaagcatttaatgattttcaaatgacacatgtaacctaaacactataggacagtgatatttgcctaatctagaaccttctaccaggttgtccaagatgtgcccctagagaatatagcactcaattaatagtgttggatgagtttatttacaggtaaagataattgccttgtgtttagagggtgccatctggcactcagcagccaggatgattccatccaactgcctatatctggtgatttcagggttaatttccttttctgcttcctgatcatatatgagctcatacatattcaaaagtactgtcaagtgtctaggattagcaaagtgggggtaaaagcaatgaaaattttagaaatctattgctgaaaagcttacaatttggataaagatcatcacttttgaagatatgtttacaccttgtaatgagccttttagctttgctctctggcttgattcccaaattcccagcattgattcccaaatctaacaagttatttggtaattgtgaatcactgatcaacaaaaatctaccatcactcctgagaaaggaactgaaaaatgcaggccatagcgagaatcagttgcttctttcttatggttacaagatgccatatcatatgctataaaatgtctatcggtaatttttaaaactgtgattattatgagtcaatagtagtcatttaattatgtgctcttagagtttatttaaaatttattttcatgcactaaaatgatttggagatacaaatagtgaaaagtatatttcttgtaatgttttgtagtaatttttatttggtttcaacagtcaatgaaaataggttaataaaatgtctagtatttcataataacctactgtgtgttacatattataccaagaagtttatattcatttccttttaaatcaagctcatggtgtatggactattatattatctccattgtatagaagaaaaaattgaggcctagaaagaataagttattttcttctaggccacaaggctggtaaatatcagagacaggatataaatcttggtctatttgactcacaaaactgtattcttaataattaagcttttaagatgtccttttacacaaaaataggaaaagcaagtaagataccaataacatttatttaaaatgtgaatgcatagtaagaaaagaaatatgtgtgtgacagcatttttttccaattttccatttggccaaaccagcttttctctaaaataatgagttatgccaaatcactctgctaaaatcaccagattgtacaaaagtaccaataaaatgaaggccatagatacagagaacaatggatttaatttaggccaaaaacaaattccagagatcattctaagtcagtcaactgagcactttgagaaagtttagcttataccaactacaaacaagcagatttatctctaagaaaaagaaaacaaaattgtttccatcttttatttcaatttaaaagctaagatggaatattaatattgcctacttctgctttccttgtttaagcactaaaagaaatcaagcagtcattggaatgttttcttttttaaaagaccctttaactatatgattttaaaaatgtctgtctccaaaaaatgaaaatcaaaacacatagccaagagccaagagacgaggaagaacattctcatatcttttcagcatttggaggtggtggtgattgtgagcactttagactgagccaacttgacctaatatgacaaaggaccagagcttttggttatggtattcatcagcttcctttctcagcatgcataattggcttatatttatgtcattgttgctgtacgattcctacagctgtataatacctaagaactttacttattcaccatctcttttttcctctgccataggttgagctctgttaaccttgaatccgctgtctcctatcctactgatggaagcattgcagcagctgtagaagtgtgtcagtgcccaccagggtatactggctcctcttgtgaagtaagcttgcaagaatgtatccttagtgctttcaaagttccctcaacattgctttcaataacctattctaataagagctgttttttttctatcaataattacacaaataatgtgtatcacttaaaaacaaaacttgaatatctaccaaaagctgtggctttcaattagagtattaaccacataatttcattttgtaactctttctctctgagatattttgcctataactgaaaatctgatgtttctgtctttgctacatatttgatctattgtatgctggatggtagcagaatagcacttcaaaatattttctcttcattttcatcataatgttatccaaaatttagcactctattttttttttacttttctctcattttttaattctgtatcacacttttcctctacttcatttctaagaatacaaccaaatcacaatcatctgaagcatataatcttcagaatgtcaagaatataatatatggaaaaaataccttgatatagaaaactgcctacaggtctttgatttgtttagcacctaatgtttgagatatttattgttgtctcaatatcctagatttataataagattaatggttcttacttaataccgcagtgtgtcatcctaaggtaacaatttttatttgcttctgtgtattttcttttacacagaaaactggtgtgaaactggttttacttgaaacctggtcaaaaaatgtgaacactatttccttgacagagcgcatggctagcagataaataggagcttagtttctttaaaatggtgcctttaaggaatcatttgagtgtactgagatgttccacttcagaacactacctcattatgccatttatagaaatactctaggcattgctttgtcagttctctcgtacttttaaaataatgcatacatctagagatacgcattatagtcatattcatgacagctgtgtttcctttaactgagctcagattcacctttctagaaataaaactagatataacttatagaagtacttgcttttccaaaattcatgtagatgagagaaaaataattatggatatcaattagctatgtcaacccaaatttgattttacatataaaatacacaatgtatttgatgaaacaagagccttttgctcttgattccaaactatttgaacttttaagatcctctctcaattggcataataaataacttaattctactcttgttttaaggcttgtttccacatactttgttctcatcctttgcattatcttttatacaaattctaagtgcccactgaatataaaattacttgaatattacaattgcttaattggctatgcttttagtctcttccttctctccttcaaaaatattttcaatacattctagatatgtttgataaattctgtaaatttacctgtataaattattaataagtacatacaacataatccctgtcctatctgtttagggagacaataaatatctatgaaaaatgggatctcagcactgtataattaagggagaggtatgtgctacagaacatacatgcaataatcattcaaagggatgagctactgcagtggagagagatgcaaagtgtcctggagtggagaaatcttaaattggatgctaaataatggtaacagatagatagaagcatttgagtgtgaaaaaaaaaggagagataataaaagcttcctgtatctgtcacacaataattgtttgataaataaaattactttgtaatccataaaagaacttaattgaatcaagagacaatgaattttggaactttggattttctctctgacttcttcatttcttctactctctaaaattcattttttccttatcaaaactttctgtccctaaattcactattattcagtcctatcctttcattatttcatttgcttttcaattaagtgtagtttgtaaggccagtcattctagccttgttatcactaatatcctgggatcccttaaaagctgagtaaacgccaaagaccattaatgtcttaattccagcttgctgagaacctctggccaaaaaaggatcaaatgactccattgtagacattctcttttacttcatttggggccatagtgttgattcaggatcttttttctcatttctacttgacttcttgtgaagtgttctgcagttaaatctttcaaaaattttcttactttcatagtgctgtcatcatagatttcacttgacagatgagacaggggatatactattaaaaagagtgttatgcaatctcagtttcttcttccatgaaatgaaaataatattaaccacctcatagaattgtttgtttgttcgtactttcatttagctgactagtatttgatgagcgtgtattttgagacaaacaagaccctacacagggaaaatagtgccattaacaatacagatattgtccctgtccccaaggacgttgcactgagtggtggcattaacgatatgccagaaagcaaatagaaataaacgtgacaaattctatgaaggaaataaacagggtgaaataaacagggttctatgataaagttactgcaagtggttgtatgaaggttagaaagtctactttgtaaaagtttgtcaggaaaggcttcctgaggtggtgacagctaaatcgagtgttgaagaatgagagggacaacgatgtaaaaccagctgctaaggaagcagcatagatcgtggagtctgtaaggactggaaagaaggagcgtggctggagccttgtaagcaaggggaaaagtgggacaagaagtgattggaaaagcaaggccatgaggagatttgcacatatgataagaaatgagcattttattctcatggcatggaacatcattacaagcctttcagcagagtagtggagtagtgtaatctgatttacatttttgggttttggggtgttttttgttgtttgagacagggtcttgctctgtcacctaggctggagtgcagtgatgctgtcatagcttgctgcagcctcaaactcctgagctcaagtgatcctcctgcctcagcctcctgagtagctgggactacaggtgtataccaccatgcccagctatttttttttgtttgttttaatagagacaagatctcaatatgttgcacaggctgatctcgaactcctgagctcaagcaatcctcccacctcagcctcccaaagttctggggttacaggcatgggccaacgcacccagcctgagttacatttttttgaagaaggcattatggctacagtaggaagaatgtgtcttaggagggcatgaataataggaaggagaagggttaatatgtagttgcagtggaacacagcaatgacagtagttgctgttaggatcatggcagggaatataaaaagagttagcatattctatatatattttgatagtagaacaaataggacttactgattcgagactgtatgtcaggggagagattaaagaaataaagagtttaagaatgagtcatagatgaccagtttgaatgattgatcagttggttgtggtgtcatttactgagctgaggaatagttggtgtgtgtgggggggtgggggcatggaatccatagtccagtttagaaattttcgatttgaaaacgctgtgaagtgtaaatgtcaatgtgtatttataatattcaggtcttaaattcagcatgtctgtctggtctagagatatgtttttggaaggcgtcataaactatggaactgaataaaattacccaggagaaagtgcaattgatttaaaaaagagagaaaaatagcccagcccaagccctgaggagctcctgacgttaagaagcagggtcaaagcagaggagacagcaaagaaatatgctagaaatttgggaagtgtgatgtcatgaagttgagaaaagaaattgtgggaggaaaaggagtcagctaggcccaaggctgatgaaaggttggataaaatgcaattgcagaattgtccatcgaatttggctgcatggaatttggtgacaaggacaagagcagttttaattgagaggtggtgacacaaaacagattagaatggaatgaagtgtgaaaaagaggtgaggaatataatacttgttaagagtagtgttactgaaaagaaaaacatagatgactagaaaagttatatgaggctaagaggacagttttgtcatttgtgttttgtttatttttgatggagacactagatcatatttttttgtgctgatagtaatgacccagtagaagggaaagttattactaatccatcagagagagtgaatattgagaagataacagatgctggaatcagatgacaagtggagtaatatttctttaggaggaaggaccccacattccccacatcacttgtttggaatgggaatatggcaacaaggtttggagatatatgcttagatctctggacttgttagtgcaaaggcagctttaatttttttctgtgagtaataagttaaaatcactggctaaaagagaggtgtaaggagttgggaagtttgaagaaagaagacgtggtatgagtactgcatttgcagagtattaaaacaaaacaaaaaaacttattaaggaaaacttcatgaatatctgtctgaaaacagtagattagttctctcccttttctcaacatccttaatttctacccccttatgaatatgtagcttcaccagcttttaaaaatgtatattacagaaggaaatcacttctataatgaatctagggaggcaaaaaatgtaatggggagaaatgggaagggatttaattgggagaaatggaaacggaacaggatagaaatttgacaattttgggttggttgtgggggttgaaaaatgagaacacatggacacagggaggggaacattatacactggggcctgtcggagggtggggggctaggggaaggatagcattaggagaaatatctaatgtagatgatgggttgatgggttcaggaaaccaccatggcacgtgtatacctatgtaacaaacctgcacgttctgcacatgtatcccagaacttaaagtataataataattttgaaaacaaatttgacactttttttggtactgttcaaattaaggggaaagttcattttattttattttcagatataaagtatcagtacataaatttttttatgtgttcattattgatgttcaaatttgagagtcctcatatcctgaggcagaaggaacatttccacggagcataacacaattctatatcctttattacttcagtggtttctcttctgttttctttttcaactggaaaagaagggcttttcatgatatatgatgttgtactcgaccatccagaaatatagtaaataacccacaagatgcaatttcactggagggtgatcataagctcttagagggcagcagtatttgcctcatgcttattttgcatctcatccattttgtagtaatccccacagatggaaaacttaattaaggatgatggggaacttagagcaggcactgacacagggaatctaagactaaaataccctgttttaatcagaattcagtttttatataataaagtgtttcacattttaaacaaggaatgaaaaatacaagcaaagttacagaagaatgccataaaataagctatcaagaatgtgagaaataaatcataaactttttgtgtaaatttgagaaagcataataggatggaggaaatttagcatgaaatacatgaattatatatgtgtagaaattagctgtgtatgtggtcaaatataagtgtgggtgctgcctttcttccaaatcatgtcaaagattttctggaaatgatgacgttaagggcaattagtatatgggcaagtgaacacattccagagaatcaaaattgcttgggatgacatcgggtactctcttaggctaagactatatgatgagtccttttatatcagctgccttttttacagtactttttcttctactttcctgtctgtgcttttttctttgagactgtcacatttcaattctttatatctctgctttattttaccatttcagaagaaacaccaagctaatgcttcctctaatctcatacctgccaataacactaaggtcagtgcaaagccccagtgtcaggaggaatagctctgttgcaatgtttcaataatggcaatgctttgacaagcacatttgatgagtttcctacctgttattttctgttatcagaaaacaaacacaaacaaacaaaaacacctttttgttttaatctccaagactgactaaagccttatctttctctcagtcttgttggcctaggcacaggcgagttaacggcactatttttggtggcatctgtgagccatgtcagtgctttggtcatgcggagtcctgtgatgacgtcactggagaatgcctggtaagtgctctcttctttggggatgctgattgacaaggctgaaatcacctcgacagatgctacaattcagctactaccctggggaccttaaacacttgagtcaagaagtgctttgacaaagatctttgtattgaactgaattggaactgagaatgctctttcatatgtgatctccctaatgaatatgaggaagtgtttattcatattaaatcaagaattaaattagaatcagatatatttttataaggcataacttctgattggaagtataactaccatgaatatatatggtttcactttcttccataaatctatgaaaagtacagtgtacttttaaaatagaaaataatttatatccccataatatgaaaagtgtaaaatataacctttatagtaaacataattaagttttcttcatgttgaaaatgaaaacatactacatatttttatttaaaatgttcataatttaactaaatgcatagtgtcatttgtagattaaaaataaaaacaatatgtaatacatattcaccagagctgcttctcctttgcaattaagtctaagctttaaccagaaaataggctttacaaagtgcaaagcactttccatcctgctaagaaaccttaggattggagaattacactgaatagaccattctgattaactcaagggcacattagttttatattgtctgacatggcatgaagcttgaaacaacacttctcctttcattagtcttgcagaaacacaatttaaaatggtgccaattaaggaggatattatactctcatttccctgaagaatttaaggcggattctgttacctgtaattcttaatgttctatctttctcttgctcattttcccccatttctcttctacttaaaagcttctgggaaaaatccaaaatgaaaattcagggcttttgtttcagtgtaatttggcatttaggtttgttgatgctctttcccttttctctatataagattttgtttaattgcattgcattatgaagcatgagagccttaatttgtggatcagtggatttttgaaatgacatttttatgaatagaaagactaagtgattttcattttaattatgccataagtcttttaaaatgtactttgggaaaaatattgggttacctttaaacacttcactaacatgcagtaggaaataatactcagcccaaaactgacatggaattgttttacttaccctaagaagacaaaaataagtatgtcataataccaaactcatgatgttccatatagtcatatttcatgaattcattaggataaaatcaaatcaaattttcatgctgaattcattaggatgaaagcaaattagtccatttgttgatgtgatatttctaaaactagaagccttttttaactaataaaacagtgtcattcagcataattttgagagaaggaagggagagaacagaccctactaatgatgcctagtttactgattttgtttcatgaacagggagataggaggtctccttcaaataacagagcgatcttgaggaaacagtggacatcttgatgataaagacagaatctggtgtttcctgaattttccatcatagctagtaaataggtgatcatgtaggatatactgactttcaagtgccctttctccaaaattgtattgataactaagtgctgatattccattttgagtatatgggttctgatacaatacacaaagaggagaatatttgaatgttgctcatcaagggcattcttactgttcagctgaccctgcattttagcttcttgtttatttttcatggttttaacccagcattaagtagcatggtttttagcatgaaaaataaatttataaatttataaagcttaacttgctttaaaatttgattataaattatctgaaaaatatttttggcaccagaacaaaatctaaacttctgcaatagtgtaggtctatatttaaaagacattttaactcaaagtccatttgaagtaagccaggaagtattcaatgtcacatgggaagatttcatgcttgcttcttctcatagttcttgtggtatgtaatgtgagcaaaattttgtaaagcactttcgtaacaggacacctgtaaaaataaccaatccatcagagtgaagcttccatcttttttttttttttatttccattatataggttgtctgatgcagttttctggtttccactacaaaaatacttgagttttaagatgatttttatttgatgaaacgtgacattagaaaatgtaagaactacatgttatttgtcttttaaatcaataattggaaataaaaaaccctctcaattatgcaagattttcagttgaatgttagaaataccattttcaacatgtttaaggcaaaattaatttttgattcaattttttaaaacccttaagtatttgaagacataattttagttgtatcagtgagataacatgcaaataattttacaaaaaaacaagcaattcttcagtaatagcttagtttagctaaacttaaaaattgaaaggaagtaaaacaaaaatcaaatcggggaaaaaatctttcttcaaatggatccatgttttgcacattaaatcccaatatactgcattattaaggcaactattcatagtgaagctgaccttaatgctatcttttaaaaagttttgttaaaaataaatttgagaaagaattttaaataacttagagaaaagcctgttttcaaatatcaccagttactacagaaatacatatccacatttagttgatgaaattggcacgtgatgtttaaaatttttcaattttctccatgtttaattatgagtcaagcaagcttctcacagatgtaatacagtagtgcattgtccaaaccatcagagtccactgaggccaaaattcatgtctgagctaagaggccatagccccggaggatttctatgattagccacagttcccattaaatcagcaatttcaagctgaacaattgatttttacctagaatcagctacaatttccattaaacatatgttattagtgctctatgactacacacacacacacacacacacacacacacacacacacacacacacacacgcaatatcatgtattttcttaaggaaaataaagaaaaaatgaagtaagatttgcataatgaaaaacattaaaatgaatttcaatcatctttttgtaagtatgcatatgctgaaactactgtgttgtttataagctagatattaaattaactttcaatgctatttctctgctgtaaaattgaccatttaacatggaaaaattattcttgctggcagggagcagactaatgacttcgtagacctatttttggcaacatgttgatccctgacaccaaaataataaactctgatgctcatttctttctcagaactgtaaggatcacacaggtggcccatattgtgataaatgtcttcctggtttctatggcgagcctactaaaggaacctctgaagactgtcaaccctgtgcctgtccactcaatatcccatccaataagtaagtaacaaacttaccccatgaataagctcagcatccatttctgcaagtacacttttcatagcaaatatacacttccttttatcccatgtaaataaataataaacacagacatgaattttttcaggaaaattatatgaattttttcaaacctaagatatttaaaactatgaggatttctaagaatttgtaatttttttagctctagttttggtgatttaatttctaagagtagaactcaaatagaatttctacaccaattccaaagaacataaatattttatacaaacacatacatgtgcatgcatgtacacacctacacacagacacatacccatcttcataccttaataaaaggatataaatacagctaatttgggttctacccatacactatttttttgtgaatcttgggcaagtcgtaaacctctcaaaaagtaaaatgaagggactgatttaactgacttttaagtacccattctatcccttctttttagaaaaattcgttgttcacctagaacaaccacctcttagagcagatttaaaaaaacaaacaacaacaagaaagaacacttgacttcctcatttccttaccttttagaggaatgctatatccagctgcttgaattcacattccctcagggcagcctctctcagtaaacagctaagcacaccccaaccaaaaatgttgttttgtttttaaattgggatactttttttttttttttttttttttgagacagagtctcgctctgttgcccaggctagagtgcagtggtgcaatcttggctcactgcaagctctgcctcccgggttcaagccattctcctgcctcagctggactacaggctgtgttgaataaaaatcaacaatttttactcaaaagtgattataaataactatacttttaaataaaaggaaattattttctgaagaactctcttaaaggtgagcttagtgcttaataaggttcatatcgtattgtacactttccagctatctctaggcactgtgacaacactgacagagcaaaaattttcaatgatctttaagggaaatctgtcagctatagtcttttaatgtgtagatgtgatcaagtaggtcatacttcaaactcttacccagaatgcgcctaattaaaatggtcttttgttagattcaatgaatactataagctaaagactttgagataattctaacattaagtttaaatgttctccttgaaactgtgcttcctactgttaatccacatgaaatgcttatcctcccaatgaccttctttactcagaattttttaccttactcattgtttggaaaagaagagaaagcactactatttaataaaagcagactactatattctaggccaaacactgtatttggtattatttcaccttcaactataactcagtaaggtagatattattatcctcattgtatagattaagaaatgaaggccattagtagaaaaatggcattatgatgccaattctggagccagactctttggtttaaatgctgggttccatactttccagctgtgccactttaggcaagtcactgaaactctctgtgcctcaattttgtcatcattagttataataggactctcatagggttgatgtgggaaagacataattaaaatgtgtaaaccacctaaactgtgactggatatgatgaacccaatctaagagctgattgttattaacctgctcagagtcataaagtattaaagtatcagagttggaattttagttttaaaatccatgtgctttccaaatctctacggtctacaatgaagacttctttaaaaaaaaatacacactgcattttaagtgataacactaaaagcagtaattaattcattggataagtcaatttatctagcaaggttttgagaaaataagacattggtttaatgcaggggtcctcaaccatctatagcctgttaggaaccgggctgcctagcaggaagtgagtggttggcattaccacctgagctcagcctcctaacagatcaggcaggcattagattctcatagaagctcaaaccctattgcgaactgcacctgcgagggatctagcttgtatgctccttatgagagtctaactgatgcctgatgatctgacgtggaacagttttatcccaaactcctcccctgcatctgtggaaaaattgtctccaacaaaagaagtacctggtgccaaaaattttggggaccactggttaatgtatgttagtgatcagaacatttccagggcctaaggcatgagcctgaatgggctcaaaactgaagattctttaacaaccaaggatgttagagaagaggaagaaggcaagagagaaacctgttggaaaataattactataggagaacaaatgaaatatattccttcataattaaaggctactcaagcctatgatagtcataacatgacacaaaacctgcactttggtatatatgcgaagggttagatcacccaatggaagacctacttgtttgccatggctgaatggcattctcttaaccatcttcatttacatgaaactcattgttcacgactaacttgcatttgaggaaagcagaagtattgcatctggccactcgtattgcatctccttctcagccaagatgtcatgagcattagcaccactatcaatccagcagagctggctgcccattgcatcatgtgaattccagctgaatacatattagaattatataattgattgagtatgcaaaccctatggatttaccctcaagtctgaccaacattactataaatgcagaggaaacattagggagataattttgcttggataattataggcattcatgacccattgttgtctctttatttgttgtgcatttacttggataatgggttctaattgttgttcctgaaaaagaaagaaagtctgcaagcattaaaacacaatccatcagtgccaaagggattgggtttccagtgtccaataatattatttcctaaaagatgtatattctaatttggtataattacgttgatcctgatttttaaaaatgcatataacacagtgataacaataccagtaacaccaagtatttaatgattctttcattttcaaaatgttttcacttagagtaagcaattaataattattagtaaatattaataattaccaaattatcaaatattaatataaaatattaaaattagcaaattactaaataataattttacttctagcagtagaattgggactagaatagcaatttattttaaattccagctttcaatgtggtattttaacaagtagaaagagagggcagtgataattcacttagtttataaatcctagaagttttgtgagagggttataatgtcttttacatttaaaacaattttacatttaaaacaattttacatttaaaacaactagaaaattatcatggtttagttgcacaactgtgatgagaaaaatccattttcatctaacaacctgaaatgtttaaaaaaaaaatcactaaacaagacacttaatgacctagggaaactatcctttttaaaaatattttataaaaaacattactgttataatgtgagctagaaactctgagatatgaattgaatatttgcatacaatcctgaagacgagattttaatttccacaggttattcagagaaaaaaaaaaagggagctaaaggttgacgcaaccttcatgggaagtctaaagcttagtgatagttttaccttggtgatttatctatttaatccctggtcataaatcttatagatcacaagcattttggctccaaatttcttagataatattgctaaataaatcaaatatgtaagaagatagagatagattggtataattattatgatgtatgaatacagagaagcatataatatttaaattatacatatatatcaacttcatcaactatttatggtgatcactatgcttggccttctcatcttgttgatgtatatattctagctataggttgtaactaggcagtaaaagttatctggagagaagcaaataacaatgtaactatttcgaatgtttatattctttaatttctggcatcacatagcttataggttaaataaaatatgaaagagacatgtgaatctctgcctttgaatacttaggatgtgtttgaatatataatattattgaagttgttatagattttcatcagttatataataaaatatattattggcacaaggctggacagagataggacctcaataagttctatctactaatatcactgtaaatactactggtttgtgtgggtcaggaatgctgaaatttaagtttttgaaagaatgaaactcaaatttgagttgacctttgggctcactcaagagatcatattgaatgcacgttgttaaaattaatatagagaaatgtattccaagacaataggtaaatttaaggaaacaatcaattcagccatattctctagaaaattgagaatgctctagatgttttagtgctctttcctacacattgttttatgtgcacatgggagattatgatgggtcttcctggttccatatgccaaaggaaaaaactaaagttcagagaaattaagtgccttgatagtgattatacagcttgcttgtggcagaaccaatattggaactcatatattttgactcacctctctgtgcttcttccaatggggctacagtaatagaaacaattacagaaacattgaaaagaagcaaaaaaaaatcaatagaatttaatgtcagacaaactgtaaatgttcactgtaaaaatcagtaaatcttcactgtttggcaagagttatgttaattatgctacatagttacagttatattaacagctatgttaatataagggactagagcaggatgagaaaactgcagatttaattctttaactattaactaaatacctttcacgttaaatcaacatatcttattttgtttaaaaatttgtaaaaaaaaaaaaaaaggcaaagttttttaaaaaattaataagtcgtatctataatttattatggcaatatgctttcatactttttcagtataaaagggtttatcaaatcaatcatattattccattttgcagaatgggaaacaggtttagagaaatatatcgttcaaagacatacttagaaaataaatcaagtctaattaagaaatgcaattgtggagattaaatcagatttcatagtacttaaaggtaattaaagaaataagtgtttgcttaatgattctcctgagaataagtaggagagatcattgaactgaagaagaaaatacttagaaacttcagaaatttatgacgctaacaccaaaatcatgaagtaaatgaattttttctttttctcctcttcctctcagtccctgccccttttcagttatgtgtgaatattctcattaccctcatctccagcttctccactgacattgtgtagccactcaaaatggtttctcttatcctacccaactgttcaagataataattagttgaaaggagtcctgatcccctgttgtgtatgcaaatacagaacatgccctgattttctaaccctaatgatggaagttttaattttatacccatgattaaaggagtgcttgttttatatcacatacaatcccaagaagcaattcattatattttatttcaaatgcatgacagttaaagacacacaaaatattctcacacattgacttaatatgtgtttaattttattttagagtattggattaactctctgtgggagcatttaacgttagaactgaatttcaggacccacagaaggacccacagaagaagtttccctaatgtctgataatcaggaattgttgagcttctattgagcaattgttttgcttttggcttctggctgctctgaatcatttacctgttgattgttcccttttgcattagctgtgaaaaacctcaaagccaaatgttgatccacccttatcaaatgaacatatgttataacatgcattttgaattctaaatacacccttaagtttatcttttttttagtatttttttctctttaaccttgctttattcttaatgcacatattttgacagatagaattaaattctttttagaacaaggttaattgtttctctatgtatgcattcacatacataaacatatatagattgttgacatagtcacatgtatacacatgtatgtacacatatatatgcatacatatatacatgcttataagtagattataaaaataaaagtatatattcagccattaagagggattattttcatgtccagctttttattggttatcccaataacagcttcccctcctcccctatttgtggaaaatgcccgctgctcttggctttcttgtgtttcctgtggcgtggtttggataatccgggatgaagaacattttctgctggtgtggagctagccaaatagagttaaatgacataatcttggaatcacttgaggtcaatgatgatctcacaatttcctctttgtgtcacggaacaattagcttcatgtcttggccaaaattagtgctaagtgactgcatttgccaaggcaaattctgtagatgttttttattgtgcatgtttatttctcactctaattttatttttgttgttgaatgccatcttctgccatagctgtaactgcaattacagcaataagagagtgaatcttcagtttatgttgttgaaagaatatcaaagcacaaatacagatatattttatgagaaagttttatttggatgcgttatgtcgagtatctatattactagaaacttaaacttacttaattcttaccagtaggtttcaatgacaattggttataggaagaagagaatatcacattaagaatctaaagtcctagatcccatactaaattctcctggaaattttgtatatgaccttggttaagaaaaactgtgcctgccctaaccagctcataggattttgtgaaaatgtgataaaattgtaaaagtattctgaactgtaaggagctagtcaaatttaacatatttttattgcctaatttttttctcgaaaaagtgttgatttttgtcagtgagcaccttttacttatgttggttttaactgacatgtgagtgtatttaagaatctgaaatctattttatgaatagctttaaagtgtcaaggccaggtgcaatggctcatgcctgtaatcctagcactttgggaggccaaggcaggtggatcacttgaggtcaggagttcaagaccagcccggccaatatggtgagaccccatttctactaaaaatacaaaaatgggccaggcctggtagcacctgcctgcaatcccagctactcaggaggctgagacactagaatcgcttgaacccagtaggcaggggtttcagtgagccaagattgcaccactgcactccagtctgggcaacagagcaagactctgtctcaaataaaataaaataaaatatttttaaaaatgtcagaagccttgtcaaccaccattgacaagagttatgataaactgatttaggattataaaaaacaattggtatggttttctttcaatcagtgtagtcccacagaggtgggaaacccagtgcttctggttggagtcagtttctcagtagatgatgagatagttacagaatgccaattttcaaagaagacatatatatgctacagagatgcagttctcacttttatgtctgaaaacagtaacagcaaatcaccggatgtggatgagaggaaatcctttttttttattttattttaacctgtgcatcttcagtgcaatcacaatcccgtcaagaaaatcacccatagtgaactgtctttgggtcatgcgtagcaaagtacaggatgctttataaaaggagattctttactcgcagtgcacacgctgggtatgtcttgtctgctgttcatcacagctaccagaactccttaatgtggaatctttgatccagataatatttataaattcaaagcatcccagaccagcctttatctccttgacccagcagattcatttagactttccactgagttgaaatgtttaaaatgatagacttacctggtcctaataccttgctagtatcccaaaaataggaagaactattaaatctttacagaactaccctgagttaagccagagaaatactattcagaaatagtgttcatgatctgatctgcaccaaagttaagaaagtatttcaaagtaattcaagtgtcaggagcaggatcaaatcaggacttggaatgtttaatttgttgttatgtctttaattcatttagccatcaagcaagtctctattgaattgccctgtcatatataatagaaaacaaatctacttagggaaaacataataagagaaagattaattgagggcatttccctttaaaacggtagcgcaacagaccttacagaattcaaaatggttgatggcccttcagagagccagtcgagaacgcattaccgtgtgtcaatcttggggtaggggttcatgtatgagaggtgcctctcacaaggcaaagaagcatggctggagtgaaacatgttgctgaaagctaaagctagcacctgagttctctgttggttcttcatctggtgttcagctctattgcttcagacccaaattagaaatatgtgcaaagagagaagtgaattttgaaacatgccagagggtatgagatggcaaggttgcttttgtttggttaggtttatgataagtttaggtagaatatgcacacttgatctcttctgaaagctttcctgaggattccatcagtgtgagggcatacctgcaaggaagcacatgccgcagcctgcacacaggcacgccccactatggcagtagctgaagaaggaagcactgccaccaccactaccacatactgagatttccaaaatcactaacaaatttctccaggctgcttcaaattcagagggatttggctacagaagaaagtatgtgaggctgcatatgtgccaggcctggaggaatttctaaaaagcagctatacatttccacttgttactgatgatcactactcagagcagtcgaaagtcagttaataacatgtcacagggatactgctctccactgggctatattcacgtctgcagaaatagcaatgtcatttcatcctccattggccagaccctaatctctgtctctggggtgagaatgaccagcctgtactcttttgtcagagcagtagtggagagagagaaatgagaaaatgctaatgactttgtgtatgtccttcttccttgtccctgttttccgcaacaacatcaacatagctttagcccaacgtgccatttagaccggagtcttggattgatctgtgatggatgccctgtcgggtacacaggaccacgctgtgagaggtaagagtatactacactgtcttgcaaaatgatttctaccttgggagttataaaaccgcagatacaatcatcctttgcatcatcctttggagaaaaaaggccacactcaatgaggtgaaataaagtttctcaacgcacttgtcaaacaaatgcattatatttttgtaatttatttatttttcagaaattgcttcataaatcttcattcactcagagaatatctgattaatgttttaatcttaaaggttaagtattaacctacaatctttgtagaaagcattgctcaagtggaaagtcatgcactttaagatttatcttactgtctgtgtaggcaccatttatttttcataattagctttttgtccttaaaatgtagcttaaatgcatagttcatagttcagcaagtggttcataatttactttaaatatacttgaaaatagaaacaaaatgtaatttattatcatgatttatatcctcttctaattgctcctaaaccagtattttaattcctgttgattttactgggttgctttgcagcagaaacaagagtattattttatgtaatttgtgtgattatatttccttctgaaatgtttttgaagaaataattcttctatatattcagcctcagcataaaagtgatacaaacttcccccttgacatcattgccaaaaacaaaaacctccctctggtttcagcactggaaatagtccctgctgccacccttcctgggagggaggggtgcaaaggaagtgacctactttcactcatcatcactgaggctaaccctgaagagggctgtttctgcccgtcttttcctgtcatcttggcagctatcacccctgtttcaaccaggatgcataaaattaatgaagcaggagcctatcacccagagagaatttagctagcaactagcagtctgtggacaaagtgccaatgacagttcctagcagcaacaagtactatttgtgagtatggaagcatctgtaaattaggaatgaaagaaaaaaaaatgaaacaagcagcatttatttgcaatcaagaaactagatatctttaattgtgtgtgtgtgtctgtgtgtgtgtttaaagaaaggcatgtgcatattacttactataataggagaacatatcattgccaagacagatttacatcaagtgcctaaaccccccagttcactacaggcaacctttttttagcaactggaaaatgacagctgctctgtcatacaaggctattaaatccacttatctaggtgagcataatctctgatgtacttatattgctttgctttatgtactatactccctatacatgttagacaatagtttctgaaccatctataatttaaaaccctacattttatttaacaaacatctgtttagcaactaccatgtgctgggtacaaggctagacattggatataaatagatgcattttcccatccttgccctcagcacctcacatctttctttaatgcaagtgaggatggttgcttgtattcttgggagaattccatttgaatagtaaaaatcaccaaggagagaaatacctgacagaaagtatgatttcctgtctaaaatctgtattaatctgattcagaagatggcaacatgcatatgcagtgtaatgaatggcatattttatctccagctcaagtttttccacagttgataccatatttttctagccagaatttagattagggttttccaggaatatttaagatttataatttcattgtatttatgtaagccaaaagaacaccttagatagatctaaaatatgagggaaacattttttgtttgagatgtgcctgttgaagtagaagagagggaagataagggtcagggtaaggaggagatactggttgcattaaaaatcttgtaatcaaaaccattctgtaagtgatttgtgtgatcagcttatgcacatcatctaaataagaccagaatttaaaaactaaatcaacatttcccaaattgtagatgttcctggaataaagaattctgtgatcacatgagtttgggaagcatccatttgcatgttaaaagttctggcatgtcctacagtgtgtaattaagaaatctgttcaatttgtttagctcagcatttcctaaacttatgtggccataaaccctctgctttaactatatagcaagaatatatctcagactacagctcaggtgggacaagagttataactttatagtctttatcacaatttaatttctattttgagacccctttctctatatgtgggaactgtgaggtcttagaaacataatctgagcccatttcaagttgttttcttctcctctctcccagctagaatcaaagttctattaagcttacctagtaccaaaggccttatatgcaagggtagaggggagggtataatgtctgtgtgtatatgttgagcaaggggacatgtgatagggccagccagtactgagtatttcacccaagcatgtttctgctgacctatccctttttctccgtcctcctaattacctttcctttcaggtctagaaagtctctcaactactttcattccattcttagaggcacaggaatcattcagcttctttcattccatgctaagacccaccaacatctctaccatcatcatttttccatctgcctttccaaatccatcccattttctatttgaaaaaggatgagctacatttgtggaactggtggctttcagagctcggggtctggcagattcctatgtctctgccttttgccctgtcaaatcccttcattcaaacatgtagcacaagatggccttgcttcttgaatcgagggggtgaagagaaacagtgaacaggggaatggccaaacaagatacaacaaaacatggattggtattctgtcacaagttgaacactagttacagcttggaaaacattcacttagggccaaaacaccactatttttgaggtatcactgctttgctggggaatgatttaaacaaaggaaaaaaaagagtcagagagtgaggggagaaggtattcatgatgatacctttgctaagattctagacttttatcatctggacaagaggagaacaaaaataacaaagagacagaatcttgaagggctaaaagagattaagtaagcaattggaatatcaagagcaattaaaaagactgttgagctaaaagtgagtcaaatgctgaggatacctgcctgatcggacactaagttactttcagaataagtttgtaacctcagcaacatgtcatacattatggagaaggcatttcaaaaaggcaggcaagttcatctggtggattctataggacaacatgaaacttaatgggatacatagacttcttaagccctccccgctccccagctggcaaatttttaacaacttctccttaagtgatgagagaggggtcaaaagccaggactaatctcacaattgccactgaaaatgtggaaggtgtttgaatctaattgcttaatattttgaaaattcatctacagttttatcctcaagattcatactagatatcaaagaaattcctttttgtatcttaaatttcagttccaaaatcccatttagattttgtctgcttcagaatgtctgaattcgaatcaagtctaatcacccctctgcttactatgctcatgggaccttctattcacttgtgagtctccttgtgcctttgggtcctgaatgcagagcatgggctacagaaataacagaggaggggcagttatacctacctgtagtactgttagcaaaattgtgactccagttgaggtgtcaagaggccactcatatgtggttgtgcagtttgtacactgcacaaaggcactcagggaaggggaagattgagggcttgaatccagtttaccctcttcttttccatgaagtccctgggtgtctagtctgtttactttttctgcatatgtctagaaaggacaatttcttccaacttgtaaaaggcaccatgtgagcagggaaacaccctcagtcttttgctgattatgtcaaatgggaggaagtaagaacacagcattacagccacgcctctttatacagcagccaccctcttctgtgcctttgccaatactgttccctctgcctggaagattgcagccctttcactcctccatccgagactaactaatccctgttcagctcccaaaagtcagcactatcatcctgaaaatgtccttgattgggcctaatctgagttggttgcccttttgtgtgctgccataatagcatttgcatatctccagttgttctactgctacgttttaaaatgtgtgttcattctccatggactgtagtgtgaagactgtaccttatttgtattagtaccgtgtaaaagtgctcagctgattttttttaatgggttgggagaaaccagagcttttctaatttgcttggctagattaagccagcattatattgtttcattgttttcagtgtatagataatagaaatgtaggccgtgattttagccaaaagttgctgaaaaaatgatggggcagaatgagacaaaagtctcatcagtgtggttgctttcttctcattgttgcttgtctgcacgtccgctctttttctacctctccctctctctcttcctctctccctccctccctctaacattgttcctaaattatcaatagcagcaagtgtaacaaataactgcatgtgttatctggagtcttatttacatttaaacggccctttttcaaaatattgcaatttgatttgaaaaagttaacagatgtggaaaggaacaatgcctttgttatgtcaagatatccgtttctagcaaggcattcattcgataaactatttttaaaaatgcactcattctgccttgcatatgaaaatgagagggcttgacatttcacattacaattatttttggtggagtgaaaaaccaaaggactgtgatttaaactaattttaattaggtgaatccaacttgatcagactctaacacactatttttattaataaaagttatatgattagcagtattatattctctgaccctcaaattactttttaattcctaacggaacaccttcagaaatctctaatactgttctctgtatagaaacacacacccatacaccagtaatgtgctgaagtgttgcagaaaatagtcccactttcagtaacatggcatatgaattttctatcacgtatattcacaaattttccttacacgtcctgcaagaaaaaataaataaaagacagatgcttctttagttattctatttaattatagttattttcctcctgaaatgagtttttttattatggagaatttcagtcttattaattgctatctaagttaagaaaaattcccagatctcgttatataaagctatctctccaaagggcagtaactcatcttgaggaaagtgagctgaaaataataggttttcgtttgctgtgataatgatcattgtatatccttattccagtggcacaaagtcactctcttagtggtaaacaaaatgagatgtgaatatatgtggatgtgatcataagctctgaatattaaataagacaagaagaatcaggttaaaattcaaaagaatctccttcttatctttatcaaatgcctctcttgaagggattttgggggaattttgtgcactcaaattttattgcatattttataatacagaattaacaaacaattatatctgtggttggcaatattcttctaagcagtatttatacaactcataagtgtataaaatcttttgtgaatataagtaatttcattttaaaaattatgataaaacatcaaatctatgaattatagtacctaagtacctatacattttctagaaaacttagaatcatcaatgtatctgcaccaaattaatggctctgccccagaattgggatttgttaaagtactctcaatataatgtactggatttaaaccatttttatttcaaatggtagagagcctttctctaaataatgactgcatatctgtgagtagatgagcataaaagtggtgtactactgaggaaattatattctcccacattgtttttgatccccttcaattttgacacttgctgcaaaagactttatcttggtaagatggcaaagataacagagctagcctgaccataagattcagatgccctgttctgtttctcctttggcaaatgtggcttagtataaagtgtgagcaaatgtcattgaaagagaagacagagcagaatataaataggcgctgcctataaggacgtttctgcacacctgtagcagtaagttgcattttaaaacataacatttaggtcagagaaaatttgctgctatcgtttttaaaaatcttctttgccatgccctataaacaaacttttgtttttccaataatataatatattatataaatagttttatattatattatatttatataatatatataataatatataatatattatatttatataatatatataataatatataatatattatatttatataatatatataataatatataatatattatatttatataatatatataataatatataatatattatataatatattatataatatataataatatataatatattatataatatataataatatataatatattatataatatataataatatataatatattatataatatataataatatataatatattatataatatataataatatataatatattatataatatataataatatataatatattatataatatataatataaatagtttttggtaagaaagaaagagcaggagacaaagaaagaaagaaacagagaggaaggaaggaaggaagggaggaaagagggaaggagggagagagggagggagggagggaggaaggaaggaagcaaggaaggaaggaagggaggaaagagggagggagggaaggagggaaggagggaggaaggaaggaagagagagagagaaagaaaggaagaaagggagaaagacctggagtttgctaatagagttggcaggcacagttcagtatcaccttatggcatattcctataatatgcaggcatgctttctcagacttccctttagtaaagccttcaatgaaaatttgcctctgaattcatatgcaaatacatacaaatagattattaattcagatatacccacagctcccatccaattaataagaatcttctgagtcacagtttctagttaataaattctgaactcttattactgaatttccttgcgagcctgtttcctcataacaagttctggctgcaacaacaacaaaaaatgtgaaccttacatatttgtagagaaaataaccaattggagtagagacatatgatgtgttgtactacaaaggctttccaacatggacctggattcctccagagtgccagcagcagattcttattatgctttggtctcattttcagtgccagtgacaagattatatatttttttcgggctgaaatctaattactagtgggctggcaggatatcatcttgtatctacactgcagttgtagaaaaacatttttttaatcacgttgcgtttgagaaaaggaacacttaaaaggaaaatccatcatcctgggagaaggggagaatgaaaaatatgtaaacattgccccaactgaggtccccccaaaggctcactgatgaaatttcttgccttaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagcgtaagtcctgaactattgatgcccctgacagaattgatgtattgtacctcaaagtagctgatgagttcttgagtgtggattgaagagtaggaaattatgtggaatacatggttgatagatgcatagaatatacagagtctgcatattccagaacatttccttgtactaactaatagagtaaatacctttaaaattgctgtggtattgaagcatcactgttttccaaatgataaacatgtttttatttacatgcggaaggaagatttttttaatgaacttatgtccacagcaggaaagaagaatttgcatattagatagacaccatgtatccatttttttatctcaattctaatcacttgctttaaataattttttctgcccatgatatttcagtagtagccatcagaaggtgttaatcagttatgctttcatatgttaactttacagtgtcgtattttgtaataggtataaaattctgccaatattttcgcacacaggcatttgtcattgttgaatgattaacctcattttagtttcataatagtcatttaaggactatttctagaatgctctttcagtgttttccttccacaaaattagctactctagggcttcatccatattagtataatacatttctcccctctttaccttttttgctgtattaatactacatagaatttccaaatccttaatgtcagtgggattagaatatgaaggcggatcttgttgcagaagatcaaatggaaagtgaatccaatgttagcatttggccatcatcagcttcatttactatcataatgtttaagcagagtaggttatgagaccagcctatccattcatttctgtcaaatttatgtgagagactcttccaattattcaggtgggtcccaggacatgcagaattatagaaaccactgtaaatgtagcctattatcaactctactgtaagcaccaaagacccagtagggtaccctatttcattaagaaatgtgtctctctcatcacaggtttagaagatgagttctagctttttgttatttaataatgataattcattgaatcaaaaccaaatcactttctggaccaactggcagctgttaatataacctgtaaattgatctttttttaaagcaaaatttccaacagctcagtgcctttaaacactggattcctgacaaatgtataaaatcatagaaagcctaagaaattcttcctttcccacagatcatctaggatctacattttctagctgtgtgctcctgagcaagatatttgacctccttgagacacagttttctagtctacaaagagagtcatgaattttctgtggggactaaaggatttggcacatagagggtatccagtgagttcccaagtcctggagatgctcacacatggtagctgtctttggtagcagtgctcatagtagctgtgcatatcagttgttcaccagtgaattctaaggctaagttagtcatttactgacattttatcctgtcttccaataacccccacccccataaagttagggatattattccactaattttattatggtaatttattgtgggattattttattatggtaattaattattattttattatggtaattaattattgtagaaaattattatgggattattttattatggtaatttattatgggatccatggcatgaagtcttaagaacataaaaaagaatgtgagaataaaaacattttgaccattaccagttttcatactacttgccgtgagtatagatgtgattataatttttaatgctctttgccatataatcacaattaaaagtataagaagcacatttattacttatttttataatttttcatggatacaatatcacttctatgcataagtggtaaaacctcaaggaaagaaagttcctggaaatacattattttggttacctatagatttgttcaagaaaagtacaccactacaaagaaatatattttgcattttaaatttgtgtatatcgttggtgtcatatttttccattaaaatgacactttagcaaaactttatactgctttgttgtttttacgataacattaattaattaccatcatatttatggtaaatttaattttgtagtttacactccaagaaaaagtgactcctaaagtctaaataatttgatattttaaaaatgtatgatatgcataagaaactttcataaaataataaaagtatatacaaattcgataaatcagatgaaaatggatatttaaaggaaaaattttcagcctttccttgtatttcagctatagactatccgtaggctctttcagtttctcaatggcccttactctagtatccccttggcagacactgaagacaaactttgctggaagataaattaagcagtttttagaaaagcagttcttttgtttgtttatttgtttgttttttaaaaggagaacctagagccaggagaataaaatattagcataggctgatagagtacctgtttatagcttaattttaggttgtgttcaaatcaaaatattcagaaatttaacaaaatcatctatgagtagcctaaattcccatgtcatctcctccttgtatttttattctgatataaatgcaattatatgtaccattaaaaatatagggtacatagtaaacaattaattactattctatttgtgaaaaggtcacttaagctttagactgatttactctacgttttagaataacctcagacagctttataacaaagcaaaaaagacaaaagattacttaaatgaaatatgttttgtatgtttggagatagcatataaactgtaaaataaaagtgattcttaaatgttataatgctatagtcttaagatacttgaaatgatgtttttgttgtcttttaaacttctgaatcttaaaaaaggcataaatatttcacctcaaaccattttttaaacttaacacaaaaccggcacacagtaaatcattaaatcaaaaaaactaactaaatttttctagattaatagtaacattaaaattttgccaggggtgctattaattttgaaaattcctcaaaattattttagttctaaagtcagtatgcattacttacaatgggataatagtattttaagtgttaccctgatgtatctgtaaagaactaaaacagcgttacaccttgagtcaagaactccaagttcctgtcacgttctggactcacctatatgacacagcaggcatgtggacttgtataagctatggcttctttgaatttcagtgtcttcatgctcaaaattggaatgatgatgatgacattaatattttaatggcatatgatgggccagacatgatgctaaagcctttatgtgaattatccctacagcttgtagagttgttatagggattaaatgatagaatgcctaacagggcacttaacaaatcagaaaacattctgttactgaacttaggcgtccatgttaccatgtggggtatattattatttaacaagcctattaagactattagaaagttttcctgatcacaggtctctcttctctttgcagcctgtcgctgtaatgccggtggctctttctctgaggtttgccacagtcaaactggacagtgtgagtgcagagccaacgttcagggtcagagatgtgacaaatgcaaggtaaggagtagaggctgacccataaattactttctccttacagattttcactggcttttcatgacatgttttgtataccttcgtatattaaaaggaaggtttgggattatctaattctacaattgaaatgactgtgatcagtgaaaagtttttttcaaactagaacaaaattcattgtacattaccatttgaccttaaacatttttttttggcagtgaatgtgtattatattcgctttaattcagacatttctgaaacaaatagcaggcgaatttaatcttaatctgtggagatactctttcctttgcctttacatttttggcagaataaaatgttactcttggggctgggcgcggtggctcatgcctgtaatcccagcactttgggaggccaaggcaggtggatcacgaggtcaggagttcaagaacagcctggccaagatggtgaaacaccatctctgctaaaaactacaaaaatcagccaggcacggtggcaggtgcctgtaatcccagctactcaggaggctgaggcgggagaatcgcttgaacctgggtggcagaggttgcagtgagccgagatagtgccactgcactccagcctgggcgaccgagtgagactccatctcaaaaaacaaaacaaaccaaaatgttactccctttgctttttagcaaacaccttcttctagttccatcatttaaaagctacttcctgtgagcagtctacctaatggaagtttcagtagagaagttaatcaagatatttttaaagatgcattattttgctaaaacaaaatattcaattaaaatacagcatgttgttctcagtccctgaacataccgattgccctgctttcagtatggcaagcaacttcagattcctccatgagggtggacagatttgctctagcgctttcacaaaaatacattgtatttgtgataaagacagctaagcagaagcaagcatttctccgatgtcaaactggccttactgtaggaagtttgaaaatatcatctgcttctgtctcttgaataatatcattgctctgttttgtttttattttattttatggttggtttttaaagcccaatatgtggcgggatccagagaagcgattctgtgtgctatgtgactgcgatcccgttggctctgtgtcaccgcaatgtgatattacaggaagatgtgtctgtaaatcaggcttcgtagggaaacagtgcaacctcggcaggcaggtgcaccaacaggaggagcagccgcggagagcgcaacgggtgctgggttctcctcagaggtgggctatcggcagctccagcgggtgccctcggggagcctatcgggccccagctccggtaatcccagaggcgctgcatggctcatgcctctgcatgttgtgttctgtgtgctgtggctgaagttccctggtggcattttaccaaataacagttgctaagtgtgcaaattgcaaatgcaaagattagacaattcctaattgaacccttgcccttttaaaaataaccatccgtatgctttaaaaagcatattcaagttcatagggtcataaaactttcaattaaccaaactttcaattaaccatgaatatgtggaaatcaaataaaaatctacttgagagaacctataatcttagaaatggaagagacttcaggcaacctttggggaaagctaactttaataaatgaacaaatgaaggaaaatctagcagagaaattgatttgtccaagaaaactcagcccatttatcaggcatttcatcataattaagaattttgttaatttccacatcaattgtgcttatgtgtacaacaaatgcaagaaacacattttcacacactataaatggacaaatacccaaaacggggaaagttgtttctaattacaaaagtgtggttctcatatcacaggacaaaacaaaacaaatgctggggaagaaggaagagagggagggagggaagaagaggtcccaggctgagctgcagaagagtaggagacaagacttaccagtatagagtcaggacctgtagagaattgaggatagggcatagaagaaggagagatggaaataaaaagtaaagaagaagaagtaaaaaacaattcatggttttatttcttggctcattatcacacattttttaaaaaacaaattttgatgtcagactgccttagatcaaatcctggcctcattacttcctagctataaattccttgaatctttctgtaattcagcttcttcatctgtagtaagatccacttcagagggtttatgtctgcttacgtactccaagaagcaaatgccaagaggtttcctgggggaaaggccaacgaagcatgaagtgggagacagcatagccttctgctgcaatggggttctgactcccgggaaaacacagaaagaaagactgggtaggaaaagccttgtttggtgcattttgtcaaatcttaaattcttggccaagccaatgggatatacccaagcaaattttacccactaaaggaatcctgaattggtcagggaggttctagtatcttacagtaatcagcctgagagaaggatactcttgtggaagctcatcttaattcattcagagtgctataagagcataacatagactaagtggcatgtaaacaatggaaattcatttctcacgattctagaggctgggaagtacaagatccaggtgctggcagatttcctatctagtgagggccctctttctctagacagtcatttacccactggaacctcacttgggggaggaaactctctgaggcctcttttataagtgcagtgatcccattcatgagagctccattctcatgacctaatcacctcccaaaggccccacctcctgtctataccaccaccttgagggttaagatttctacatatgaattttgggggacataaacattcagtccattacagagcacctctgatgggtccaaaagacaagaaactggaggctttcagtcagtaaaattccacactgtaggttgtcttgcaggtagatcggatgaggcgcctccaaggctgtctcagggtagcagtgagaacagtgcatcaggcaggagcatagagagtttttagtaaatgttaggcctgattactattattattaccaatgttgttaaatgaagaaatgtttaaaataattttttttcaaaaacaaatgcatacatttacaataaaagaaaaagataataactgattaaaatgtctcctaaatataaatttagcagaaagtcaacgttcattcaagccctacatatcttacagtactattgtatgaagcagggttttgtcccgagactattttttcctctgcagcagtatgtgtgagagctgagagctcagactctggagccaacctagctgatctggaatcttgactccacaattggttagctcatgaccttaggcaacttacttaacctttctgtgcctcagtttcaccactcaataaaaaagtggtgagaatgacaactctctgccagggttgtcctgaggagtaaatgagtacatatttgtaaagagtttagatttgtaaagggtttagaattgtgctttgcaaaaaggaagcacaatatatgaatgctagttcttattaccccgagagagacacatttatgggaacctatacagtttctcactgggtctggatagccactctctcccatatttattttacctcattaatctcaattactgaccatgaatgtctgctccttaagtttgtttactagtggggttttctttagcctttgaaacaaatttttgaacaaatttgtaaacattttattactgaaatttggtagtatttattttgctacaacttagcctttaaagctacattatttaaatatttgaaaagtgaggtagaaccgtttcttcttgtatatttccttacataatcgactttggaatttttaaaatgatagctataatttggaatctcatttgatatttgattgatttaaaggggtgtacacacacccctttaatgagtaaatcaatatgagagtgtggatatatagatgtaaatatatatgagtaaatgtatatatatatgagtgtgtatatatatgtgtttatacatatatcggcatagatatatgagtgaagacaatttctgaaataaagatgaatacaaagtattatttctatgactcagatatttttcaataccgttttaatatattatgtttagtctttttgtctatgtatttctgtttctgtttgtgtgtctggtggtatgggtatgtaattgaaatttacatagtatttatatagtttcatatttttgtttaatttctatttcatgctatatcctaagcatatttatatcattaaaactgcttcaaaacaggattttaattcttgcatattatttcataatgtggatgtcatcatttaatttattcaacaatttttataacattgtacagttaagtgcctgcatagttattcaccatgataaataatattgtaataggcatgcttttgctttaataatattccaatttctgattatttctctaagccaggtatctaaaattttacatgaatttcttttactaataatgatattatatggttagttttttttatataggtgaatttaatttcaaagtcatgtcatctgttggaactgttacatgcttttttctttaatcatataccacaatctgaattagaactagaaataaaaataaaaccaacagtaaatgtaaagatgagaatgatcgtcaaactcagtcaacccattttacattttaaaaataaaactattcttagctacggtcattttaaaaatctaattttcagtgtgatttcacttttataacttatttttaaaactactaacaataatatctaaaatatataatgaggcttattaatttctctttgggtggctcacgttaagtggcaagatttttttttaccaagaagcaattattaagtctaattttccaaaataagaattatttttacaaagaagtaattaccgagaataattttccagattaaaatatcataataatgtgacatgctttatatttttaaaaaataaccctgaagtattttaagcaggatagatgattttcatttttctgctcggagtgattttttaatccatcagcattttctaacgtttcattttaagcctgataacatgcatttcaagaaagtcagccgaagctggtaatgcaaacttgaccgtaaaagatgatttgttatagatagataagagatatgcatatgaataactcatcagagaatgaaagtttacttacctgatctggtgctttaatacgtgttctcactaatcaatttcaattgttagaatgaaacctaagaaatcaaatgtttgttgaaccaattatttgatcagtgtaagcataacctgaaaattatatttataatgtgaacactatagcaatgattaaaagtatttatggatatgtgacaaaattctatcaaatattagggcaaaaaggattattttaactttaggctgctggtcaataatgttgaaagtatttttaccaagtaggagtccatagatctgaaagtaatcaattcagattactaaaaatgaagaagtaaaattttaaattaagactagaaataccacctataggtcctttccatattgctattgaaatcttgagaagtactgggacaggctggtgaaaatacaacagacagtaaaggaagcgcctaattctgcagttaattttgataaaatttcagaataattgaacttttctctttggatatcatagaaaaggtccatttgattgaatgaaaacccaattgtcataacatcagtgaggaatcctgataactcctaagttcctctgttcccacctgatctttggtattgtgcatcttgcttcacttcgagttaactgatttaaatttaatttttctctcctcttccattgccaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacaggtctgtaaatatgacttaagtcctacatattcactctgatagttttagggtctgacttctgtaacagtttgttcttttaaaggaagcacagattgatacaacgtatttaacataatgagtaatgtctacttatttttacgttacttaaaaaatgaaatacatgtcagtttgaaacactgccttaataactgtgtgcaagtactcagtaaaaatcagcagatgctcgtttggttgtgtccctccctgtctgtgactttgattcagccagtcactcaaacactgctacggcttgaaagttaaatgttcgatttttctggtaccagtcttatcttagtttaagctcaaaccccacgccaatgcatttcaactttccctttttcctattgcaaaattggtatccggatcaagaaaagtcaaggtgttttttttttcctggtaccccaaaaacatcttttcatctacttttggctgccttgaaaactatgatgttctaagagagaaataggttggctctagatatttagttcatcaaaaaatgcaggcagaggtttctaaccatgattccctcaagcagtattcttatacatccagccacagccttcacccaaatcatgagctaagaaaatatcacttagcattctgcagatgaaagtaaagagtgaacattagccttgatttatatgctgctaatttcgaactgacccttattccaacaatcactagtttgaatattacctttgtttactaatgtcatggattcaacctggataatgctcacatactctcagcaccatggtaagattttaaaacattgttattcactgttgtggcaaatttaagtaggaagcagtaggaataatatttaaaactatttaaagaaccaatatctttcagacattctccagcactttagatatgtggattttaccataaattaagccatgataagttattctaattgataagttattctaattgataagttattctaaatgataagtttataattgtagatcctctaagaatctgtatatctctaagccaatatctgtataacttaaaaattataaagctgtattttaaaatatactctgttctttaaatccaaagctcactgacatttttacttaatatgaattaatgaggtagtattatacatttaaatacatatagtaacaaattataaatgagaccaagaatattattttaaattatagaaagatgacagcatttaataaatgcagacctactagcattctggcccaaagaaacaccatagaaaaaaaaaagcacaaaacaggaagaatagtaatatgactgaggacatgacttgcacaaaatagcctggatttgtctaaatggctccttcagtaactagttctgggaccttgactgagtaattttgtttcattttccatctgcaaaattcatctattaaattaagataataatagtatctaccacacatggtttttgttacaattagttgagttagcggctataaaatatttagagtaatgcctagcatgtaagtgctatggaagcatttatcattattattattatctttattagttttattaattgtgttatacattgtgctttggcacaggaaaactagctaattactcaggttttctttctatttagtgttatgattccgctgaagaactacttaagataatttctatttgcaagtaatgatttgcactgtcccatgacattttttagcatataaatttaaacataatggtaactatttttcttcttaatgaaggacacatctaaaataaatcatttggcttaaaattagcaacaacagtaataaccaaaacagcaatgactaacatttatttagtgtttactcggtgtaaagtatttttctaaacaccttccacagctggtgtgtaatgctgtgagcaatgaatattgtcatttcataaaaagtgaatttagtcaaatattctaaatatattcagtgaaaatgatttagtcatcatataaccaattaaaagtttactcataacattagtcttccatttgaattcaagtatttgggtttcttccctcacttacatttctttgacatgaaacgctgcactagaaatattcttagtagctgggtcaactgccgctatgtggcatgcattccttgtcttggatggctttgaagatattctcaaacattatttttgcaatctttgaaaaagtacaaaaggtagataactttgtaccctttgaatattgcatgatagcaacaaaaatgaaaaatctatagaaaaaagtcaggtggtaaataaaaatcgaaagtatctttatatataaacagtgtccataattcaaccattttaaagtatttgcaaaattggattattctgttgtgtgcgtttctaactatatacatgatgtaccgaatttaagaagcttattaagcttattggtttttactgcagatcgggctcatcaaggaaaaactaatccgtacagcataaacaaattagaaatgaacttaaaataaatatacaaacaaaatagtaaactttgtagtacccgaatataaggtgttacagttaacatggaatctgataacaccaattctttcctttcttaaacttcataggaaagctaaaaatactttaacttttgaaattaataaatgaaatacatcttatatttattgaacagctcctttctgaaatacattgtactataatataaaagatgaatgaagtaagtttttatttccaaatatccttaagtgtagaactgaaaagaaaataagacaaaccaacacaatataaaactcaacactttgtgtcaaatttttactatttttccccttctttgttttccctcttataccggtgaagcttgtgaatgttctcatctgggtaataattgtgacccaaagactgggcgatgcatttgccctcccaataccattggagagaaatgttctaaatgtgcacccaatacctggggccacagcattaccactggttgtaaggtgagtgaaccacttttttgctctgataattttttggagagatttttgttttgtagagctctgtaattgggcatttcaaaattcaatattacatcacaaaataatgtagaagtattactataatgtgattacagatattaatcaatatcttacagtttacttgtaggaaagatgatgaagtaaatatacatttatgcagctgaacacttgaaatctacaagaggggtaaaaagaacaaaaattctgtaataataccagaaaagagctataacctcatacctaggcacaaggacatacatgtgcaaagtatgaggatatgaggaactaattaattttccaaaaatctatagaaattgcccctgaattatgactaggttttaggtttcaggaagtagttgagatcattctgaagagtcattttaacaacatttagcttggaaaataatcattttttcccattggtagaccatagaaattgacatggccagagtcatgttcagagagatctatctagcatcagcagggatggtaacaatttataaggctgttgaagaaatattaataagagatgccaaaagcctggacccagtcaatgagcgtcagtgaagatatatagggcgcgagttacattttagaactcaggctgatacagcctggtgaattcattgatttggggaataagaaagagaagacttaggatgactcctaggttttgctttgcaatggagtagatgataataagtaccatgtgcagctataggaattataggaggaggagcaagttcaggaaggaaagataatcactttgcatttttatcagctttttgtgaggtattaataaaataaaattcacccatttatagtaatgaattttaaccaatgattacagtggtgtaatcatcccttgtgccccattgcagtgaagtccccatcaccccccatgtgcctactgttttgccttctagcattataattttccaatttctacaacttctgaaaaatagaatcgtagtctgtttttttgagggggggtttgtttgtttctttgtttggcttccttcacttggtgttacgtttttgtaattcatccatattgttgcatgtatcagcagtttgttctaaaaattgcttaataatattccatttgtgtaatgtacagtgacttgcttacctgtttaccatttaatgggtgtttgggtcatttctagtttggggttacaattttgctgtgaacattagcatacaagtcaaaagcatatttatggacaaatgttttctcttttttttcttaagaacactccacatctttgccaactcttggacttttaacccttttttaattttaagaattctgatgcatgtgtatttctcttgtttgcatttatttaatgcccagtaatgttgggaatcctttcatttatttatttgtcatttatacatcttttttgaagtgtttacaaagcttatgcccatttctattttgagttgtttgtttccttagtaatgcattgcaaggattatttatatattctggatacatgttctttaacgtatgttaaagcttgcttttcatatagattgctttttacctagtttcatcatctaatctttataaacactagcttattatctttttcttctatagtccatactttttatgttctacccaagaaagacaaggtccaaagatttctctcccatgttttcttcaagaagttttagagttttagctcttaaatgtaggtttggattccattttgaatattaatttttctatatatcaggtaatggtcagagctcactttttatggatacccaatttttcaaacattatttgttgaaaagactatcctttttcccattgaattactttgactcctttgtcaaaatctatcaactatatatatgtttatgcatttctggactcttttctgcttcaccgatctattcttatgttaatactagttaatatgttaattattgtagctttccagcaagtcataaaatcaggtattgtaaattcctcaacctcattcatcgtttccaataccttttgagtactttagctcctttacatttccacataacttttaaatttagcatgtcaattctttaccaaaaagcctgctaggatttggctgaaattatattgaattgatagatcaatttgggaagaattgacagcttaaaagtattagatatcccagtgtatgaacatggcataactctgcatttttttaggttgttataattttttctcagaaatgtttgtagtttttgatgtgcaagctttgcatatatattgttaaatgtatccgtttcatattttttatcaaaagcaaatgctgtgttccatttcagttttaaattgcttgttactagaatagaaaaatacaattatttttataccttatccttctatactgtaatcttgctaaacttattagttctagtttctttttggtccatttagtgagattttcttgtagataatcatgtcatctgcaaagagagatttacttcctttctaatctgtgtaacttctgtggcattttcttgtcctattgtagtaaactattgactagaagtggtggaagcaaatatccttgccttgttccttagtttaagtggaaagcattgtcttttataattgaaaatgatgttggctatattttacctgtaggtgctttttattgttttgaggatgccccctcgtgtttttagtttgctaagagcttttatcaagaatatgtgttcaattttgttaaatgacttttctgcatctattgagatgaccatatgatatttctttttaagctgttaatatgacagattatactgattgattttcaacatatcaatccagtcttacaatcctcagattaatcctgcttggccatggggattatccttttaaaattatgttgaatcctgtttgctagcattttcttaatgattttggatctacgtttataagaaatattggtatgaacttatttttcttgtagcgttgtcgtcgggatgaggtactgcaagcttcatgaaatggattcagaagtattccctcctcataatttataaaagcgttttcacaatcaatgaggtagaaaacagaaatactttagaggaacccaaaagctcactatttgaaaagatcagtaaagttggtaatattctagaaaggttaatcaagaaaaaagagagaagaaacaagcaatcaaaatcacaaataaaagggggacatcactatagatcctatagacattaagataataatatggtagtaataggaacaagttttgcctaataaatgtgataacttgcatgaaaagaacattccttcttttgcttactttgagtttaattttctcttgtgttccaagtttttttgttttttgttttttgtttttgagacggagtcttgctctgacccccaggctcgagtgcagtggcagatcttggctcactgccagctccgcctcccgggttcacgccattctcctgcctcagcctcctgagtagctgggactacaggtgcccgccactacgcccggctaattttttgtatttttagtagagacggggtttcaccgcgttagccaggatggtctcgatctcctgacctcgtgatccgccagcctcagcctcccaaaatgctaggattacaggcgtgagccaccgtgcccggccaattgtgttccaagtttcttaaggtgaaaccttagatcattgatttgtaatcctttttctctaatatgggcatttgatacatttttttccagaaactactttgtttgcactccacatattttgatatgctgtgttttaattttcacttggtttaatataatctttaatttattttggggataatgtttagtttctaaatatttggggaattttcaaggtatcgttactgttactagtatctagtttaattctaaattgttctgagaacataatctgcattatttcagaccttttgaaaattattgagatttgttttatggcccggaatagtgttcagtttgtttattataacatgtgcacttgaaaataatgtgtattctggagttgttggatgaaaacttctatataggtcaattatccttaacggtttttagatctacatgttctctcagttactgagagtgttggactataactttgtccgtttcttctttcacttctctcaggttttattcacatgtatttttgagcagtgatactaggtgcatgaacatttaggattgctatgtctttttgaaaagttggtgccttttgacattgtgaaatgtctctctttattcctagtaacattccttgttcagaagtgtactttttctgatatttatatagctattgcaactttctttttaatggtgtttgtgtggtatatatttttcacaccatcatctatttcatctccctttttagtattttaatgtgtgccttttttttttttattctgagacagggtcttactccattgcccaggctagagtgcagtggtgtgatctcagctcactgcaccctccaccttctgggctcaagaaatcctctcacctcagcctccagagtagctgggactacaggcgcatgccaccatgcttggctaatttttaagttttttgtagaaatgagatctcactatattgcccatgcttgtctcaaagtcctgtgctcaagtgatcctgcaaaattctgggattacaggtgtataccaccatgcctagcttaatgtgtgtgtgtgtgagagagagacagagagagagagtgtgtgtgtgtgtaaataacatatattcagatctttatttttcaacgaatcttaataatttggccttttaatttgaggagttaaatcatttccacttaatgtaaatattggtatgattggattaagcctgcactttgctatttgcttttgcttgccttatctgctcttgccttttttttttccttattgtcctgccttcttttgcattaatttgtataacatcttctcttgacttttggattattaaatatacctattcattttatttctttggttttgtctaggaatatacatctttaactttccagaatgtacattaaaataatattataccactttacatttagcgtaagaaccttacaacaggaaacctccagtcccctttcctatcctttgtactatattgtcatatatttttacttctatatattatacatctgacaatataagcttacgattttgatttcaatagtcaattatctttttaaacaagaaaatttctcctataactctttttccttgtgtatatcaattttaatgctttaaattcctttgtgtacattaaaattttcatttcatatcatttttcttcttccattaactacttcctaatctttatcattttattcctgttgtttcaggtctgctgacaataattttttccttttttttttttttttttttgttccagaaaggtgttttttttttttccgaagatgtttttgcagagtatgtaatcctaaatactggtttgcagcaatttaattatgctttttgttttctttttgtgtgtttaataattattttttcatgggattagttagatctgttggccctgtaggattatagttttcatcaaatttggaaatgaaagttgtcagccattatatctttaaatatttttttgttcttcattcttattgtctctttctggaaatcattttttgtatgttgggccaattgatattttcccccatctcactgaggttcttatttttttaattatttttgtatctgtattttttatttctgatagtttctattgttaagtgtccaaagtcactgattttttaatgcagcctaacctgtttttaatccaattgagtctattttttattttaaacattgtatttttttatcttttaaatttccttttggacattgtatatcttttatttctctactatactcacattttttcatttattcttgaaaatataatgtttataaacattagcatttttaaaatggtcatctgcaaattccatcttttttattgcaggactattcctactgactgacttttctcctgtttctgagtcatattttcttgattctttacatgcctgataatttttatttggatgccagacattatatacttttcattgttgtgtattggattttattgtatttctttaaagaatgttgaactttatgctggcaaacagtttaggtagtcacgggtcacttggattcttttgaagcttgcttttgagttttgttagggaaggtgcagcagaacagtctgaaagcccttctactaagctgtgaaacttctgagaatactacctagttggttactatgtctctttactctggctgttgaaaatatggcttattccaagctttctctgggctgtaagaatttttgcagcctagggttttccaatgccattttccttcatcccatgcatgcacctatcagcattcagtcaatgactcaagagaacgcttctgcacatctctggaattacctttctatctaacttctttctttttgaacacgtattctatttgccatcataagtttcagcagcctcggcttcctcaaactccactctttgtctctcaactcagctataatgcgggctttgggtttaccctctctgtgttgcagcctagaaattgcctctgtacactgcttcatgtttttttccttctctcagaaatcacagtcctgtgcttcctataattcaatatctaaaaacaattgtttcttggtttgtatttttattttagttggttgtgtactttaacagcttaacaaagaagaataaatactgtaaaaactaagaagaggctgttcaaaagaagaatattcttcagtgcctaatgcaacacaaaggtcaagtaggattagtgctgaagttgttcattaaattgaagagcaataataagggcatttttttatgttagtgggagtcgttccaattgattccactgggttgtgaaatattggaacgtgatgaccaagtgtggtcctgtttgaccctatagcagtaccctatagagatgtaaactttttttcctgctgagttagcacagatgaaataatagactctaaccaccttcacatgtatgataaaacatttgaacctggtctagaatatgctgacctagaggaaaacaagcatattgatgattcttcaaggaagttcagatgtctgacttcaattagacatgtgattagaaaaaataaaaactggacaggacattcatttttctattgtcaatagcattattaagtttaaaatgcaagagagctacatttttagaaagaaatcaaaaactcctcagaatttcaaagtgttcttatgaatatgaacaatgctataagtgtctatgactgacttttgcattttcagcttcaaatccaagcatccaccatatcacttggactcaggagtaagccctagggaaacttacaagagttccgttttatccacagaatgctatgatatagccaaactctaattaaactcttgaaattgaagttgatacctcatgttcaagatataaatcaggataaaatacattccaagtttctatgaaaacgtagttatatgtttagtactatcatttttactgatcattagataattactctgttgactaaagttgactgaattttttgattactttaaaatcaccatcaaaagtctagacttctgaatcgagaaatacttcaccattatgaagaattacaaaaaaaaacaaaactcatagagcctgtatcagacaattcttgcattgctataaagaaatacctgagactgattataagaaaactggtttaatgggctcacagttctggagggtgtacaggaagcatagcggcatctgtttctggtgaaggcctcaggaagcttccagtcatgatggaaggccaagcaaggacagacttccacatggcaggatcaggagaaaagcagggatgccatgcatttaaacaaccagatcttgccggtaggaactcatggtcacaaggacagcaccaagccctgagggatcagcccccatgatccaaacacctcccaccaggctccacctccaacactggggattatattttaacacgagaattagtggggacatatccaactgtatcagagacctctcaagtaatttatttatgagcatgtgttttactgtttttaaaactgggatgactttaatttaaatgaacagtgatttgagatttatagcttccctttctttgtgtcatggataatttctctgtgctaaggtgtgagcatacacatcatttgggctgttattgaagtagaatacgaagcctgccttctttcactagcaggggaatagtgagtaaattctctattgctaaacaaatattacctctatttatgatttaaatttgatgatggccatagtgctatctaaacacatggttaatggtctggtttattctccactataacttcctgaataaacttcctgatttggaaaggtcccaatgtctatttgtactgtcaacaattttgtaaaaattcatgctttggttttatacaattatttggataacttcatattttagttaaagataaagatgcctcacaggataatttaaatttattatttgattatagttttgataacatgattttctattaatacccgattatggcctattttgtttaagtgagttaatacatactcaaagcagttggcaaagaaaaactatgtaagtgaatatgtaagacatcctaattttgaaatttgattctacatctgatgttctttaagttacttggcggtgaggttagtgggttattctatgccttggaagctttgtccatatttataatatacaaataatcacattttagatctttgggtttaaaatatcttctagaagccgcccttattgcagcctttctactgattagcaataattagatagaaaaatacttacctataaagacaagaaataaagctaatcctgataatcatttttttttttttttgagacggagtctcgctctgtcacccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgataatcattttaataacagaatctgggaagatttttaaccaaatatttgggcatgaaagacaatagaggaggaactggtgatcttggaaatgataatctcataagcaaactactgttagcaggaacagaaacataatactcctggtaatggtggatataagaattaagctgaggagggaaagtgtgagatacacagtgagatgcagccagacttggatctaggagtttggccaggtgctatgcatatgactttaccactgggctgtagatctgagaaggataatagaacagcaccaaaaagagttaagtcacaaagtgcatacaccatatggtggcaaactcagacagagagaggtgataccctttgtaatgccaagtcatgctctgcttgggagacagaaactacactggttttttaaacagtgaaatggaattgttaactggtaaaaggtggttggttactaaaaaaggataaaagaaagctataaggtgtcccgagtacaggtacagaagagcagctactccctctaggctgagggaggaaagacagtgaaggagttaagggctaagagagggcatgctccttctccccacttgcagcaaagctgaggttcagaaatctttcaagagggcgttgctgtcataggaatgtacagcctatggatggtcaaacaaaaccaaaaacaaacacgtcggagtttgtaggcaaatgcatgtctgtagaagctgcccaccgttcttggaggataggagcacgctgggctactgagaagccgacttcaaggtcagagcgtgtgtgcagaccaaagctagtcagaagggtgcctatggagagacaatgtgccctcccaactaaaggcacacctgggattctttctgggccactgggctcccgtgctaaataatacaaaaataatgatgaagattctttttttttttttagacagagccttgctctgtcgcctaggctggagtgcagtggcgcgatctcggctcactgcaagctgcacctcctgggttcacgccattctcctgcctcagcctcaggagtagctgggactacaggcgtccgccaccacgcccggctaattttttgtgtttttaatagagacagggtttcaccatgttagccaggacggtctcaatctcctgaccttgtgatccgccctcctcggcctcccaaagtgctgggattacaggcatgagccaccgcgcccggcctaatgaagaaccagaactcagcttggaagtgtggtgggccgccattatggacttattgggtccttccaaggcctctattgactaagcctatcattctgccaccggatacggagaaatgtctacggggtctacctactgtatcacaaagcagggtgaatttggagctcagaaacagtagatgtataattggcacagctggtccctgaaatgacttattccaagatcctaaatgacattttagaaattcacttggcatttttattaaattgcaagaagatatgagctctgtaaatcaagagcagaaacctttaaaaggataatgtaagacaaaaagacaaatggataagcagaaattaaagatgagagaaataaaattattcaaaagaagttaagattgcaatagggtaatgaaaataagcattggtggtatgtgtatacaataaaacttttcctgtaaaacaggagctgtgaaagtaggataccaatttgagaggtaaatacagcaagaaatgtaaaacaaaggaaaatgattgcagaagacattaggatattatagatttggcagagagaacagagtgatgtactttaagaattatagatgatcctgaaaaagaaaattgattaattagaacagatgtaaaaatcaaaaacaaatctgaagaagaaacagtactgaatcaaaacacaattatgttcccaaactgaaagaactatgttccagtaagttgatggaaaaaaaaaaaacaaacccaagcttcagaaaattctagcaaaaatatgaattatgtaaataaagagaaaatcgtgtatacatcttgggcgaagaaaaacgttactaacagagacctcaaatcagaattgtatgcaagaataaatgccaaaaaacaatatactagatgttacttctcttcaagctctccttggattccccaagtctagtctgatgccctttgtatgttcacatagcattttggacttctcctattatataatgcttattctatcatgttatgctaacatatttacttgtctccctctactagaccgtaaggtatgtctccaaataaatgtttaaatgctacaattatgagataataaggtaaaataactttgtctaaaatttaatctttgagacaaagcagttggaaaaaacccatacccagcccctctctacctcagaaagagagaagacacattttctttctaattcacatagcattatggtttctggacgatcatatatttccataaatgcaggaagcaattttaatgtttatgttcactgatgtttcccaagtgactaaactagaatagtacaaagcctataacagatacatgattaatatgtgtttaatggaagcatagaaacattagaattaaaattttaagatatttcccataaagttgtgttaatggttgctgtttttatctcctctataggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtatgtgctgctgacatgcagctagggaaaacctccctcaattctgtttccattgctcagttttaacttcattcagtgtttgttatacctgcttcattaagctaaacaaacagatggacaaaatctcattgccagacatggagttttcattgatatgcatttgttggcataccgataaacactgcttttctagagcttattttcaacccaaacccacctttttttctagttggtggagatgatctattttcaatggtatagtgattttttaaaaaatatattagatttgcttcgataaggacaatctgggaggggtggcagggaagacagttcttttaagcatcatcagagaaaatcacagctaaataataaggcttataaaaaccatttctccaaaaattaatctgcaatcgctgtatactagaaaatatatttactgctgtggaagtttagtaaaatttcaacacatataaacgctgtcattacaaacagtgactatgtgcaaatttcagccctcattaatatggttaaatgatgtagaaaaagagccaattaaaaaggtaaaaaggatttttcccctcagatagttctgaaaaatcaattccaggataaatgcagtttaaactgtgtcagaggtatcttttcaagataaaatctatgcaaaaagggacagaggaaacaggaagataaaatctgggtagtggttgttaaaatggccttgagaattgaggaaaatggcagtttctaccatcaagggcttcggccaataccgagtacaatgctgcattcttatatctcgcaattatgatcatatatttaatacatgttatgtgtgtatatatattacaataattatataaattgatattttaacctgctgcctatttcttacagcttacaatagcaccactgtttaagactcaatgtttttatgttgcttttgaaattttcatgagtctttcatattgctcagagcagaactgtagaaaatgtaccacttacatttaagaaacaatgtacaggccgggcgtggtggctcacgcctgtaatcccaccactttgggaggccgaggcgggcggatcacgaggtcaggagatcgagacaatcctggctaacacggtgaaaccccgtctctactaaaaatacaaaaattagctgggcgcggtggcgggcgcctgtagtcccatctactcggaaggctgaggccggagaatggtgtgaacctgggaggcggagcttgcagtgagcagagatagcgccactgcactctggcctgggcgaaagagcgagactccgtctcaaaaaaaaaaaaaaaaaaaaagtacaatacctttagtcttatatctatttaaaaataaagcatttttaaaagatccatgaactcctaacaatgaggttaactacatgtgccatttgagatgtgagtctaatactcagtgttcttctgttttgttttaaattttttaaaaagagtatgctcccgttatgcattctcagggtgatttctcccctaactttgccgttataaactctgagggtctcttgtctttcctcaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgagtagggaactgctgagccatgtaatggtataatgttagttcctgctggtgtcttttagtcaggcactgaggggtagtagaaaatggcaaaacatttaagtaaccttttcctctgtgaacatttaggaacagcaaaggggtcacgtgccattagagagttggagtaaatgcctttcttatttgttcttaaaagtagttcacttattgataaggaaatagatgccaagtgaaaaagaggaaccttgtccgggaagcattatgttttgagatgggaagagtgagggcaccagagcatgaatgttgatatgagctaacacaccaatgagaaccaggacttgtcacacattcattccaaccaaccttaggcaatcatgatttttggagtgaaaacatgttcatttttcattttcctttaactctttctacatttagattcaatttgtgttagtgtgaaaggctccagtgtccacagatattgtggctttcactatgtgaattagtcaaaaagatttacgtcctgccatgcttgcccactgcgtgtgagttctgttgcttgtgagaacatcatcagaatgggtataggaactgcagatagacatgcagttcgtaacttagttttaaagaaatgtccaaagcgtaaattcagccttctgctgtattttgaccccttgcaggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaaggtaagcacaagaactttaatgtcaagtgagaacaagataaaatctttttagaatcacaccatttggagatttatccaattcctcattcttctttttattttgtcagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagaggtaaagttagtcattgtttggtgcaaagataccaatcaatggttttgcattcagttttgtcatagtgatttctcttcttgttaacagaaagaatggaaatattatggggatgatcctcgagtccatagaactgtgacccgagaagacttcttggatatactatatgatattcattacattcttatcaaagctacttatggaaatttcatgcgacaaagcaggtaaactctaatagaaaatattcaagctcttattttagagtctgtaaggaaggttattgacctacagatatcagataagaaagattggaaagtgattggttttgcagtataatgatagaagataaaccatggaggcttccctgtgacctggaagaagctactaccattcatcagaaaagaaaaatagcatgagaaacacgttaaagggaaaaaaaaatatggaattcactgcagacatagtgagtttaagatgccagtcataaattcaagagatcatatactgtagatcaggtaaaattaactgttgtggtataaatggattataaaagtgctgagaaagtgacctcttcacccatcaggggaaccaggcagggccaagttggtccagtctcctccaactgtgagcattctaatctgttcaccccagtgtgccatacaatgttgtcattttccctatgcatcatgttgagaaatgattctgaatcactttgaaaaaaatcacacagaacagcaagaatgaatgcaatgttgtcgaacctacatgatgggaatacttcaagggagtattccgtgttttcttatgaccaaaattggccaactgaaatgaggcttgttgggtctgacacttaggaccacactggtaacattcatgataccggtctcagtgtcctggggcagaattaatctcaagcttttaaagaaagaatgtgacacatgagcccaatattatgagtgtaaactattattttccatgaatataattgtaaaaagaaggaataacatattgtcaaaagtaaaaagatgattgtttaatttgaaagagtatgtttacagaacatgggaatggattagtaatgaggaaaatattgaaatataaaataaagagagaataactaatagaggaaccaggagacttccacatcatggaccctcatggtcatattctttgagtagacggttcaccttatccaatgggataaaatgagaaatcatacagatttaggtaagtttcataccatggaggcagaaagttgaactgagttcatataggagacctcaatttctctttcatgtcagtctctgttacattctatgagaatatagaatcgatatatgtttgtaaatagtcttatataataaattattagacctgcctaggaaagcaaaacagaaaaattatgaagtctctcaatggccaactaatgaatataaaaatactatttttcaaatgtttatactggaataagcacacaagacagcagaaaaccttttatttcatgcagaagatccataatgcttttctgattgatgtagagacttttagtaaaagagtaaattaaggaccaaaattcacttttatatatgtattccttgggtttccttttgatatttctcactataacaggagattatttttatatgaaataataaaaaaaatatacttaaaaaacgctgttatctatactgttaattattttagaatatcacatgtaaattaggtggcagaagccatagcagatttgcatgtcttagaaaatagcaggtaatttcgtgagtttgcaaatagattattttgcaaatggttctgtactgcagtaaaagagtttggtagtaaacagaacatcttgttagtggaactgatagaaacaatattgtcattcatctttaattatactttctttgcttctctcacaccaatttcaccttcctacactgtgacactttgtcttttttttttttcccgccctatgtctttttcttttgtcacactgttttacatacctcaccaaatgagatcttttggtttaagtgaccgtttttttgaaactttagaatacatttttcctaatctcagtaaaaactggggtcatagtctcacaatgctaagaacaaataaagctgtcatcagcatttgattttgtaaggcagtggaattgtggcaaaggtttttaaaaggtttgaatagtccccctaaagtaattaaaataaccttgtatctttatttattcaattataaatttaaatctcaaaagcagagagtttaagagtttatattctgtttgaggtttgaactttgtacattgtatcagtgctggcattatcttttttctttgcttttgtttccttttataaagtttaatttaaggaaatagcaacttttgcatttcagtagttatttaaatggaagctggagtttggccaaatccctgatgcaatcaaagccattgctctctaatcccctgaaaaaaaaaatggtgtattgcagaaatatttgttgttgctgccattcaagcttcacttgatttgtaaacacttgcgggtctgttatgtgcattcatgtgcaagagaaaggagaatgaagccagtagctcctcgggctataaaattccatggagatgccaatgcaaagttaccttcttactcccacagagagcccagagaacataagggagaagtttttcttgcagaaggggagtggtttgcttacagctcaccaccactgtgtgtacttacagggagcagagagtgaaacctgaattttaattgaatgtgtgtttcatcaagaccaatcttcagagtgcagattacaatgctagcaaagaacatgcattcataattcagtttcaataaaacctacctatgcttgttataaagtttatgactcaaactccttaaactcctggaggtaacttttatttgaagcaaaactattcattgtcacattttaaagtttatttcccaaacatgtttgtgttaccagttagtccatcataaaatagtcccagtttatggactacatttattttttaatgaaaagggtattaatatgttattttcaattatgattttcttttcaattataatgactatttcaccatcagaaaaggtgagttaagttacttgaaggaattatttaataaagttaagaaaatattattttgaaacattatcctcagaaagaaatcaatattattagattatgcgtgatcattattttctaggtggttttctaaagttcctgaaaggtcattcagagcattgggaagaagaaatttgggatagtagtaaattcaaagcaatttcaccagtgcctgtacgaaataattgaatggggaatgaccttgggttgtctgtttgcaagaatataaatgtctaattaattggccgtgtctacctgaagccactcacattttaaaaagtggggggaatatctttataataacttttcaacaggatatcagacatccaatatactaaacttcttatgatttatgtgaatattttgctaatatgtactcttaacatttgaggaagcaaaaatgcaatattaggatttggtacatgagccccagaaatttaaacagcttcaaaacaatgttaattatcttgatttaatcatcccacaacttatctatgtatcaaaatatcacattgtttaaataaatatagttgacccttgaacaacatggtggttaggagcatcaaccccacctcatgcagtcagaaatccacatataacttttgataccttcaaaacttaactactaatagcctcctgttgaacagaagccatactgataacatagtagattaacatatatttgtgtgggtattatatattgtattcttataataaagtgagctagagaaaagaaaatgttattaagaaagtaataagggctgggctcagtggctcatgcctgtaatcccagcacttcgggaggccaaagcaggcagatcacttgaggtcaacagttcaagaccagcctggccaacatgatgaaacccagtttctactaaaaatacaataattagctgggcgtggtgttgcacacctgtaatcccagctactcaggaggctgaggcaggagaatcacttgaacctggtaggcggaggttgtagtgagccaagattatgccactacactccagcctgggtgacagagtgagactctgtctcaaataaataaataaataaataaataaaaagaaaaaaaaaaagaaaagaataggaagagcaaatatattaagtggaagtggatcattgtaaaggtcttcatcctcgttgtcttcattttgagcagactaaagaggaggaggaagaagaggagggattggtcctgctatctctgggtagcagacgtggaagaaaatccccgtacaagtgaacccatgcagttcaagcccatattgttcaagggtcaacttatgtacaattattatttgtcaattaaaaacaaaaagacaatagaacatacttgaggttgacaaaaacgtgagaaggatattgctgtaggattgattgtttactaggtgatcttaactgactgtcatagtaatctaagtacattctcgctgtttctaggatttctgaaatctcaatggaggtagctgaacaaggacgtggaacaacaatgactcctccagctgacttgattgaaaaatgtgattgtcccctgggctattctggcctgtcctgtgaggtaagctacctcctactaacctgcttaatctcaagtcacttcaggagctaaatggaaatactcccagaagtacctttactgcatacatattcttaatctattttatttaatcttccactcacagtgtgagacacagtggcaagaggataatgttattgatatttagtacaaatcatacctgaagggaaatagttgatcaaaaatttaaagatttgtgaaaatatttaacaatcaggaattaagaatgttttaataagcctatttattatagctgatctattttcttggaccacttctgaagagttagagacatttaaactgcaatgattaggagataggattatactgggttttgaaaatatttttatatagaacacgacaaaacttgtacactaaatagcaggctgttccctttaacataagcttctcagggaaacatatctttgttccaacagtgctgctatgagtcattacagttataaaactatcttttttttttacattttaaaagtaattttaaaactgcttttcaataaacttgctgagatattctcttgtctgccttcaagattgtcaaatttcttaggatctaatttctataattgtgaaatattaataggaacagtacgacttaagggaggtggaatgaatagatgagaaactggcctgggtttgaatctcgacttcaccatacagtaagcctgagaccctgcactgggtgctacacctctttaggctttagcaggtaaacaccaagtccctgagtaactaccactacactttcacctctcccgcagaccccacagtctgaagcctggcatgcatggggcctccaggactgctccagccctacagctgggattctttctcattagtcaggctggctggtgctcacagcataccagttagatattattaaatctccctcacctacagcctgagtcttatgaagactaaatgagctgttaatgttaaggattcatcacagcacctggtgtgtagatgatgtaagttttgatggttaatattattattaatgtaatcactagttatatacccatgtattgattcagttataaataattttatacatcttattttgtaaataggatttgagaagttgtattaagtatggtacatgagacagatgattccactaggtcaaaactgaagtgcaacttaaaaataatgagtatacatttcttgagagggacatggcatcatgaaaagaaaaaggaatttggtttcagtgaatcctacctagctgcactacttggacaggttacttgctctgtttttgctaaatcttgggtttttacctatacatcctaaggattgatttaaatggaaacgtatgtgtgaaaatccctttacaaactgacatgccattcagcttagttaccatcacatggattccatatagttcaaggaaaaagtttataaaataactgcaactgttttgtgacacatgcttaaaatgattttctactctttcctgtgacttctctgaagggcaatatttatttacatgtgtccattttgagctaataaataatcaagtaatccatctccttattaaattgtatttcctacatctatttatacacacactagtaaacttatactggtaagcactgcttatacagtaagcactgctctttccaatatacatatgtacacatagtgtatgggtgaaaactgagactgtgtggcacatatgaaatgagtgacctttccagtgagcattgaagattttaaaatggaggacagaaagaatgtgagatttttctagacaagagatggaatttcctttatcccaggtagcgtttggttttacttttaactgtgtgcacttgatcaatgctcttaattgctgtagaccttcgttattatatagctatccaatctataaaatgacagattgagttgaagttctaaaattctctgattctgcaatattattttgctatagaaaatattctgtaagtagtcaaggttgacctttagatatcttgaagagaaggttattacagctatatttttctgcatttatttgaaataatactgttcacttgtgaacaaaaatgttagtagaatagcaaattattttcatgcaaccaaccttccattctggatttaaaatgttaaaaacctttcttcatatgattgatagactttttgaatagtacattcaaatacatgctttcccattaatttgagtcattttccatcattatatgaaaatgtaaatgagcacaaataaaacaaatgataaatgaaaatcaagaaaaactaagaatatgtacaaattgtcatctgcattagtggcttcaccgtcccatgactttcacttaagcatctatttacagacagtaattgcagtaatatcttagtagagagattacagagataaagacctatctctcataataatgtacctgaagtgttttccacaacccatggcctctaatccattatacctcttatttataattcatcttgattcctaagtgtaattacccaggcataaaatcttatcatcaaagcaagagctaagggcagttttgaaataatacatcccattccagtaacatatgctttgggtcatgaatacacaaagcagttcctctacaatatttttacaaaatgtatagtattctagagacatctgcatctacaggctattttatttcatgtttttatccacaatatggttgcaagtaaacaaaattaagtatcagttactgctaaaatatagccagttgtaaagactcttagcctttgcttgttacctgcactgttatgacagtgcaggcctggtcattaaaaatgttagttttagaaatgcctaattattataatttactatttgcagaaggggccagattaccttcaggagtcaaacaaaggacaccatttcctcaccagatttcttggtgttggagccattgagtttgttatactttatttaacctgtctttgagtgacattaaatataggttattgcccaaactgacctaaactgagctttatgcagttgaaaggttatatgcaggtaccattcttacttatgactttctttcttaaatatggaaaatattcagccttgcgtgtgcagctctctgcagtaatacggaaatcagaaatttgtcaatgatctctaggtcatgttttgatagtttcagcttctatcctgtcttcccatattttaaaagggctttaggcttgcagttgaatggccggtgtctattggatcgccactcagaagctgtcccttgtggctattaaaactgatttttttaaatctccaaataatttatacctatcgtcaacacataaagcccaaaaggcaaaatgtgaaaatagtcttagctacttacatatgcacacatctatcctttatcacttctgttgcacaccagagacccaaagtctctgttttcatgtacagacaagtgttgaggaacatggcatgggtaagttatgttataattttgtttacaaatataacctaaaacaatcatggtatctttatttttagtttatttccagcaaacatagaaaaaactatttgagatagagaaacctattgatttatgtatgacaattattaaacatgctttatctcaagtaatcctcagatccaccctatgaaaagcagaacctaccattgattgagtgcttactatctcctgtacacttcctaatacagttacaccaacatcatcgactataatttatgatccccattttacgggtgagagaattgaggcccatgatcacacacctacacagcaattcaaacctcaatgaatctgtttccaaaacctaggtaaacttgtactcaactattatattatgcagtcatgtgctgcttaacgacagggatacgttctgagaaatgtgtcgttaggtgatctcctcattgtgcaaacatcatagagtgtacatacacaaacctaaatggtgtagcctactacacacctaggctacatgggatagcctgttgctcctaggctacagacctgcacagcatgttattggtactgaatacagtaggcaattgtaacataatggtaagtatttgcatatctaaacatatttaaacatagcaaaggtacattaaaaatatagttttataatcttatgggaccactgtcgtacacatggtcctatcattgaccaaaatgtcattatgcagcagcacatgactgtacaatattcctacattccaggtgaggaaaccaaggcacacagtattcagaaccttactacatacaaagtggtgaaacaggaattaaactcgggtctgcctgattgcaaaatccatgcaaagatacaagatagagtgtttttatgagctccagcacaagcatctatttttattactaaactctgaagaaagaaaggagcgcagtgtgcagccctgagcctaggataggataggtctctacagtctgcttcattctctcctctctaccctcccacatttttgtgtaaatttaatctaattttttgatgaaacaatatattatgaaaataaattaaagatagacgagagcagaagaaaattgagccatgaataatttcaacagtggggaagagaactttggaaaagtttaaattagagtagaaatgggtaagaggagctcaggaaagtatttatttgcttttctttaattccccattgtgttccagaaaggattttagatgggactcaaaaagtaacttttttgcttccaattccaacataatcattctcacaaacttttgtctcagttcaccaagaggaaaaacattcaatattgacaaacaccctaaaaattatttaaattgaaagaatagtgcaaaataatcaaggaaaagagagaatttctgtttttttttttaaaaaaaacagcacgttttaagtttctaatctttgcgttgtcaaatactctctctctctcttttgctacctcatagaaatttaatccatcaggatacgaaataaatcaaaactaatctaaaatgttaaaactgaaagacactttagaagtcatctgagttaacctactcatttgtgggatgaggaaactgggtctcaaagtaacttgcccatatctctcagacaaaactaacataaaatcaaggcttccctattcattccttttatagtaccaaggagtggtatgcactttttatgtatttatttatttttttgagatggagtctcgctttgtcactcaggctggagtgcagtggccagatctcagcttactgcaacctccacttcccaggttcaagcgatgctcgtgcctcagcctccagagtagttgggactacagacacgcatcaccacgcctggctaatttttgtatttttagtcaagacatggtttcaccatgttggccaggctggtctggaactcctgacctcaagtaatccagccacctcagcctcccaaaatgctgggattacaggcgtgagccaccatgtctcgccttttccatgtgcccttttaaatgcacacatacacaacagagaataaggagcttgccagtgacgctgcgctctaattgtctgttagacttttctaagagttttaaaacaaactcgggcctcaactctcccccagaggaattgactccacctcctctagggctggaccggaccacagactcccactatgggcgcttgtctattgtgtcaggctgcctgtcggggaaaaccacagtaataggaaaaatgtgttgtgcgttagagtagacttcaccttagggctcgccttcacatttggacctacaacgctaaactgtacaattcctcgatgaggagtattacttcttgtgtttctttttcttctaagatttattttaaacttttgtttgagcttcaaggaaacttcctctcaatttgtgtgattttttacacaaatttttacagacagtaattacagtaataacttagtagagagattacagagataaagtcctatctctcatagtaacacacatgcatgcacctagcaagtatgtcaataacacaacaattttatatatatataattttatatacatatttatatattatatatattttatatattatatatataatttatatatataatatataatttatatattatatatatataattaatatatatattcaaggatgaaatccatgcacagaaaatccagttttattcagtggtcagcttgctaaagaattggaataacccacactatgaaccacttttaaatagatcttggtttatttcttcagttatgcttaaactaattcttcaaccatcatttccaggacttattcaataataatggcaaaaatgaaccttgctttttaaataatatgtataaactttattaaattatatgattatgtccaccataagacaaataagactcaaaatagtttgaatactattctcagttttatcagcttgctcaaagttgggacattattaaatctcattagaatttattttaggctgtgataaaagcagagagtctcttgattaagtgcttaattgaagtacttttgcattatccaaatcaaaataaacaaggagggtgctagctattaagctagatctttttaaggagcttctttgtatatttgtctctggactgtctaggccagaaccaaagggatgtggaggtactagaaagttcttaatctgatattttttctggcttagtcagcaatcacttttctttcatcaatgggcataagatttttaagtgaaaaaaaaaaattctacttaaccaaggtggtaaaatagtccccttgtaattctccatgggatttgaaaaactgactcctaccttttattcataaatcaagcaatgtctgcagctatgcatgaggagaggactgagcctgaaacacaagacggttttcatcttcgtgccagagctgtggactaccttccagaaagccagagatgtttgttgatacattttcataataaacccaaatgaagatggaagtcttgattttgcatatgtcagcttcactagaagttttctgtttgctttcagatttttattgcaaaaagaaaaaaattatatcagggaaagataaattttattggtggtctaatagtcgcaagacatgtacagcttttattattttggatttcttacttttatagtctttaaattatatcagtataaataatgcatccataacactttttatttagttttttgctgtgtttcattggacatttgctagttatccatcaagcacagtaaaagcagattttaggtgttaaagacattggaattatctttattccatatgacaatgttatttaaaaacaaacatctttttcaagaaaaatactctttggagctttttcaggctgaattgtatctacaaataaaagctttccttggttaaaatctgattacacatggatgccgcccgaacaccttggagaccaggaagaaatacacattaagtatcaaaatcggcacttgcgtttgtaagtgatgttgcccctgccgcaggtgggggaaggccagtctgtctttgcagccactgaagagctcaagcgttgctaatgcagtatttctaactttgctgtcctaattggcttccttttctttcaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccaggtagtcctctgagccttccttgaacaaggtccatgtgctcattcctctttacacatgctcagcatctgcatgcagaggccagctaaactgtaagggaatgcaactgtgtgtgtgaaataaaatatgtaagggaaaaagatattcacagattctgcattttaaaaagtaaggaaaaaataactgggagaaccactgagcatgtcaagaaatagaattttagcagcatcttagaagagcaccagaagacatacctatttaaaaattatgtgtgcctttttttctgattattttcttataaataaactttctataaaatttggaaattacagaaaagaattaagaagaaaaaattcacccaaaatgcaacataacattttaatgttttaagtatttcccaccaatttttacatgtgtttatgaataagatttatataacaccatggatgcagttttatgtcttgtcctttacatttttacctatcatgaggttgtattatgttgttagatattatttaaaatctttacgatctttgtttggatgtcccataatttacccatttcccttagaattgaggtagctcttatttttttatgtttctgctggcaccctgcactctctaccaccatctgcattagaacaatcagaacaatcatgtgttccaccctttttatcgtagtcactgtaagaaattcaggttgcccctgtcaccacttgtccctcaagctgtaatctgcccacagctcatctttgttaagcccatctcccacctctgctcaccttctgaaaccattctactgagccttgtggaactcatggtcaaaacaggcaaaataccccgcagaatcctcctcttccctcagtgttctcttcatcatgctctgactgaaacccaactctcactttgcatgctgctaccccggcagccctcttaaggagtagccatcacctttttgttttttttttcccctgagatgctgactcactctgtcgtgcaggctggagggcagtggcgatcctggctcactgcaacctccgactcccgggttcaagtgattctcatgcctcagcctcctgagtagctgggactacaggctcacgccaccacacctggatattttttttatttttagtagagacggggtttcaccatgttgtctaggctggtctcgaactcctaacctcaggtaatccacccaccttggcctcccaaagtgctgggattacaggcatgagccaccatgcccagctgcagtcgccatcactttctttcactcccttcattcccctgagtctgaaggtgggggcaggttttcctgctcctcgctgccagtttcatattatccatcctcctctacatcagggtccacaacccctgggccacaggaggatattggtccgtggccttttagaaaccagaccacacagcaggaggcaagcagcaggcaaaggagcaagcgcagcttcattagcatttacagctgctcctcattcctggtattactgtactgcctgagctccacctcctgtcagatcagagacagcattagattctcataggagcacaaaccctattgtgaactgcacatgtgagggatctaggttgtgcgctcctgagaatctaatgcctgatgatcaatgatctgtcactgtctcccatcaccccaagatgggactatctagttgcaggaaaacaagcttagggcttccactgattctatgttatggtgagttgtataattatttcattatatattacaatgtaataataatagatagtaataataataatagataataaagtgcacagtaaatataacatgcttgcatcatcacaaaaccatcccccaatcctagtccatggaaaaattgccttccatgaaaccagtccctggtgccaaaaacattggagacgctgctctacagcacccagctttgactctcatgcttccctctatgtgccccctctccatctgcttgtcgaagtcacctactaacctttaaataccccacatcattccttgctgattttccctgtctaattgtcattttccctagcactactcctgtcatcattcttagtgattttaatgtccatgaacttaactcttccatactcttcactttcagtttcttgtgcctctctggtctccatttgaagcgtttttttgttgttgtttggtttttgtttttttttttttttttcccactgtgtcgtttctctctagttcacttcttctaaatacttccacttcaatgtgtgtaatctcacaattgatgcacacacttttttcttgttccttatctcatgctttcactgtagtaaccagcttaatagtcatgatctttcattggtattactgctttgcaacgctcatttccctggctactcctttacttattttttactcaagtgaactccaacactgtgagaatcctaccatctcctccatacctgcaccttctttttttttttgagacggagtcttgctctgtcacccaggctggagtgcagtgacgcgatctcagctcactgcaagctccgcctctcaggttcaagccattctcctgcctcagcctcctgagtagctggaactacaggtgcccaccaccatgcccggcttctttttttgtatttttaatagagacggggtttcactgtgttagccaggatggactcgatctcctgacctcatgatccatgattcgcctccttcggcctcccaaagtgctgggactacaggcgtaagccactgcgcccggccacctgcaccttctaagctgaacgtggctgtagaaaaagacaattgtgccatctaatctcaccttaaattcatgatccctctcttcaaatggaccctttgtgctgctctgcaatcatgccacttttctctcatcctttttcttttccacattcctaggtgattatttcatacctccccctccatcctcaagcctaaacctctcctctcaccccctcccatccttaccctcagttgatggtgttgcctcttatttcattgagaatttagaagctgtcagaagagaggtaacaagctcccactactgcatgcacccacttttctgcatctgtgcccaattattatgactcttttctattactttggatgaattattcttgtttccagaaaagatcacatcttccccctatgttctcaattctacccctctcccgcttgatgacatcactctggctaatctctcctccttcttatattgtcactttttttttccatcttaaaagcaaaaacaaactctcctgactcatttcctttctaagtaaccacttcattcttctccttccatacaatggagagctgtctatcccgtctataatttctcttcatccattctcctttgaattactaaaaacaggctatcacctcctcttctatactggattcaatggctaatctacagccaccagtgttcaccttactatatctaacagccatgtttgccactgtgaatcaccccattcttcttgaaaccctttgctcaatttgctttccagcccatggcattctggagatgttcaaattccatagtggctccttctcagctttcttcattactctgaaatctacatagtggtattcctgggactcaatccttggagcaatttgtttctctaactacattcattcagatggtgatcttacccaggcatgtggctttctgtactgagatattttgatattgacatcccacagtatttactattaagtttatgatttaattttatatccactcattactatggtgtggggaggtaatttttctgcagatatgtattaccactgtaaagaaacatttactgattaatatttccttttccccttgatacattattgtatctgaacatacacaaatttatttcatccatattaagatatgtttcagtataatccattttgttttacttaccttttagctcttattacaatgttctgcttaccttcattttatgttaacatatctgtaaagcaaggtcctttatttctcttctcttctaattaactagatgctcttacatattcttccagctgacacttttatgcactattttaatctcttccacaaattttaattacaatcaaaattactggaattttgattgtaattaaattagcctatttgtaaagaattgctatatttacactagtcactcttctctcttcagatattttatgtcttacagtaaactgttttaaggttgtctatatcaagcacgcatttctcatataaaaattctttctatgtatcttacattttcattttaatggtagtaaacattacctgttttgtttcaacatagtaaatgtactaactggtcattattggtaaaccttaactattagaataggtgtttttacatgtatttgatatccaataacttttattttagttctagaagtttatcagttgattcagttattgttaagtttaccatttttttttttttttttttttttttttgagagggagtcttgctctgtcacccaggctagagggcagtggtgctatcatggctcactgcaacctccacctcccaggttcaagcgattttcctgcctcagcctcctgagtagctgggattacaggcacctgccaccataactggctaatttttgcattttagtagagatggggtttcaccattttagccaggctgatttcaaactcctgacctcaagtgatctgcctgcctcggcctcccaaagttcagggattacaggcatgaaccaccaaacctggcctataatactattatttgcaaatattataattgtgctttcacttgtcaaaagctatatctgttataataataatttcatgtttttaaattgtctcccaaaataataagctttctattttattactgattttaatatgattgccttaagtctttcaccattaagtatgatgctgatggttagtataagaaaaacatttcttgtcatgttacgaaaactgctttctattcctagcttcttaaagatatcctctttcaatcaggataagatatttaaattactcatatgcttaattgtggagagtggagtgggaatgtagatgcatttaagaggtgatcatatataggtttttcaccttaaacagaaccataaatgatattattgactaaataaataacttaatattagccatccatgaattccagaaataattactatcttgctttagtatgctattttttcatcaactgcttgcctgacaaattcaataggcaatttgagaggaaggggttaatctatacacattcttaagcaagaattaaatgtatatgtcttatgcaatcttcactggcatttttagcacagttatatttgctttatatgattaatttagaagcatttataaataatgcagtttaatttcaattttgttaggattaaaattaccgtctttatactgtcctcttttgaccaattgactattatgactatttttgttctctaagaattctaaaagcatgtctattttctgaggaatccctagatgaagtaaaaaataaatacttccattaaacaaacacagctggtataaaccgttatgctccaaatttttatattttctttcatggaactcacaacttttgaatttaggcaactctgttcatctttgaaatggcctcatgaggcaaataagaaatagctgttattactcccacacagtaagtgaggaaactgaagcatactgatttctcttttatgtgcaatatggctctcagtttcatatcatatccattatacagtgcaatgccctctaccttggtatagtggcaagcatgaactctgcagtcagagtgccttgattcaaatcctggcttcaccccttactggtagtgtgagcctactcaatttatttaacctgaatgaggtcttagtttcttcatttatataatgaaaacaataatagtggctactcacagagtttttgtaaggatttgatgaaatactcaataaaaggcttagaacattacttagtgcatggtacgcttcataaaagcaattatgataatgatgatcataaagatgataattaccatacacattatctaccatttatagtcgaagaaccaatcagttgataattaatcaaaaaataagtaaaaaaaattcatgtctagcgctatgctagattttcttactgtctcagtccatttcggatgttgtaacaaaatatcataaactgggtagcttataaataacagaaacttatttcccacagttctgaaggctgggaagtccaagatcaagtctccagcaaagtcagtgtctggggaaggcttctttcctggtcatagctgaccccttctttctttgtcttcacgtgttggaaggcactagatagctctctggggtctcttttgtaaaggccctaatcccactcatgaggctccagcctcatgatgtaatcacctcccaaaggccccatctcctattactatcacactgggagacaggatttcaacatacaaatttttggagaacacagttgttcaggccatagcaagccttaacccccaacatgatgatatttggagatgggcactcacttatcttgtttttctttatcttcacacctttccctgaaaatataaagtgcataggaaagaaaactgtagaaagctttatagactaaatattttaaagaaacccagatcaccttgtaactatgctcttcatcatacctaatgatacttgcaagataattgttgcttcatcctaggcattaataaatcctgtacataggcatgttattatgaatagctcagtgacattgctccttaagaaaaaaaatttttttgaagactaaaacctatgtaatactgagtccaaggggatagcgggaggtaagtgaactaacagtaactagtacacacacataggtagtaagtaggtagatagatagatagatagatagatagatagatagatagatacagaaggaagatattttcatttaatcattgctacaccctgtagtcagattatttctcctattttttttttcacatgggaatattgaagacttagctagctcaaacaactttttaaagataaaataatttgtggaaatattattttcactctatcataattcttattttaaaaagaaaataataaaaataaatctctataactgatcattgctgttgcctgaaacatttaaccaattacctctatcttcagtaaatagacagatttgtaactagaattcactattttttgttttgtaaaccttatttaatctacctaacaaccttgccagaatagagattgttagcattatactaagttctggaaattaatgctaagaaaatgtaagcaacctataaagccttgaacaaaaagtattagaagcaggtttcaaatccaccacaaactgcgttctccagacggcaagagagtgtaaacactctctgctgattaaatgagtttgattttacaagctcaagtgaattatatcttagagtcgggacagaatctgcaaaagtgactaggggtcatgtatggaaaacacttgagaaattgtgagaacataaaatttgtcgcaggatagtaagcaataaaacatctttccaggttttataaaggaaaataaaatgtaggaaactgattgtcatctccagtgaaacttaagtattgcttacttaacaaatatctgtcaactgtggaaaaaataaacagtgctcattaggaatcagaataggttcactttgtcagaggcaatggctcatgcctgtaatcctagcacttttggaggccaagagcggaggatccaggagttcgagaccagcatggtcaacaaaggccctgtgtctacaaaaaattaaaaattaaaaaaaagaataggttcattcaaaataacacatatcaaactaagtgctaggtttactgtatatataatatctgaaaacctagttttctaaatcccagtaaaatatcaagtttatcagacaatgtgatacatcatatctcaaattcagcaaaaaataataactgctattatgtgtccaaaactgtgtatgtaccaggaccaaaacaggtcactgtacagagattttctcatttattgttacaataaacttatgagatagacaagattatttcttcttttattgttgatgaactgatgctagagaaattaaataacttgcttaagtcataaaacagcagaggccatatccatgtttcaaatgctggtttgtttaaatagatgtttgatgagctatttcatagtatccttgtgcacaagattgaaaatatgagccagatgttagccagctgataggttgatgggcatatacgttgctaaaaaaatgtgacccagagtacactctagtgatatctccaatgatgaggcgtaagctttgtatttgaccttgttgtgttcaaaatatctgtaaatgctttggatgatatctatcaaatattcagataatataaagctgaaagtattatctaatgtgttggatggtgggaaaatatcctgacagatgatactatgaattacagttaacaagatgagattaatagaaaagatttgaactcaggtaagctcacttgtttgttcattcctgtggcatctgttaattatgtttccaacatgcaggtctatggcctatggtagatagtaagaatatgaagactgcatgggtcttgccctctaggagcttattctctagtttaggggaaagaacagaggaaatgacacatattagcaattcatgtgaagtaagagtccttacttgattgcagattcactaggtgccaacacagggcattgctatttgtataagatccaaatcaagggaggaagtacatttaatatatttgcaagtcacagctagagacttataatctactatattttgaaagaaaccctgagtaagattgctaaatgtttagcttgaaacaaagatttaggaagtaatagtattcttagatatttgaggaccttccctaggaaaagggaattagacttaattttcatagcttcagaaggcagaacttggatcactcactgaaaattagaatgcatcaaatttttattcaccgtaaggaaaaacttcacagcttatgcaagacgaaaaaagctgtcttataagaattcatgcatttaatgatatctcaaggaaagtatagaaggcattcctgtatggcaagaaggttagattaagtaatttctcaccttaggcctgagatactataatattaatgttatagtcatttgattttgtagaaggaatatataccaacagttttccagtgtgcaaaaaaaaacttaacaaatctaatatattctgatgtattattgaagagatactagcacataccactcttgagaatataattaaacttctcattaggcatccaaaatataggaatttcccctaatggctaatttttatataagaaaaaatactatgtacactatttcaaagcagacagaaaagtcatatgaaaagggtatgtcaaaaaagtttcaaaaagaggctcctgatttatgtgttgtgtgtttgtggacctaaccaggacatttgattcaattaaccaagtttagtatgtcagcaaccctctgaaagattgagaagattgactgtccagagaatattacaatatttgctttctctgttgaagaaattatgtagacttacaggtataagagaaacaaaatcatatttttgaatctcttatttttagtaatgattattggctttaaggattttaattcagttactaatgttatatttaggttacataaaataattcattatgcaattattttactgcaaaagcaaaaggctgaaaattattgttgaagatcccatgtatttttggcacattcatctctataaaataagttcttaaaacactccccagttaacacttattcatcagcatgacaccttgctgaatgacttgaaattataattcatagataattattttatcttggagccattatctctcataatgctactgttaaatatggaatggctcttttattgcttaaaaatggtggttcctttggatggttgaataaaagaggattatggcacttaaatcaatggcaaaatatgacaaatcattttgccctgctaaccacttttctgcaatgacacttgaaatttgggctttttcatctgaaaaagcctgaccagtttcatctatacttcctggaacatgcattcattcattcagtcattcaaaatagtcatcgaatgcctcccatgtttgatgaactaaaaggagcatttaagccagttttaggtcatcggggaatgtttctcagagaaagtgacatttaaaatgagagctgaaatgaataagtgctagcctgatatacactgtagagctaaggatttgcaaatgaaaagtcccagcagtgataaagagtatccgcataatttgagaatttcagatggccccatgtggctacggcattatatgcaaagaaagcagtggctacagctacatatggaggggtaagcacagtggtggtgaaggcgggggtgggggtggcaggtaatgaagctcttccttgccatgctaatgatttgttattcatcctgactgcatttgggagctagtgtaggctttcaagcaagagaaggtcatggtttgatatgttcataggatgatcactctgcagtgtggagaaatcaccagataagaaaatatggagacaggatctttagctaaaaggctattctaataatccaaataaaatatgacagtggccagatgaaaatagtagcaacaagaaagtcaagaaacagagagtaatagactcatggaactgatgatctaatggatacctcggataagagaggcctctaggttgctgaccttggcaattgagtgaatgacagtgacctcagatgaaacgagaaatacaggagtattacaaggtttagcaagagatgaacttcattgttgtcatttcaaatttaagacgcttctgtgttatacaatatttattcaagaagcaattagaagcagaagtctggaacccattagagatatccaggctgaatacataaaatacagagttttgggcacaccattaactgaagtcatagtaatggatgaaatcaccaaggtaaatgtggaggagaaaaaagagatgaggaccaaagttagaattaagggcgtcaattatattgaacagaaagggaaggaagagtcgataaaggagaattcgagtagccgcagaagtaggagaaacatcaactggcttactcttaaagaagccatgggggctgggcacggcagctcccgcctgtaatcccaacactttgggaggccagggcaggcagatcacggggtcaagagatggagacgatcctggccagcatggtgaaaccccgtctttactgaaaatacgaaaattaactgggcatggttacgcatgcctgtaatctcagctactcaggaggctgaggcaggagaatcgcttgaacctgggaggcagaggttgcagtgagctgagatggtgccactgcactccagcctgactacagagcgagactgtctcaaaaaaaaaaaaaagaaagaaagaaaaagaaagaaagaaaccatgggaagagagtatccagaaatatctatcaatggctacagaaaacctacatatgaggcctgatgattgtaagttttgctttagcaacaaagatcttatgggtcatcctggtattatgtttaatggtgaaaccagaagcctgtttaaagggagaatgggagatgaagaagtagagaccaggaatgtaaacaatgtctttttaaaagcttatcgaaaataggatagaaattgtcaagcaatttgagacctcacagattttttttttaagacaggaaaggcttgaccaatttcaaatattaatgagaatgagcctgcaaaggagggaataaagatggtggagaaaatggggaggcaggaggaaaggaaaccaatttaggagtggagtagcttcagacaaaggacggaaacaaatgtcaaagggatggaaaataatgtggcaatatactgaattgtttgccaggaaaccaagggagcatccaaattagagctttcttatctcttaaagtagggtaaggtgtagaagtagaagatttgagattggctgggcacgttgggaggctgaggtgggtggatcacctgaggtcaggagttcaagaccagcctggccaacatggtgaaaccccatctctactaaaaatacaaaaaattagcctggcgtggtggtatgtgcctgtagtaccagctactcgggaaggtgaggcaggagaatccctttattcaggaggcagaggttgcagtgagccaagatggtgccactgcactccagcctgggcgacagagctctgtctcaaaaaaaaaaaaaaaaaaaaaagagaaaaagaaaagaaaagaaaagaaaagacttgtaccttgtcatattggaaaaccagattcatttcacattgttataaaatctgtaaatgtcacaatataatttcaaatataacaccaaaaatgtaaaaaataaatgatctaaaattcactgtggcaatgtcatagtttcactgcaagaaatagcataaactctcaaaaagagttaatagaagttttaaacaaacattaattccatggcaatatctgtggtggaaatgacgtcagctattgtttgttgtgaattgccacacattccctaccaacaattgtctggccattagaagacacatgaaacataaatacattcttcttgattgactaaatgaagcagagcccagtctatgggatatcatccaagttcaagctggcggcttcgtggctccagctgagattatcaggaagtcaattcactaacatgtccatctagtttgtaactgacttttttgtttctcaacttttctttcgatattgtttataagatgtaagtcactattttgaccactccaaatcctgtcttataaaatccagctaaaattcaattccaaattcccttcttcctttttctcaactctcaaatgcaaggatcgcattcccacaagataacattcaatgttgcattcttgctgccatgtttattttttgtcaggtggtttttttaaattattattttcccaaagtctaagtaaatttctagaaggtaggatgttctttcattgcctgtttcagtgcattccatgtagctcttcctaactccttattgcataattgattattgtgttaaatataattctgcttcatgaaaattttaatttgaagctatttgcacactattctgaagctattctcatttctttgtggaaaggtgttaaagggtatcaccccaatgtctcttattatgcaagcataagaaagaagatatcgatctgagattgctagttttagattgactcctctgtatttatgaagaaccacctacatctatgctttccaccttgaggtggtttcagaaagcccactagtgggcatgtgccaaggccacagtatttgtagcacctttttctaacatctcatagagctaaaacctgggatatgaagaaacataaatgcctagaagaaataataaattttagagactcgaagtctattccccaatttagagtaggagaaaaatttacatagagattgattcagggaaaagagaatagcaactcttattgtcagtgtagctacgatagcacagtattagtttctcaaatcaaagagttcctttaaaaatatttatatcaaagactgagttctctgtcagtgataaagtgtgtgtgtgagtgtgtgtgtgtaagaaagtatatgtgttcatagacacacattcatagctagggactgtatgataaattacattctaactatcactaaattaaaaacaaacttcttctcccttttcctttacagaattgtcaacatcacactgctggtgacttctgtgaacgatgtgctcttggatactatggaattgtcaagggattgccaaatgactgtcagcaatgtgcctgccctctgatttcttccagtaacaagtaagattgagaaatataaccatatttcccaatcagaaacgccatctgtctagcacatgggctgtctatgatttggctattttttccatgtagacaaaaatctcaatttaagatagagatatttttaataatatagaaacatgacaaaagtgagtatataatgctctatggttcatttttcctttgaaactctgtcccaagtaaataatacttattaattaaaattgaagtaccaatattaatgtaagacatatttataaaacaaatgatatatatatacaaatatgcatggtttcataaatataccagtctaatgcttgcatatagctctgcccataatatcatctatgaaggattgttcgggtgcatattatataatttttgtggctgtttccatttattttatgtgtttaattcaagattgggaaataattatcaagaaaacattgaaaaattgtacaattaaagcaggtgacttattgttatgctccaaaaaatgtcatctcccggaatcacagcctcctttttcttaagatggtctgagcttggtaccatggaaacacagccctaagaagaaacaaaagctggaatatcttatttcagtgctgtctgaacattctgcactggtttatacattgatgaaaaccctaggtgttttcatttacctttttgcccacactacctgcactttctgttaagtgatttatagacttcagtaaggcagggtagttttactctaagaatttgcttttgaaaataatgtatggcagtttgttcagaattagaattctggacactttatcttgagtgttaaacagccacagagcaatttggacaatgtgatctttgcacctgtgcctactcactttcttcttaatcttcggctttgtgtgcattctgaaaacatttcctgtaaatcatctccttttcctctgaaagctcctcttttttgttggctggaatcacaagccttttacagggtgtcaaatgtcaatttttaggtaagctggatattgaagaggataatatacatggtcttattgttcatccagggaccaagtagtatgtgtatgaaaaataacattatttttgtctctctttccctaatttctccttgatgccccgatttatttaattgttttaaaaagtaagccatttggattagaaaaatttaataattaattgataattccctggtgagtacactataataaaagctacaggagatatacaagagaagcatgccattttttggaggagctcactgtaaaacctgtgtgttaaggggtatcaacttaaatgtaaagaaaattcaaaggcacaaaacaccacacttaatactggaagcttcaagaacatatgaaaagaaatagtagcatgtataatgggtcttaaacaattaatttcaggattttcactggtgggaatagtaggaaattatatgggcaaatgcttacaaaatacaaggcatgtgcaaaacctaataagtaacagaatttggaacatggcgttcagacacaatttcatgatcacagatgaaaatgaatgggagaataaagaccatattgtagaaatccttaaataccagtctaagaaatagttatttaattttctatgtaataaggaaacactacaagtttttattttgaaaaaaaggttaatatgattatggccacattttaggaaaactattatcatagaattgagtataatgaattgaaacaggcaaatgagaaaagcatagagaccaattaaaaggctagtatactagcatgggcaaaagataattagaaccagaagtaggtaatagtaataagaatggagacaaaggaatgaatgtgagaaaatggtttaatacagctttacagattcggaaactaattagatgtgaggggtgagggtccgggcagaagttgaagacaggtttttaggcaggttacccccaaaaatggtggtgctattaactgaaatggagaaaccaggagagagccgttagagaagaaagataatttatgtttcaaataggttcagattgatagaacatatctgtctgaatggaaatatgcaaatagctgcaggaaatggaaatctgaaaattgcaggagcagatgaaggaagagatatgttaataagtgaattaaagttggataagatttcccaggctaatgttatccaaggcgagtatatagaaagaatgaaagacaggactttatgttgggaaaggagaaaaagaagagccaaggcaggagcagtcagaagagagggaacccaggcggcactgccattgacaccaagggagagaagagcagtgaacagcatcagttgctgctctcacaagggagacccaatgaatatggtggcaattgactattgtaattgagcaaataaatgggcttgccgcctgaagcacatagaagccaataacgttggcactggcttcggagaaaagaaaggctttactgcaaaattgttcagcaaggagacaagagtcaggttcaaatctgtctccctaatttgggatatggggaaggttgcaaggggtcagaaggcaaggcaaaggatttagaaatgctggcttggcagagtctgattggagggcttcaaatttgatcacttacagtaaggtatattgaggcagattttagccctggatcttctgggccaatggacccctcatttctgaaggagttccaatgtccaggttttgattttgtccctgtcttgttggttcaaggggaggaatagttggttcctggtgttgttagaggtcaaaatttttctattgaacatgcctgggctacatgacttgcagcttttggctctgttatacctaaaaggtaacttgacattttgttatcaacagggtaggcccggttttggttggtcctgtagttacactctcagagtcattgatgaattttgaccatcaataatgaaagcagaatttgaatttacagttttaagaaatttcaagaataaaatgatagaatactaccctgattggttagcaggatcaataacagggtgtgttttcatttttgtttcattgttgttttatatgatttgtataatttgagtaaatttttatgcaaaagaccctgaaagaatcaaaatatcaaattaaaatggcaagttcagtggctttcaaactttattgattgcatccactgtaagatacacttttttatatcataagccagaaacacacaaaaacttgtgtgtgtagatatctaaatatatgtattatacaccatgccatttatttaattttgttattttacatttttagaaaaaaaattttagccaaaacctactcaatggatttcatgagtcacttatatcaccatctaaagcttgggacgtattaggctaattaacaaagtgaagacctataaattgtgagaagagaagaattaaaatgtgaagcaaagaaaccagccagggcaaagaaaagaggcacttctccccaagacataaaaacagattctgaggaatagatggaggaggctgagatatctcaatttatgacttcaatctgtgcagtcagtgagaaatatggaggcatgatgagtgattactgactcatttccacggcattagttcaagtcctcattatctcttaccaaaacaaatatggtagaaatttaactcttatgacggagtggcagtgctcacacacccttagaagtttccagtgccttcccaaggaaagatcagactctttgagcattagaaaccctctgtaatctgactacctttccaggctccaagccctcaactccattctatataatgccaagtttggcatttcttgcacttatctagacatcattagcagtctgctcttgctattccctcagacaatccctgtgaaatctaatttatttttaaaggcatttttcaaaccctacctctgccacaaaacctatccatagcacagaatgtattttgtacattttatatacaacgaacacattttactatacagaattatttcaatcattctttcaggagatgaacatttactaagcatatacttcatcccaacactatgaataaaagataaaagatatgtgtcctgtcctgtatgtgtacatatctgtgtctcacacagaattgtaaattctttgaaggtaaacataatgtcttatttctttctttattcaagaaaaagttaatgagggcccaactcaatgctaggcatggctcttcgtactgggaatatataagtgaacaaaacggcctgtgtttcctagccttctggagcttgtattttttataagagagtaagataaagaaatagatatataatgtaatatcaggtaatgacaagtactaccaggagaaataaaggagactcaaggaacttagagtgatgaaggtatgattttagatgaggtggtccatgatcttcacaaacagatgagacttgtgcagaaatgtgaatggtgtgagccatgtgaatacctgcaggaagaacagtcccctcagagaaaaaagtcactgcactggccctgagacagacccatgcttggcagataacaggaggccagggtggttggaacagagtgaatgagaagagggggctaggagatgaagtcagcaaagctctaatgaatatctaactctcctgagggctaaaaatcttccagtggcaagaggtggcttggtacaggataatccagtggtgttattgatggaagcaccagcagcatttgcagataggagataagtggagtgtgagagaggagacacggttgacaccatggtttttggcagagcaaatggaaacatggagtggctgttgactgggatggggaaaattagggaaaggtctggtgtatttttggagggggagaaacttacttttagatctgcgaaggtaggcacaatatttaaatcccttaggactaagtgagatcattcagaggagagaggagaagggaacagaaatcagaaaactgaattgtgaagcacgttaagagatcaaggacatgccatagatccaacaaaggaaactgaaaaggaacaaccaatgaactgggataaaaaccagaaggaaatggtttccaggaagcccatttatctctgcagtgtccataggagatgacacagagagcaagctctgtaaattttaaaaattctgttgaggggagtttggaattagcagccatagggaaatgtaaaagatggtcaccatgagaaaagcacaaggatttctgagtagccctgcagacaaaatgataattgagagaagattagggagttgtgaacagaaagaataaactcaagcttcaagtgagatggaatccctactccctccagaagaccttttatgtgatataaggaaacagtgcaatccaccataatatcataatttgaaaaaaattgtatcaactattcaagaattactacattcctatacagtaaacactttattatttttttattgacatttcattattttactataacgaaatgtaatttaatcatactggctctttagagtttctcttgaaatgtctaaaatctgtttcttagagcccatatatgtataagagtgtgtgtgtgtgttcgcgtatgcgtgcatgtgcgtgagtgtgcatgcacagatgcagtcagtatcaggctttaaatgaatgagctaaaaatttggcagagtgtgtcagttataagtttattttttgtgaaggcaaaaataaatttgttggataatgcgtttgtgagtagtagatcaatttgttcacatattttgcaaaagttagagcttattactcattcatgtactattgatgtaacgcattagaagacagttaacattaggtcctaatggcacctgaccaaaaggagctgtgggcctggcctatacaccttattgcctgttttcagcatcaactgatttagtgaagcagcaaaaagaaaaatggtgtgtgcagcattatctttctgccacagatacatgtttttaatttccaagtttccaatgcatcattcagttttatctaacgggaatgcagctgagagaagtttgtaacaacccaaaactacatgctaatatagtttagttttcaagtcttgtggagtctttttttttttaatggaataagatcatcagaaatccaggagcaagacagactggctgtggtctaccagcattgtagtaaaaacattggggaagttttataagacctaattattagaaaataccataaaatagtcattttcatagaaaaagctttccctttcctcacactgaatcacattactttgtgttcaaggtaaaatgtagtttgaaatctggatgtaaattagaaaagatattattttattccaagtgaaacatgtattcacacttcacgtcttgaagcaccagtggccatttgggctgagttttcaagaaaaaaaatttatatagattttatgccctttttttaacctaagagatattaagtaatagctattccactatcagacaatgtgcataaattctagtcagatttttcttttgattagtgaacaataggacaattttgctggatgtttagtatattcatggctgtcacatcattattaaattccagaatattaacatgctttgtgtgatgcatttttaatccatcataaaccaaacaatatatatttgtttactgttattaatggtttttcattgtgacgtcctagccttaaataagaacttcagcaataattataaagatggcatttattactacctaaaagtatgtcccaataaccttgatcatggataggaatactattttataaaataaatggattaaactttttttgcaatccttttctttctgattcagtttcagcccctcttgtgtcgcagaaggacttgacgactaccgctgcacggcttgtccacggggatatgaaggccagtactgtgaaaggtaccaacagccatgaaacgtacagagtaatgatatgtagggactatatggtaaagggtcacaataggaaaacattcattatttgaagaacttcaatatttgcatatcctttagaagtttaaattacaatgctttcaaaaccacttgtgtatcttagaatttgtccaaagaaagttgtttatttccaccgtatgtttagactttatcaaagattccaaactatttacaattatctaacttatgctttagtatatatatatatataattttatatgtaaatataacatttcataagaataaatcaattttcaaaagcttagcagtagttactactaataagaaactggctacacttttcttattttaatgcactggaaaatattgtctggaagtaactgaattcacgtcattgttctgaacactatgactacaccagcaagtgtatacataactcaaaatataaatagtatcaagaatttttaattagtacccagacaataaagtatttgttattcagttttccttttcaataggcaaacaatattatttaaatgttttctcttaccatattgcttatgaaatctcataatgcatgtatacagctgttaaattgaattctcagtgtaatccaaatggtaaattaaggagtacagttccaaactgattgtctagaaaagttgcaattaatatcttccagatatatattttctgtaagatcagtatcctggatattcaaacttgtcaccaccacttttggtatattttagatattatctttaatgtaacagagagttactaatgttaactactaacattatacacacatgatagttttagcataattgatagcagtataaaagttttagaaagatccatagacttcgctcaattccaacagttcagctacattccattttcctcatctataatctcaggaatcattgataggccacctactttacactaatattgtgacaataagtgtgtaaaggacactgttggtgccctgcctaggcacctacactgaagccttctctccaacagaagaggcagaaaggcctgaatgtttacccgcccttcctgcagtggcccatgactaaccagcgtgagagtacaaaagtccagctctttggcccctaagtggaacaagttttgagatcttattttatgctccagagcactccatggaatcaggctaagactgggacatcacctgaaatcatacccttgattagagcttttcttttccatgtcctgcttcacccactcctttgctagattctcctaggaacacttaaatggtaagcttctttgtaaatataaactaatactaattatcagcatccacttaagagtcttgttttatataaccagcaacagctgtattaatcatggcaataagtaactaaataattagggttaagctttataaatcccaatgcaatttttatacatttgtaaaatatatttctaaataaatccgtatgtggtaactctaaacacagtatccaatatttgcatatatataaaacagtggattcacaatttccataccaacagaaattagcagcaattaaataactcatagcaacaccaaatctaaaaatatttccatttgttctgaagatatatacatcttttggatatagatataggtgatacaagtacatacttgttaatacccaccagtgagctttggtattcatggttagactaatatttatttcctgtacctttaaacaccagtaggatggtgactaaaagcatcgctggacaccaaaaagattatctacagtaattcatgaaaaaaaaattatgatatagctacatttatacactgtagttaccattttctacaaaagcatgtgtatagaataggctagaagggtacactaaaataacaattattgtgttaaagcagaatgattacagaaaatttatttgttaatatccagtagtatttaatcgataaaagctgtcagtttgtgtagcatagagatgagcagggccatacagtatcaaatgtgagtgacttaaagtgtttttccagtcctcaaacattgttatagctttgcattcatcatctctaacatataaatgatcaggttatatttctctgaaaaattgctttattcagctatattaaaccaaagttcttggttaaatttttattgtaaccttccaaataaatttgttccagtgctgagagcttcttaaatcatttaaatcatctttcgacctgctcagactgatcaggttaggtctaaaactgcttaaatttcttgagtatccctgtaatatagaaacctctcctcatactttattttcaatactcttgtaataaactctttgaacatttaatcaatctgaatctgcttagaatacaattattttacctataaatgttaagaagccatttaagtggacttacttaaatgctactttcagtatttgtactctttcattgaaaaaaataatcaaaaacatgaatgtataaaagcctaatgtcacaaatcgttttcttcatgttttgccttttctaaccagcacagggtgaattaactttcacagtcagccatgcagatttcacagtctcaggcagctaaagatggtctatgattatcttgccagtatttatagcttttggctccaatcccctactgtctctcaacttcctcacatacttgcctgttgaacaaaaattctaactgtttgttatatttacactgaccatatataaaacttgttgtccaatctgggacactatattaaaaacaggcagtgtttttagcaattaagccaaaacaacaggtaataggaaattgtcctgggcaaaccagaatgtatggccctgctagcattgtgtaaagttaccaaacttccagtgtcataacacggagtgaaatacacttaggtgaatggatgcatagatacgtggaagagtcaattaatggactgcatttagggttcatccagttggattctctttctacttttccaaatcagtgttatatattttgtttgcatatcattaacccacttccacagatacacatgaaaaatccatcttgaggaagatatggcaaaaagaaaagatgaataaaagtaaacagaaaatctgagtagcctattgccacttaacttgcctcttttgcctcattggtaaaattaatgggttgtattatttggttattttgagatctgaaattcatgagtatagggaagcccagaagtcaatatagaattgcactcatctctaattatacaagaggacttaacaaaaaagtttatgatctagagcagtcacagacaaactatgacccacaggccaaatttggcccatttctgattctgtatggcactcaattaagaactgttgttacaggtcagcatttacaatcaatttgatgacaggaggcactaagttataacccaaatgaaggataatttcaaacctcaggaagaatccaattcttctcattagtagcctgatattacaaagtaatttaacattattattattattattattaatgttttcaattccatcaacaacagcagaatgctttagaattttatttctttttcacggcataatcttgatttttcctatgtcctgcaaagcctactgtttactatctgaccctttacaggaaaagttaactaatgtatggactcttgctatcagttttgttgcatcaaaacaaaagaccacacacaacaatgtggagacatgacttgctattaacctcttttgctttgtcactgtttcaattcaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgtttgtacgtatactaactttgctgttagttttggaggccttgattccagttctgtctcatttccaatgagaaagagtgactctccccgcccgcctttttttttttttttgcaatagttatactcttcattctttctgacactatctatccaccttctgctgttcacctgctgattgcgtgtccatcctgctgagccaagaacagctgagaaaatcctcagtgtgctttagtcagttcattgaaagacctacaatgaagctcctggaggcattttatttgatttgtccatctcagggtttacagttttgcctcaagttggcattgcctttgtgacagattaaagatgtgagtgtattaaaaaatttagaatcctcctgaatttgtaatcgactggacagatactttaagccttgaatgacaactgatgtttcttttcccagcttttatgaaaatccatgggcatactgcttcataattttctcttgaactacaaaacccgtaagcagtaacaatgaagtcaagtatttttactcacgtacagtaagtggagagcagtttgctctcttgctgtctctcttttttcttactgattctggattcgctagtgccatattgaaagtacattgaaatcagtagctaaatataattcttggatcttgcatacattcaaatccaaaataggttatttataaatttaaggaaggagtgctcttctatagtattcttttcctcaaggaaatttattttagcaccttttatttcaacatttacctattgtaatagtatttgtgcatgtcaacatttcttgttttagcatattgtttgagtctaaatcttaatagtatcttaaatagaagaatttttgtttatgttctagttttataagagttaacctcagaagctaaagctggattaaaaaatacaccaaaaagttaagactgggtgttatttgggaaaatagattttaaaatcattttttctttgtattttaaccatctttaatgaaaatgtattacactgaaaataaatgtgaaggtaggtgagaggggagagattaaatgtactgtcaaatacatttatattgtcatatttagttgatagtatatacacactaattcttcccaagtataatgatatattttaatgataattaaagaagtagactatcaaagtattttataatattgctttcaagtcaaataaattattaacatgcacataattaactagataatatatagatattcttaatgtaaacagtccttgaattattaatcatcacttttattaactatccagaagcaaacttgaaataaaaagatcatattaatgttaagcacaaaaattaaacaatagtacattaaaatctggggtagataatataatgggattatttggggaacatttcttttaaagagaattggcattctgcccatcaacaacaatggctttttcatttattgttgatgatcaatacttttttaacattttgaatacatttatcattagaaatcgtaattcatcttttccctatcacatatgtgggtttctaatctccacttgtcccatgtgatattaagaaaagggccaatcctccagttacaaagctacaccagttttataattcttatttgctttattcttgccccacaaggaaatgtatttacaggggttatacatggtatttagttcagttgctggactggaagtgtttatattctttttaaaagaatagcagtttttattccagaaaaaaatattaaattataggattgtttttgatatctagactcttttgctaaagcacagttaattatcttataattatgctgtatagattttccatatactgctcttaagcattagtgatttccacttacttctaggaatgttttctcttcacctttcactaaactaactctaagaattgttacacagagtatctttagacttttcatcttttctcttcttctaaaatttctcccgttatggaaaaatatgccatgattctatgatcttggcctttcccaggattcggtttctacttctactcctagttttgaaatcagataaaataagacacaagtgaggatgtaattctgacttattctcaattttccttttaatatatttctgtatccttaagctaaattagtgcaagagaccaaaaaatggattcacctggggtgtttgatctgcaggacctgttttagcacatgtaatcatggtggaattgcataaggcctgggggtgagagtaagggaggtagcttggctctagcaagagaatttagatgtagtaagagaaatgtctgcagtgcttgttgttagtatagtactgactacaggaaataaactttctcctattgcttagaataagtaaacactcagtttagtagcatgtattgtacaagagttaattttgcttcctttagttacttccctgggaaatataatttagactgatccacatcatggatttgtgtatttcaaaaacagaaaagaaaagaaagagagacagaaatgcatgataaatgacctaagcctgatcattgtgtgatctcaggtaatttgcatattggtgaaaggaatctatacactcactgtaaatttagtttaggctcttatttctcaaagtatataaaattctgctgaagagatcaggcaaaacaaagccaatgcaggaactgtgaaaggacttcccttggacaccttggtccctaaaagatacttatagcttccagggacagttgccagtgacccctggattttactggatccaaaatggaattttttgcagcacacaggccttttatatgtggattttcactactatcatgaagaatgtatacaaataatctgtgtccacgttaggaacctatttagacatcacagtctctcatagttagtgacctaaattcagccccaccatgcagagtcagttcctgagcataactaagcaatttattcaccttcaaattccaggcattctctaaagtcccttttaccacacagggttcatcataatagtaattttatttaaaggctcaccttgactgagaacttaccatttgccaggcactatattaagcattttacacgtggttctttcattcttgtaacattcccattccttatcatccccactgtgtgataagagaactgaatttaggtaggttaagtcattttctcagtgacttttcagtagatccgtgatttgagcatgggtcagtcttacaaatcttattttcttaacctctatgctggctactgataaacagagaaagcaaacgtggtttagccagtatattcaacattaatgaattcagccctttattcatttactgcttccatgtttagagcccattctacctcgattaaaaataaatataaaacgagctaaaattacaaaatgagaaattttaagtgtatgtaatctcagtaatgacatttattttctgctaatcattgagactcctctaagatttaaaacattatggcatttatggtagattccttttcatcagagattgtcaagtagagactgtcttctatgcagaagaaaagatactagctgggtgcccagattaacttcacagcctctttttttctaaaaggaattatttgggacagctttacaatgttatgtaagttggtgagttctgaagagatattttattaatttcccaaattaagatttcttcttgataagttaatacaaatccatcctcctctttcaactgtcattcatagttcacatgtcattttataaaatgagaacaactaacctgccttcaagaaacttaaaaatgaacaaagaagccattatttgcttaacagtaaagtttagtattttgaaacacaaaacttggatttgttcatatcctattttctgtaaactcatatcattaacacagaataacccatgtgatgtttaaaatagattatgagtggcatagtaaaatgtattactctcctagagaacagaaattaaaattagtatctgttggcaagatattacttcataaaaattgcctgaaatagcattttataaatatcaaattggtgttgcctatttttaatcactgcatagtggggtttttgggatatatcagcttttattatttatagtcacaatttacttaaattctaacatatatttatttaaaataaaacatacactttgcttgccaatttgcaaaagtgatcatgaactatgttttctacttgcaacctgagataagcctagctaaatgtggtaattttccttaactctgtaaaattggcaacttccaaccacttggtgaaaccggaagtctgaagttttatcctatcttgatctacagagatataatcaacattgtcgtttttaatagccagttgccaccaaagatctgatcacaataatgcagagacctttatatattatcactagaacactgttgtacatttataatcaaaaatgattaataatggcagtgattgccccctatatatgggagcagaaacaaaatagaatgtggttatcactgtaatgaaaacaggacttactattctgaaaaatgatgataaacatcagttgatctccagatgctgattactgatctaacactttgcttgttgtaccccctaaatgtcatcctctctctgctcgtactcactgctcaagtaagttcttatttgaaaggacagtaagtatgtcatagttttctgtagtctaagctgtgtcatgttgttcacatccaggtgttaggcaatctataaaacatcttctgttcaccttgtttgcaccttctactcatttgttttgttagtaaaagatatttgagtttcttgttgtcaaccttagcattggtccaggctaacaatgtgtggaatggcaactatcaccgtgattctagatgattttcctagttgttagagatcagtctcagtggtttgtatattattgaggaagctgttctgctagctgattaaggagttgcacagttgaattatcgtatagagacagctgatcactgttgcctttgttttcagcaagttttatttgaagagtaaactaaactctactttgattgcaatttctactctggcaaggctcaggaggttttattgaccttgaaagacaaactaaaatcacataatcttaaagttggaagaaataagtaaactagcctagccttctctttttctgtgacatccacaaaacagacagcatcctaatgcaaggaagcatggtgttatgaagtggctacagaaggtttgaaacctagcttgcaatttgtgtgacattatttaatttcctaaacctcattttcatcctctgtaaaatggatgtaaaatgctacatacatgtatgtgaagtatctaagcataataggtgctcaataaattctaggcattgttatcatcattgttattatgtgaccatttttttccccaaagacctgatgttttgtgcaacgcatcagtttctgatgaaatattttctttagtttaggctgactttcagtttcctgttactatctctaattctaggttcttcaagtcactgaaaaccacttttatggccaccttacatttctcctgtctttaagcccttcacatgcattatttatagattcataaacactctggttgtgactatttttctcatctgtaaaatgaggatatgaatggtacttacctcatagaattgctttaaatattaagtgagataatgatggcaaagtataatacattgccagtcatgtagtgactgttgtgtagataaaaactattatcccattattatttatagtactttcaaagtttccattagtgttttgaagagttacaccatctttgaaccacattgaacttgttttcccatgtattatatatagaattttatttaatatatataaaacacatatatcaatatttaatatataaaaatatataaaatatatacatataaaacacatatcataaaacatatatataaaacataaatatcgttacttggtatgtcgacaaattcatcagtctcagctgaggtctacagctttcctctctattcaaagaaatgacaggttaaaaggtcttcttaatgactctggaatcaaatttttatttgagaagatatttattttaaaatagaatgactaaatacatcttaataagccctaaatatatgctaatgtaaaagtttctttttgaaggggaaaaagggaagtgagaaatagaaaattcagatccagggaaccgtcaatggcattcatctaggagagttaatttaacatacacacattaacacataattttatcttttgttaaaaatgtgtatttactcattttattcctatttgattagagcagagaatttatgtatcgctacctaaaattggttaatagctttcgccctttcaaaaatactcagtgtcctcattttagcttcagcttctttggtttggatgcagtgtgtgattttttttgtgacagtaagccagtagttattatgcatggggaatcctggtagaaatgcagtattttgtgctaattgctaacagaaagatctgtaatactggctgcatgatttgccccttacatgtgcccagccataacaatctgaatttagtactgtgtttgttaatattagacacaaatttatcctgacacttttataggcaaagcctcggaaacatttagtcatgtaaaatataatcatggtcttgaaatatttgcttttgctcctgtgcattttaggcaggatttcactttgtaaccttattagtattgctgaatttggagaatggtttggaaaggttctttgaggtcctgattgtaagataggtgttcatttacactgagccattactgcactttatcaaagaacagttgtttacagaatgtgaatattccatgtctctacacactcttcagattttccctatgatagtaaattacatttggttttaatttgcattccatttccaatgtttgttgccagacactttggactttttgagggcaaataaaagtagcttctggtgtaagtgaaatattttgtgtcagaataaaatagcaaaccattatgtaaagggcactttccccatgtgtttaccttataacttcatgagctagacttgtacagaagctttgaaaaaatccccatggctgtcatattcataagtctctctgacccattcagacagatgttagtatattgcttggagcgtactataaaacttacctttcacttatggaaatgtgcttgtactttgttccccaaaaagcaaatacagataccataagacatgggataataataaacctttggacacagaaacataaaatggaatgtatgagcccttgaaagagcaattaaatacattttcatttcaacagctgaagatgaggaaccaaaacagatgggcaggggatagaataaatgagagaaaaatcagtattcatcatgcctcttggcattctagtacaccgtagcatattacagtacatcagctctagttctgcattctggtccctgatttattcttgtatgaagtaaaaactgagaaaacgataggtactttccttggaaatttctggaaccatctagtaaggagtatctagccatcctgttatcaacaaactgattcaattccttcttggaaataggtaggttatatattattaaataaattaaagaataatttaatgtttgctatcaaaggcacacactgccctaaaaagcatggtgaaacatcctattatcattaccaagtatctttaaagatcttggaggtgaaaaaagagcaaattgcttgcttgcatcctaggaacatctgcccaaaatacatcttcactagaggtcaaatggaacttttaaaacaatgatgaacttgggctcagtgagagaagaaccttcctattcttcataattcctaataaaattataattgttactactgctgtttttaacctatgaattgcagcttgaaagtctctgatctgaatcacatgtgcaaaacttgaaaaagtgtgtcagttatcgattgtatcagttatacattccaaagtttagtagcttaaaacaacaagtgcatacactctcatgattctgtaggttggcaatttgggctgagctcagttggacagatcttccactgtcacgcctaggggctcccagatggcctcaagcccaaattggggcctcaactgccctttcctctctcacgttgcctcccttcctcaaggaggctaacctgggattgttctgaaggcagcaggggtccaagagtgtgaaagcagaaagtgcaaatttcaatatgttgctctgccacattctgttggtcagagtatgttgcaaagctaacccagattcaaggggaagggaagtagacttcacatcttaatgtgaggtgtggcaaagaagtattaacagtaacctttttttttttttttttttgagatggagtctcactctgtttcccaggctgaagtgcagtggcatgatctaggctcactgcagcctctacctcctgggttcaagtgatactcctccctcagcctcccgagtagcgggactagaggcacatgccaccacacctggctaatttttgtatttttagtagagatggggtttcaccatgttggccaggctggtctcaaacttctcacctcaagtgatctgcccatctcaagcctcccatactgcttggattacaggcctgagccaccacacccagccagtagtaaccatttttaattgtccccagaaatgatcatcgctttgatctgtcagtcatggtgttctttcctcctaaagttttgtgctgattttcttcccgtccatctctccctttcctgagtcaaaactgaaatccttcaggcaggtatctgaatagtcattcttgttgatcggacagtctctgcctctgcaatcacaagatagttctctttctgtctctaaaccattgtttttaatgtattctcctgttcctcacacatctgtgaggttttctatcttgttctcacattcagaagttttcttccggccaaccccaacctcttccctcttcccctcttcccctctctcttctctcctaacattctacctccctgatcttctcactatttcatgtacttgggcacatgccatgctcaaacattaacccttgccattctctttgtccaaagtgttttgatacccttctctcacaaaaatattagcccacaaatatttactgaatattaactgtgtacaagaccctttcctaggcaccataaccaaggtgtttaaggtcccttctttaacgaggaagaaagaatatataaataaattaagtaataatgtagcccaaacaggcataagtgttaagaaagcaaaggaaatgcagtagtgactggcgcagggtatagggctgggggtggtggggagtttcaggtaacagtaattttagaatcatcagggacttgctctctgaaaaagtgacacttgagcacttgacctgaacacctaggaaccaggtgggagaagaccaagggagaagaattctaggtagagaagacagcaagcaaaaggacctcttccaaatccttgctcccttgaagattgagcatccctataatttatcacctggtccagtggttttatcctttggctacatggtttttcaattactggaatatttttaaaatacagtggttcacgcctatgatcccagcacttggggaagctgaggtgggaggatcacttgaggccaggagtctgacatcagccagggcaacacagcaagaccccatctctatgttaaaaaactagctggatgtggtggcatgtgcctgtagtctcaaccactcgggaggctgaggcaggaggatcactttagcccaggagtttgaggccgcagtgagtcatgatcacaccactgtactccagcatgggtggcagagcaagaccctgtctcagaaaaaaataaaaatagaaatactgatggttagaccttaccacagacccatcaaaaatcatattctgtggtggtgaggagggaaagagcccaggcatctgtattttataaatgttcatgtgattccaatgggcagccaaaggtgagaaccactgatccacaccaatgttgtcacattctaatgtgcagagataatgtgggacgcagattctgatttcctagatctggggtagagcccgattatacatttctaataagcttccaggtggtgccaaaactgttggtctgattgctactcaaagtgtggtgcacagaccaacagtagcaatatcacctgggagcttgttagaaaagcacattctcagtcagagactaagagaaaccaggtgatcaaatcacctcctgattcagaaatactagggggtgtggaccagccctctaggatttccgaaagtcctactggtggttctgaggcccactaaagcttgagaaccagactgtggatcttggtgtttagacacagtcaatttggcacttaactgagttctatgttgtgttttctctaattgtttaatgtggacaagtctgttgaagtttgcattgaacggggctatgaagccaaaataatcttttacttggtttccatgcagtgcaaatttggtttcattctggctaggagaagagtaagagatatagccctagttccagacttctgctctggcctccaaagcctctttgttcattcagcttgtgaagcatcaggagcttgcaaagcccctgcaggtgacgctctacagttgtcacctgcaagaagctgcaggtgtcacctgcaagaagctgatttattaaaagccctgccagggcagtttaatccctgtgaagtgatattgtaactcacctctagctgctgtcctatcaaaaaatcactctccgtcctccttctctttgtttacaagcaccagttaatggttttctctccattaagcagctcaggggactgctgtttagagacctaattgaattcttgccaagtttgggcatgatccagagctgctccaattctcggtattttccatgctatgtattttcccctattctaacatgtatatagcattgatacctctatctgcagaatgtaagaaattgtaactgtatacatgagagtatattataaatgcagtagttcctgctccttggcgtgcagatacacctcattactctgcaatgcaaaactaaaaatatacatgttttttaaatctgctaaaagattcaatatatgttaattttggaaattatacgactatttatgagatctattccataatgaagagtcaacaatccatttgtctctctaccaattctaccacctatcctggcccctaccaccaaatttgaatagcacctctttgatggccaaaaatattatggtgagtgtattagtccattttcgtattgctataaagaaatgcctgaagctcggcaatttgtaaagaaaagaggtataattggctcatggttccatcaggctgtacaggaagcatggctggggtggcctcagggaactttcactcatggcagaaggcaaagctggagcaggcatcttcacacaggcagagcaggaggaagtgggggctggaggtggcacacacttttaaataaccaggtcttatgagaactctgtcatgagaacatcactagggcggtggtgctaagccattaaaaccactccagtgattcaatacctcccacgaggccccatatccagtattggggatgacatttcaatatgagatttggatggggacacagatccaaaccatatctggtagaatattagcattcttggctacttaaagaatatagtttttctagcctttagcaattatttatctataagactgaaagaggttaatcatcaaagtagggatttgtgagactgcatctaatcatgggtggtaatagactgaagggataaagaggaacagttggcaaataaataagtcaataaatattatcataagaaaacactatagaaagaaaagttatttttattttgactttttattttattttttggggggtggagtctcagtctgtcgcccaggctggagtgcagtggtgcaatcttggctcactgcaacctccgcctcccagtttcaagtgattctcctgcctcagccttctgggtagctgagactacaggggcccgccaccacgcctggctaatttttgtatttttagtagagacagggtttcaccatgttggtcaggctggtcttgaactcctgacctcaggtgatccacccacctcggcctctcaaagtgttgggattacaggcatgagccaccacacccggccttctttagactttttttttttttaattattctactcaatagataccaagctaaaaatttatatactttttgaatgtgtaatacataaagcatgtggaggtcaaattactatgactttctccagtgcaatctaatggagcaccacacatttagactctggagcatgttttattccctgtggacaggttcctttcgattgctcatgtagggatttagggggtacttttaatgttatattctatgccttaaaggaaatcttcaatacttgtgcaatacactttttctccccaaatctatttgctcctcctctttggtccctcagtttatattatcgcctctatttcaggttctgggcgacatgcatatctgttcttttgttgttgttcttatctttcctcaaccatcatccatttgatagcattaatattctgagatgagtagtttcatcttccatggaattattcttggaccataaaatatttcatagctgaattctttgaacatctgcctgggatgtttagcagaagtaactactctttgtcacttctctttcacagtttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaaggtaggttggtgcagtcacaagcaagggccagggacaaggtgacagaagcttcacaagcggtattggctgtaattggtaaatgttcttcccacagccccaaatcaagggacacaactgttagggaaattcagagactttcttaaccagtgtttttcaaactcaagaactataatatacagatttctattaagggaaaagagtctcatgtaccccccagtgtctggcctaaatcagttttattatgtcacttaaatatgtgcaaacataaaatcaggtataaactctttatacttatagctctataaaattaaaacaaattaatccttacaaaaccaataaaattcaaattaaaaacattaatataaagtaacatgattttggctgaatggaaattgctgcttgcaacaagaataggatattgactattttcacacagttcttccaccagagatgatgtggtaactcatttctcctaccttaccacatttgaaccagagagccccctacaaagggtcctgaaatgaatgtgagcatcacttgacaagtttatgtgactaacgtgctcagtctgccataggctcaaacacacaggcaaatgtaggcactgagatcaggtggccatattcatctctcaggtgcctagcctgggatccagaaatgcttacattaatatttaaggttatcatcaaaatgaaaacacatgattagaatcttgtactaaagagctagaactagtagacctttaaaagttcttcaacaagcaccagtttgataaacactgttctaaattgtggttaaagcttttggtagttaacgaggtaggagaaaacattaaagaaattggggttgtttcacctgatggaaaaagatgaaaggtgtcaacttactatcagtcaattatcagatatttattaagaaattatagaatacctcagcattgcacttggttccctggggatttcatgactcttttaatatcttcactacccttaggaaatgtagattctatgtgctttaaaaataatcattaaacaataatcaagcaattagcaagaatacataatgaccatgtgttttacaaacattcaaagtacattagcgcacagagactggagaaatcagtaagattcagggtaaccagagaatgtaccattactgagagtataatttctgttggaatttgaagtgtagacacaattttagtagagaagtatttgttgctttagaggaaggcatctaagatttattcactacacattggtagatattcttttaggaaatatattctttaattctgaccataacctttaaggtaagtattattatccctattttccagaagaagaaaccaataatgatgataacaagaataactaacatttattgaaaagctaggcaattgactgaagtcttaaatggattaccatacatagcttttacagaaactccaagaaataggaaagaagttgtcatggtctgaatatttacatctccccaaatttatatgttgaaagtctgtcacagtccattggagctgctgtgacaaataccataaactgattagcttataaacaatagaaatatatctctcacagttctgaggctgggaagcccaagatcaaggtaccagcaatgttcaatgtctagtgaaggcctgttcctcacagagggtgacttcttgctatgaccccacatttaattcatttaatatctggatactgaggaaaaggatagctagctctctggggtctctttaataagggcactaatcccaatcatgaaggctacattctcatgactcaatcacttcccaaaggctccacctcctaatatcatcacattgggaactaggatgtcaacacatggatattagaaggacacaaacattctgccttctgccgtgtgaggacacagggagaaggcagctgtgcttaacagagccatgtgagcagaggcagtggtgtgaattagatctgtctggcagatattaaaagtcagacctgctagtgaaagataaggctggagacttcagtgaggcagggtgatatgatggacaaccttgaaagccaggcagaggaacctgagtttaccttgtggtcctggtattcagggaagtgaagagttttaatgaaaagaatgccgatcagttattttccttgtatatggagagaatacagaaaaataaattaaactagaaaagcaaacattttagttgaacatgaaacattttaaaactaatacttaagcaatggatgatgaagtaaagaggatcctatagaagaggctccaatttgtgaacatcttctaagccaagggattcagtgacccatccacttctggctggatattgatccagatgacctggattatccttaaattctagtctttcttgattttttattttgttcttcttccatcattcacttgacatttgtatactgaggatcaccttctggtattataaaaacttaagttatttcacctctttgctcaatttctttaactatgtcagtgctccccaagcttcagccaaagaccatcaaggacacacatgtgatggaacaaagtgggatttattaacttgttgcaacaaggggcactgaacaccatgggggaattgtgggctgtctcaataagaaggtgttaggaataacttctagtatttgaggctgtgctagataacttaaggttagcactcaactgggtgctattcagaagtgggagtaattctgtgagtattttgtgaatcctatctagagggaaggaagaacagagggaggataaagctatgattaataaggaggcagtgttcattcatattagccaggaaatgggaggttggggtagttttgtggtctacacaaaacccgctatggttttgtctgcgcttagacattacagggtagtctctttttttctgtttcattcatcactggttcagagtgaccttgtctaatttagtgtcctatgagattatttatgttccataggaaaaaaatatggccctgctgttaggccagttcctagcaacaccgaggacaggccagttagttagcgcctagccaggtctctatgttaaggcctgccgttctcttttttacctgtgatctgtgtctctgttaattggaatgggagccttaaatgggccaggcaaggagtttatcttaactctaccccttactgactgtgtgatctcgtgcacatttttaactgtcttcaagacagtttgctctttcatgaaatggaataatgcttaccccccatagagctgttgtgaaaattaaatgaaaaaacaaaacataaaaagcctggcacatagtaatttctcaataagtcactgcaatttttattatttgcctgaatatttggcatgacactcaatgtgtaagtgcccagttgaaatagtttccttatcttttctttgaaggtgagaaggctaagttccttttatatacaaaaatgtgttctgtcgaacactatcactgcaaggccatttactaaaaatgtttatgggatggaatctttttcagcacttgctgtcacctcagcgggccccagagaggcttattcagctggcagagggcaatctgaatacactcgtgaccgaaatgaacgagctgctgaccagggtaaggtggcaaaattatgaatcttctgaaagcagatagattatgtcaatgaaggaaaattacttcaaagttctgaaatgcaaatcaccttcttcctaattcccaatttggtatataaaatagatgtattctgacttgctaattctgcttcaaatcaaatcatagaaatcagtagcacgcagaaaaattggggatacctggaaattgtcaatggctaaaaagtccagaatgacagtgtattttgagaactttattcagtagcctccgtggtaaagtttgtatctgttctgatttccaaaagcactatctttgattgtgtaaagagaaagaaaaacaaatgaaaatgcttgtggtctctttcatctcatcgtgggatttttgcattagtatagaaatacagtgtaaatcagtctttccacacaaaagaggaaatcttctctattgtgagactccaaagtgcttaagacactttttaaagtcagaatgtaaagtccatgttgcatttatcaggctttttaaagaattggaaattttaaattttcaaaactgcgatggtattaaaaactttttgcagttagagaatgaagaaaacaacataaagcccgccatcttgtggccagaaatatgcatgaagctagaaacggggctgcaaagtacggatttaatttgattatctaagagctttaaatgataaagagtattggagctagaaggttcctggggattatcgagtccactttgtattttaaagaagagctgcctcgggccatgacagtgaaacgaattaacaatggccatacaatttgctaaactcagggacttaagctggacccagtctcaagattcccactggcccagtactttttctacatagcctgctgtcggtttaggaaaatatccacaggaaaatcaaataggcttctgagcacataatgctaaacaacggccctgatgttacaatagcatactaaacactttttcagaatctcatagcaacaatatagaatgtacagatacaacacggagtttcttgccaaatgtatgtagacattagattaaattgagtgcatttatctcatattaatttaatatgaaataattcatatttgttataaataagaattttctaacaggtcatggtagaataaatcaatttaacaagcacacataaatgttcataacatacaaagcctaagttacgtgttggcagatgaaaaatatgaatgaggctcaatctgtcttcaaagaactttgagatgtgtgtgtgtgtgtgtgtgtgtgtgtgtgtgtacatcagcatttaagtgtatggaggaccatattagacaactgcatgcaggtatataataaaacatgaaataaaataaagtcggaagaaattctggagaaatatttaataatagaataatttcatctgcttaggggtaattagaaaaaatttcatgtaataaatggcatttcattcattcattcacttaactaatactttttgggagtctctcatgttctaggaattatgacactggggatagaagtgtgagcaaaactgcgcagtccttgccctcattggcttagtatagtctaatgatctgacgttagagacacaaaaagtatttctttttttttttttttttgagacagagtcttgctctgtcgccgaggctggagtgcagtggtgcgatcttggctcactgcaacctccgcctcccgggttcaagtgattttcctgcctcagcctcccaagtagctgggattacaggtgtgtgccaccacacctggctaattttttttgtatttttagtagagacgggtttcaccatgttcgtcaggctggtcttgaactcctgaccttgtgattcgcctgccttggcctcccaaaatgctgggattacaggcatgagccaccgcacctggccacaagaagtatttcattaagagtgtcagatctttattatgtctcaacctatactctttaccctttccagcagattgtctcatgctatgttttttaaacagactttattttttagaacagcttaaagttcaaagaaaaattgagtgtaaagttcagagtgttctcatatctactccctgcccccacaaccttccccaccagaatggtacatttattatagtcgataaacctaagttgacacctcctcatcacccaaagtccatagtttacattagggttccctcttggtattgtacattctatgggtttggaaaaatgcattatgacatgtgtccaccgttgttgtaaaatatagaaaagttttactgcccgaaaactcctctatgcttcacctattcatacctccctcttccttgacccctggcaaccactcatatttttactacatccatagttttgccttttttggaatatatagctggaatcatacagtgtggtactttttcatattagcttctttcccttggtaatatacacttaaggtttctccatattttttcatgactttatagctcatttctttgtagtgttgaataatatttcattgtttagacatatcactgtttacttattcattcccctactgaaggacatcttggttgcttccaaattttggcagcatgaatcaagttgctgtaaacatctttgtgcagacttttgtgtggacttaagttttcaacctatttgggtgaatataaaggagcatgattgctggatggtatggtaagagtatatttagttttgaaagaaattaccaaaatgtattccaaatggtcttttctattttgcattcccaccggcaataaatgagagtttctgttgctccacatcctcaatagcatttggtgtttttagtgtttggattttgtcattctaataagtgtgtatggtatctcattcttgttttagtttgcaattccttaatgacatatgatgtcgagcatcttttcatatgcttatttgccatctgtatatcttctttggtaaggtgtctatttaggtctttttccattttttcattgggttgttttcttgtcgaattcagagttttttgtatattttgggtaatagtcctttatcagatatgtcttttgccattatttgcttcccctctgtggcttgtcttgttctcttgagaagtgtctttcacagagcagaagtttttaattgtaacgaagcccagcttatcaattaggtttctccttgttgagcctttggtgttgtatctaaagactcattgccatatccacggtcatctagattttctcctatgctatcttctaggagcgttacagttttgcattttacacttaggtctataatccatttttagttaattccaatactattttaaaataaactttttactttacagtagttttagatttcaaaaaacttgcaaagagagtaccaagagccttcacatactccattcccagtctccccattgttaacatcttacattagcatggtacatgtgtcatatacatgttatatacatgtgtcatatacatattagctcatatacatgagctaataatattgaaatattaccattaacccaagactgtattcatattttttcagtgtttactgaatgtttttttactgtttcaggatcccatgcaggatactacattacatttagccattgtgtcttcttagggttcctctagactgtgacgacactgtcaaaaatactgtaacagtgtttctgatgactttgagagtttggacaggttcatgtgtttggtaagctgtccctcaattggggtttgcctcatatctttctcatgattagaatggaattatgagtttttgtgggaaaaacttcagaggtaaagtaccattttcatcacatcaagaacccatgtgaccaatatgacttattactgtggatattgaccctgatcacctgactaacatagtgtttgccagatttttccactgtaaagttactcttttatgcccttttcatactctaatactatttttatctgcccattcttcagattcagtaacataaaaggcgcagaaataggactactgaaagcaaagatcactttgatgggttgagaagggggaggaaatgtaaatactcattaattacttttttcctaccatatttataattacaaatatatcttccatgcagaccataaatactcaagtcaacatgaccaattctctctttccctgtggtcaagctgcatgacaatcaaaaggtgaattaatacagatggaattataattagagagttagatggtttcattatccaaaatcaggctaagcacgctaatgcctctatctcagagtcatgaatgatcctgcagttgtgaccagggtatgagaaatgcagtggccacaacttccaattacccatgactacattagaggagacagtgctctagactaggactgcacattggaattaccaggagccctatctcacacccataggttgtgatgcagttggtctggggtagagtcagaccactgggatattcaagaactccccagattatactgataaagaattactgtgatcctgtagttacctaatagctaagactctcttccctctggaaaatgccttaattggtactgccaatcttttttttttttttttaaacagagtttcacccttgttgtccaggctggagtacaatggtgtgaactcagctcactgcaacctccacctcctaggttcaagcaattctcctgcttcagcctcccaagtagctgggattgcaggcacctgctaccatgcccagctaatttttttttttttttttttaagtagagacagggtttcatcatgttggccaggctggtctcgaacccctgacctcgggtgatccacccgcctcagcctcccaaagtgctgggattacaggcgtgagccaccatgcccagcactactgccaatctttgttatgctcctttttctctgcttggttggctcaccagtcacttgatacagtctttagatttaagagcacatgtcaaggttgatcctgcatgactgctgtaggagctaccctctcttctttaagggcttttatattttatactcattgtttttaaatggagaaatctaattccctaatatccctgggtaaagaagacattattccacccaagaactcatatttaaaatgtattttgatatattttaattcatgtataaatataaagtaaaaaaattacataatcatatatctctttcaatgcattttgatttgttgccattttattttactcactggaagaacccaagttcctcacatatgagaatcatgtttaacatattcaaactgccctacagtatgtgtgaaatattaagatgctttttgatgatgactctacttacctctatagctattgtccttagctcctttcttttttcagagccaaaattttttaaagacttggagacaagtctgtatttatttctcactccactgctgcctggattttcactcccagcccactactgaaactgtttttataagataaccaatgacaatctggtaactaaatccactggatacttattaattttacttgaaatctctgcagctttgatctttccttccttcttaacatactgtcctctctctgtttttctcttaattctccaacctttcattctaaggctcttcctctcatcatcccttcaaagtcggtgttccttggggactaggcctcagtccatgttttccctcactgtataacactttctttggtcttcaattgccatgtacaagctgttaattcataaatctatattttcaaggctgacttcattctcatgctttggtcctatgtgccttactatggattggacatctcaaactaaactcatcatttcctcttaaagcccattatttctcctgtgtagaacatctcagtgttttatccgccagtatatgcccagtctcccaaagagaaattagcaggttgcccttcactctactccctctttcatccttcatcaaattcagtttccttctatggtgactctttgtaagccttatccaactctaacctgttgttatttatatggcagagtgaacattctaaattgcagatcctatcatgtcattctcttccttaaattgtactatggctttccacttttttcaggatgacatacagtgctctcccaccatgatctaatctctgcttctctctcatctctccccactactcatggtctggtcatctggacccctacggattgagggtataagccagaaacctacaaattttctttggtgcctctttcttcctcatgatgctcctgcttatccaattcattaccacacactgggcttccacttgtgtgtatggcattcatctctactaccccactctcatccaatctcatattgtgtagtttgggattaccacatttgttttttagctggtctctctgcttttactcttgttctcctccaaatctgttctccgtaacgtagccagaatgaatgtttgctattccaaatgtgaatacgtcatcgcagtgcttacaaactcttcccctgacttcccttaggctcgtaggataaagaccaaaattctccccttggccacatctcccatcacttgtgcccctggccatctgcactccagccatactgtcccccagccactttgtcccaccacaaagcattgccacacatttctttattttgccttaaaggtaatctacctctccctacattttgttaatttctgttaactccaatttacctttcaaatctcagctcgtgaaagccctctgtgccatcgcaggggttccaagattcctcctgtgcttatcttataccactatttttcctctagtttgtagttataaatttatctacatgatcatttgacaaataactatatagtccaccagactatagactccaaatgggcaagaaacctttttgtttcttaccacagtatcaccaatattgtacacataataggtgttaagtcaatatttgtttaattaattgtgaatgattttaaaagcatttgaacaacaagatggaaatgtagacaaacccaaaataaacatttattttgcactctttaaaatgtgttaaaatcaggcatatatttataattatattgttgaatattttgttttcattgataaacacctcttaactatttatattctgtaaggggagaatgctatgtagtagattgaactgtataaaatattaaaattttgtttcacttatattgtattttattgcctattgaatatcaaatttaatgaaaatgaaacatttccaaaaggatgaaactagtttttaaacgatttaagtgccaatattataagtttacaagattttatttatagtttttaaaagatttcaactgctaacagtgttttttatttctccttttatatttttaaaagatatatatataatataaaacaagtcatatctttttggtttggaacttttaaaattggcacgtgaaatatttaggaagaaattccacatggaactggctcattgtcattccacggggtcagctggttgctccttctttccttgtgtgttgttggtccttatggcttgcctgatgagtgcttcactaccacttagacatatggagctggtaatattggaagatgacccttgagagtatcatataaatgatttgatctgaaatctaattttagcaggaaaccatatgagtccacaaatgcaaaggtagacagtatctaagcaatgttatctattcagtagttaggtttgctccattagattctagttttaacataaagaaggcagaaaatgaaacacactggtcatatccaaccaagaaaattatgtgcagattttaagaggcacagtagaactgcttgagctaaagcaggaaagtaacagctacattgttcagaagtaaattaacgtgtgcctaatggtaatgcatgctgcctagacataaatactctaaaaaacaaaacaagaaaaaatagaaaaagaaatgggaaaaaaaaaacctagttgagtgaatgtcaacataaaagaaaaggtaatcaaaggcaagagagatacaagatactgtgtaaggcatcatttacaaaggaacactgtaaagattgcagaatagaggtaagagaatgttaaaataagaaaatccaagatagagaatgaaaggaagattgtacaacatattaggataaatgagaagttatttgtcaaatactcaaaggacaagataatagtgaataagaagaaggatgactaagagatggagatggtaatttaataaaacacagaaagagccaaactgaatcagacagatagttcctatcatgtagtatttagcattcattcataacattatcaatagcctgtcctgggtgagattgatttttgtgaattttgctttggcagtgataccactatctatcaccactacccataggtgatagtgcatttgtcataggcttctttatgaagtctctcgtgggtatttttgaccagggtgaatcttcaacttaattactgtgtaatgagacatgatttttaaaaatatatctagatgatgttctgatatgattttgaaatgtgttaattgactgaaagtcaaaacttatatacttaaagtatacattaactggagcagtgtcctccactcacctagaatactccagtttttcatgtattttactactctttctggatgttagccaaacacaaaatagtgttgggtacaaacaaaatataagtctgtgagacaaaaaaaaagtgtatttcatctccaattccctgtacatgtaagttcagataagttacttaacctcctcataccttccttttcacctgtgtaaaaagagggatgatgccttctatatatctctaaattcaggaagagtaagtgagacacacgagagtgctgtaagcctttgcaaacatgtatataaatttggcataactattcacaatagcaaagacatggaatcaacctaagtgcccatcaataatagactggctaaagaaaatgtggtacatacacaccatggaatactatgcagccataaaaaagaatgagttcatgtcctttgcagggacatggatggagctggaggacattacccttagcaaactaacacaggaacagaaaatcaaatactgtatgtcccacttataaatgggagttaaatgatgagaacacatagacatgtagaagggaacaatgttcactggggcctaccagagggcggaggatgggaaggatgagaggatggagaggattaggaagaataacttatgggcactgggcttaatacctgggtgatgaaataatctgtgcaacaaaccccattatgcatgggttttttttttttaacctgtgtaacaaatctgcacatcctgcacatgtatccctgaacttaaaagttaaaaaaatataaaaaatacaagtaattctgaggtacagatgagcctgactgtgtaactcatcctttagcatgctaacccgcattaagttgatgcttttggtgccgggaacctcacgtctcctcctcttctggaatagcctagagaggaagctcttcttctgtgtttagagggaaggtatctccttcagtaagcactgtgctggccctgaagagtcttcctaccctcttcctgccccctactgccactcccaccccaccagcgtggaacttcgtgtgtattcaaaggtccagtttgaattactgtgaggccagtggctagaaagcagtgtagttgggactggagattcacatgcctggctcttctcccaagcttcaactgtagctcttgagcagcagcttcctctgagcttctaaaaaatgcccagaaaattgcccagccaaccacatttcctggcaagcatagcaccaggcatatggtcagtttgagtgctattagataggctttagaacttccaagggatcattggtttgattgtcattgtatccaccaatcacccaacatctatgacccacgacaatttgccagacactatgcttggcactctgaggaataaaaagagtaagacagatccctagccttttctaatctatctatctaatggagatatggcaaagcacctaacaaagtcactacccattagagttgtgaatagtggtaataataattatttttgaaaatctaagaaaagagagcatgtgctagaataggtaaggagggcttcactgagaagatggagttggaattgaatctcgaaagctggatttgttttggataagtagagaagagttaagaagcaaaagtatgaacaaaatctttttttgagaatgttccaaaaggaagtaggcaagaagaatggtaataaggttggcaagattggttaggaaaattgttttttagtcctgtatataacaactttagagaatatttactataagttaggcatcatactaggagctggatatatgataaacaaaacagaccaagttctcacccccttagagcttaccttacagttggagaggttgtcaataaataggtgagccaattactaagtaattctcaaatccatggtgctatgaaggaaacgtcctgctgcaggaagtgtggaaacctaggtagcaccctgggaatggccacgctaaggagaagcacttaaactgaaagctgatgggtaacaaggacccagtctttacaggtgttgaggagaagctcattctaggtaaagacaatgggatacaagaaggtgctaagaagggatgagttttgcatatttaatatactaaaactatgccagggaggttgattgcatagggtcttagtgctaattgttttaacttctttcttatcatggagtttgtaggattcttgacaatttagtattgaagtaatcatataatcaatactaagaataaaatgcatgtgaatgatgactcttacacattactacgtaaatgaaataacctgtacaacagatcataagccagaggaagttaagacaatgaatatgatcttgatcatccagaatttaaaagagacagtgtatgatatacatttactttttaaaatttagacactttgagttataaataagaattggtccacttggtgtgaaattatgatcttttggtaatacagaaaatatattgatgaagaaaaagaatatattttaagtttaaattataatgtacattttctgtaccataagagacactagtggtattgatacattaatccgtaaggtaagatattggaagatgaccaaaatatagatcaagttccttattatggtgttcagtaatatgtgaaagtaagagtggtaccataaagttcagtcaagtctagactagaaaaatatccaaagcagtttagactacgaacatctttttttttcttttcttttctttttttttgagacagaggctcgctctgtcgccaggctggagtgcagtggcgtgatctcggctcactgccaagctgttgaccttagttagtgattcagaagtaacatttaaataattgggtatgagtatgtgtgtgtgtatgtgaatgtgtttatgtatatgtgtctgtgtgtaaaaagttatttgacccatcagacctttgagtgcaaacacgtgcaggaagccaagtttaaggaaattaatggaacataattacaacactcaccagaaaagcaaggatttgagtaacctagggactggatgcacagtttatcccaaaaaaatttttaaatccaaaagtgaaaataattccattattaatgttttagaagaataaatccagagcattataatactttggttaatactctccaaattattgtgtatatgtactgcaaattatacagaaaaaaattttaattttccaatggattcttatcctttcatcctttcatttgtgatgttaacacttgcaggatgagaagttagatgataatagttggactttatattccttcatttgtgcaaaaccttgaaaactttcataaattaaacctcttgctgcccttggaaaatcacaaaatgcagtacaattcctctagcgtcttttaccatgttctgtgctggccagacatttagttctatttaaaatccacttacgtatattttaaatattaattctctggccatgcctagtatgcaagcactctggtacaagattctagagtgttaatatgctgccaacttggaccttattcaaaactatattgagacagtttgtgattctctaattcattatctgtagttagactatccatatctttttagtaaaagagaagaaggcttatatattagcatatgcaacacatagaaaaatgaagtataaacctttcagggtactctaaaccttgtaatttttaaagaaacaatgttatacacacaccatttttgtttgactaaatatggtatattttaaccgtgaacacgttgaatgcattccagtgtgtcaaatgatattttaaatgtaaatagaggtgaatgtgcctgagaatactctttgggaggtggggctgttttggggttctgttttactttgctgacactgctgcatgattctgtgattaacaagcatatttctggtgctatcatatggaaaagttagcatttattctcccttaacattttattggcatctttgatgtgttataaaacaggcatttactactgagtagctaagcatttctccctctttgtttctttaattaacgtattgatctaaaacaaatctataggatcaagcttattgaggcagacagcctgtttgtctctcaagagatcattgctgcactccacacactttttcagtaaataaaatatggacaaaactgcaacatgtggaggctgaagattccattaaggacttttggcatctgtaccttaaagatatttcaaaaataattgtgctttattgcttcttctctgccatagcatataacaagcgttttttaaaagaccaaatacagctctctgatttccatttaatggaagaagtaataaagtttaattgtatacgtgagcatggggcatcatttgcaatacatctgatcaataattcatcgattgccgttggctcaaagtaatatttgaaagaaaatgcagccagtgggagcttatctagctgtagcttcatcatctctattaattatgtgtttcccgaatttggatcattaggctaccaaagtgacagcagatggcgagcagaccggacaggatgctgagaggaccaacacaagagcaaagtccctgggagaattcattaaggagcttgcccgggatgcagaaggtattagaaagaatcacattttaatcatcatttctcccaacagaaaaacacagaaagggatgacacaggactggaatttctcttgttataagtgacatctgtaaaatcaaaggtagagtttcaaaaagtagtgtggttaagatattcaagggtattatctgctgagaacctgtgacctgcagtgttaaattagcgacaatagtgaattagcgacaatgagggcagaatagcagtaaattcttgtaacatggctattataattacataagaataggcaacttttgttttgttattgtttttatttgaaagtatttaaagtatttttcattttcaagcaagctaatgtcatcattccacttgatacattaaagcagcactttagtttctccaaatggcttttcaaatactggggactggtttttaatgaacatctgttgcttgggatttggatgtgctactttatgagaagctctggtgcatttagctcacaattctctaggagttagttcttgccatctactaacatgaatgagaaagtggaagccattttttggcaaaagcccaaattaagaaacttaaagaatacagataatgccccatccgcactcgccccccaaaaaaacctagtccttaaatatctgttaaaatataataaacgtgcatgcatgtttagaaattgggaaaaatgctttttgttgttttttgcttgaagcagtaaaacatttttcttgctctgcaatattatgcattttagatactttgcttcataatgtagccaaataaataaggatgtgagatcaacttcaaggcagattctgactgataattcttaggcatcactggccaagaagagacaaactcccaaatgttcaccactgcaagaagcaacagggttttaatttgagagctaatttgaggcaaaggtgtgaggttctgaaacagaaattatttctgccagaaaaatctcagttaattcattgtggtttatcctctgctagatgaagctgttgtactttccctagtattattttccattaatgctacttgaagtgtccccctccaacccaaaacaacaacaacaacaaatcccactgcaggtagagcaccttcactctgagcggatccccaaaggccctagtcaatgctccaggaactttccttttctttccattgacatttcaaacacccaacacctagcagcccatcctggggactcattttcaatttgtttcaatcaaacactggtatgagaataaatgctagcatatgttttagtagatcctattatcaacactgcttactttgttctctgcaatgaaccttccatctcccaccaaagagagatgcatattcatggttacctctttggtcaatatgaatatttgcttcttctgggtgcctagggcctctaggtactatttgtacaatttgtggaccaacaggggtagactggagatggagatttatcccaggcttgctcaccaccccaaatcccacgtctatacaccagagaaaggattacccatcaccaaaggtgtctctcgttccctaaattatgcatagatcaggtggtctgattgtgtctgtccagatagggcacccttttctaatttatgtgaagtgccatgtgggatagctatactttagggaaataagaacaccactcacttttgcctgcaggcactatttggtagaattaatccaactgttaaaattgaatgaaaggtcaaatttaaattgtaccagagcaacactaaatgttcattgagatgtaatacaaagcttggcagtttaatggagaaaaaaagagaaagtgggggaaggaagggaggggagggaaggaagagaggggagggaggaaaaaggaaggaagggagggagggaggagagggaaggaagggaggggagggaggggagggagggaggaaggaacagagggaggaaaggggaagggagagaggaaagaaggaagggaaaggagggaggaaggaagaaaggaaatggaaagaaggaaggaaagaggaagggggggaaagaaggaagggaaaggagggagggaggaagaaaagaagaaaagggaaggaaggaaggaaggaaggaaggggaaataagaaagggagggacggaaggaaggactcaccaaaggctttaaagtaggttatactgtatatccacacctctttttctctctctctaaactataataatgagggataaccatcagtacttttacatttttgtttgtcagttgtaataaattgctgtgggaaaagtaaatgcttcagactgacatttatctatttcagctttatgtttggatagatgtactattcatcctatctttcattatgagtcatgacctcgttatagataatcaccttctattcatctaaggcattcttatctcactataattttataatatctaccgtgctatgactcctgattagttcataaataaactgttttattccacgcattattagaattaatgagtggacataggtaaacccattagtgtttatttcctgacatacaataggacttaatcaatgatagacacctttccttcctgtttctcagatcagagtattactttctattcttaataaatttacccatcagaggattttgttttcagtcttagtatgaaaacagttttgcttctcctgaggaatttttacttacctttatagatactgtatgcctcttaagaatcctatttgtattccctgctacgcgtagtctactaagatgcttagtagtggacttaggatgcactgcattgaacgttatggcatggttttctgtctactaattctttccctaatttatacaacttttttttttacctgtagtgctatttccttttattttaattttatctgatattaggatttttaaaaaattacctaaatcctcctttgaattaagttggaaataaataagtaaattccaaagatacatcttttacaatcattttcaatactgtgggaaagaaaatatattgaagtgatagtgcatacttttgaataagagatgaaaaacacattcatctttaagaatgctcagagaagttccagatcctatttatacataggatctggaactatatatatgtatataaacataaaactgtatgtttatatatgtctataaagagtgaaacagacttctattaaaatgatgcttcctttccttttttggtgggggagatttctaagaaaatcatattgcctagcaagtgatagatgcctatgagagaaatggaaaatgacagcattttaaaatttaactttcagtagaaaaataatggaaataaaaattaaactagacagttcaccatacaaaaataatgttaaatgagggtaagtaaagcgcagtgaaataatctggaaaataactataaaactttaaaacactaataataaataaatgttatccaaattaaactggcaagttttaatgggccatgtgtaatttatctgtgtcccgatgaggccatatttttctccaaaacccatatctaaaatttgtttttcataatgaagataaagtagcacacataccaaaaacccatttgaaagatgctctcatttaatccaaaaagatactgaaggcccatgtccattttggggagcttgtattttttttacataacatgggttgcaacaaaaagctggccatggaatagcagtttattccataagcagccaatatatttgctaaaatgtttgttcttttggtcctaaccacattgaaatcttctgggactatttcaataacagtaattgcaacaattgataatatccaactggaaaaaaaaaaacaacctcatgactgagctgcacagtgatgtcctatagaaactttatggggtatgtgttatatgttttgatgtttttcttttttttattctcatgtttttattttcctttttactttaagttctgggatgcatgcacagaatgttcaggtttgttgcataggtatacctgtgccatggtggtttgctgcacctatcaacccatcaaaagaagacatttatgcagccaacaaacatatgaaaaaagctcatcaccactgatcattagagaaatgcaagtcaaaaccacaatgagataacatatgacaccagtcagattggtaattattaaaaagtcaggaaacaatagatgctggcaaggctgtggagaagtagaaacacttttacactgttggtgggaatgtaaattagtttaaccattgtggaagacagtgtggcgattcctcaaggatccagaaccagaaataccatttgacccagcaaccccataactgggtatatacccaaaggaatataaatcattctactctaaagacacatatacagtatgtttattgcaacactatttatgcaaagagatggaaccaacccaaatgcccatcaatgatagattaggtaaagaaaatgtggtacatatacaccatggaatactatgcagccataaaaaagaatgatatcatgtcctttgcagggatatggatgaagctgaaagcttcagcatcctcagcaaactaatccaggaatggaaaaccaaacaccacatgttctcgctcataagtgggagttgaacagtgagaacacatggacaaggaggggaacaacacacactggagtctattgggggttgtggggagaggaaaaggaaagcattaggacaaatagttaatgcatgaggggctttaaaacctagatgatgggctgggcgtggtggctcactcctgtaatcccagtactttgagaggccaaggcaggcagatcacctgaggtcaggcgttcaagaccagcctggccaacatggcaaaaccccatctctactaaaaatacaaaaatcagctgggcacggtggcatgcgctataattccagctactcgggaggctgagacagtagaatcgcttgaacccaggaggtgcggtcgcagtgagcagaaattgtgccactgcactccagcctgggcaacagagcaagactccatctcaaaaaaaaaaaaacaaaaacaaacaaacaaaaaactggttgacgggttgataggtgcagcaaaccaccatggcatatgtattcctatgtaacaaagcttgctttcttaatacatgatcattttgctaaagtcatttttgtgcaccttaatgattgcttcttgtttacaaatggttttaatttaaagaaattatgtatgccatccaaaagatacagccatatttgccttttccctttctctatctgttgtcattctttttccaccagattcttctctgcagaagtttagctttgagaccagagcacaagagaaatagtgagactctgtctctcatttttcccttcctctatactgcctaggcccagaatctaaattagatcaaatttcaaaagatatttcttatgaaagctgatttatacacgcacacacacacacgcgcgcacacacacatattcatttaacaaagaaaaaacatacagctttagcaggttgggaagtggcatttattaatatcatcttcattttaaaaagtgagtacaaattatatcagtagttacttacatgctacaattggttaaagtcagctatacagatagcatgcactcagactaaaggatgagatagtaccataggtagagccaaatctgctactgctttcttgaaatctaagaagcagaaagcttcttacatttaatcattggtactctggaaggcttcccacctagtttgctggaccagggagctttcaaactaatcagcctatggttactgtgattctgtaacaaaattgagacacagcctaggtgatgtatcttactgacaatagtggtgaaatattgggaggattctttggcatatgtcaaggtataactgttaggcagtgggtcaagaaagagccaccctcactaacttctaggaatacagcacctgacaataacttctaccacagggctaggaatggccatatttgttctttaagacatgtgattcaaatatttctgctaattaaaccatggctgtcttagcccatttgggctgctataatgaaaatatcatagattttgtgccttataactgaaatgcatttctcatttgtgaaggctgagaggtccaagatcaaggtgctggctggtttggtgcctggtaaggagctgcttcctggttcagagatggctgtctccttgttatagtttcatgtggtagaaagggcaagggggttatctggcatcccttttataagagcactaatttcattcttgcccttatgacctaatctcctctcaaaggctctgtattaatctcttctcacgctgctataaagaactacctgagactgggtaacttatgaagaaaagacgtataaattgaccacagttctgcaggcttaacaagaagcatgactaggaggcctcaggaaatttacgatcatggcagaaggcaaagggaaagcaaggaccttcttcacatagtggcaggaaagagagagaatgaaaggggaagtgccacataccttcgaacaacctgatcttgtgagaatttattcactatcacaagaacagcaaggggggaggtttgctcccatgattcagtcaccacccaccaggcccctccctcaacatgtgggtattacaacttgagatgagatttgaggtggtcggtggggggacacagagaaaaaccatatcaggctctgcctccaaataccatcacattgggaattaggtttcaacatatgaatttgaggagaacataaacattcaatctacagcattggctatcagggttaaagtactgactacaggaacttttaaaccaaagacatatataacgaaaaaagaattataaagatgcattgtggaaagggtatattagacattgaaactcaattctttctactatcccagtgtttctcaagctctagggtacatcagaagctctgagaaggcttgttaaagcccagattgctggtcctcacccccagaatttctgagtctgtaggtttgtggcagggcctgagaatctgcatttctaatgggctccaaggtggtgatgctgctgctgcttataggggaccacattttagaaccactgtactgacccaccttctcacatacccctctgcctgctctgcttgtcctgactatgtacacctgtttcaggagctctgcccagtgcaaaactctctccaagaatagaaattaattttcaggaatctctatgtcataaggagatcttcggatacacccttgaatggtagaaaatgcctcttggccaaccgagacccctcattctaggagttttcaaaggtaatattatagaaataagtattcagctgacaaaagagtttgagaaaacatctctcttaaattcaccaaaaaaatgtcctatagaacacactccaggaaactttagtctaaaactaataatataactgtgtaaatgtttcaattcaccattttaaacttttatttgacgtagaattcttttctcaaatgaaatcctgcccagaacatcagcctataaagcagactcttggcagaatagacatcatttgtagaaaacctgaagcacctggagaatcctacgattccaaggagtacagtttgaaaccccatttaatgcataataaacacagacccttgtgaaggatgctattgctggaaagtgtccttgaagcctaatttataacccttctcctagaagggttataagtctagaccagtgcttctttcttcactcctttaaaaaatgaacacaggagaactatgtggaaatacaagggcaggttcattttcagagatctcatcactgagtgtatttccacactcagtatttttaaactgactgatagccactgctatgactatcttatcagcaatgcagagcttgcgtttccagcctccaagtgttatgctacaggtcactgttttttttaaactcttacctgagtatgcttcgacctacttctttattttaattctttctttcttttgaggttagaaacaccatgctttaattgctgtaacccccaaaagaaatataatattgagaaacatattacatttccctgtttgttactgattgttgtcttaactgcctctgtggttcccagcaggaacactcacggcaaaatactcttcatttggagatggtggtgcccagcagatgctgaataccatgttttcatgtggcatgtttgtttactaatttacaaaatttgttttaccccctgcagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtgtgagtagatgagttattattttttcttttgacaaactgagatttccagataatttacagttttctaaatttttatcacacgtataagtaaaagatgctttgtttttccaacctggagatatttgctatgttatctatcatctatctatctatctatctatctatttatctatctaccatctattatttattcatttacttatttaattgtactttaccattgttccaaaatgaatcaaaagcatgttcttgcctacatataatcaagtaaatgatcttttctggtgctgctccttctgtaattaggctaatgagtttgttttgttaatcatctgcattagggacttttggactatcagttgatttttgttttaataaaaatacctttggataaacaaagttatgactttaccattcatatattggccaacctatacattttatcatcttaagaaatgctgaaaagaaaagtcatcaaataataaacacctaatactttcaaataagagttgcgaatatgagggttgggaaaagtgatagtgattttacccatgctaaagaacttttatgataacgcactcaataaaatagatacatctctacattcatagtcagctaacttcaaagtggtagtattactaatacttaaataatttatactaaaccagcaatatcagcacaccagagaacttgttaaaaatacagattgtcagaccccctcccagacctcctgaatcagaaactttggggatgggacccagcaaaccatgtattaacaagcccttcaggggattatgaggcatgttagtttgagaattactgtctttcaagtatttagagtttcttaatgactcgaaaattatcactttagaaaaactaggtaagttaaatccaaaaacttccagatcaatcagttggaagaaaaagaaacatagattaaaattatgctagtctactagcatgacaatgacctagaattctgttcacagtttctgagcaaacataacaatattcatcattacattcaaagtaatagagaaaaggtctcagtacaatgaaacaagtggattgtttgattttggtatgtgaagtgaatcttaaaactcatttcatcaatcagattcctagaatgacatgattcaaaatgttattttacttacaaatttaaaaggtttcttaaaaatctgtttcgcttttattttaattaattataaatggtctcaggtaccagttttcaacttgatttagcacacagtgaatctattttacatgttttcttattttctcattcttttcatgttagcatctctttgtaacatggtttaataccaataaaccctaaggcagtgacatgagctcattgtctattattgggctgggggtggttacagagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggaggtgagtcttaggggcacttttatcttaatctcagaaggttggggactgcgggggcagtgttgaacatggctggactattcaagttgatgcacatttacaaaagtcaagagtgacaactctgaaagggggcttctaagaaacagaacaagaaatgacttttttttgtttttgttttgtttttaatgaccagttaccatcgcccaaagaatcaaataaaattttgataaattaaactgttgaagatatttaagaacactgtgatacagtggaagaagttctttacagggagtcaggcgaccttggtctcaatgacaactgtgccactatctagacatacaaattgggcaagtcaattaatctgtaagcatcagttccccaaatctacaataagtgcattatactatagcatacatatagggtatcttcaaatattcatatcatattattttgcagctttcccaaactaattcacaaatcttgttcagagatcttgctgccaaaaatcatagaagttccctacactttcaaattcaatctgagcacatgacaaatagctcaatgaattgagaccagagcttggaaaaattttggttcctctttttctatgcgctgtgttctatgcaaatgatcttttagaaggaactaacatgaatagatcaggtctgcgttattttctcctccttttccacacagataacagttacttctcaactcaagaaattatgggcagcctctatctttttaagagttctgatggaactagaactaaaacagattcctccattattttttcttcttttttttccaatttctttcttaatcttaacatagtaaattatcacttttcctaagagtaaactcagcacatataacagcagcaccctgtatgtgatattaatatttaaacaacaacaactttctccccagagacaaatttacctttgctgttttcaaagtatctgactccaacaggtcagaaaacagcagcagacctatacatcttctaacacataatttcaccgtcaacagtaactcagcaccctctggcatatagtatgtatgtagaaatgtttgttgaatgacagtaacaattgaatacaatcaaccaggattttttaaatctattcatttctattttcctttagattaagtagtaagaggaagaattacatttttttaatatattttatttccgtgtccctcttctgggacttagccttgtcattctggtagaatattgaagaggcttactttttttcttcactgatgcacctaaccaatttggagtctactgacatgctagcagtattccagaaatactgctgtgaggcaggatgctgggccactgtcctgtcacaggctccagcatgattcaccctgctcggtgacacaccagccgtgtgacttacccgaaggtgcacctgtctattttatggcaaccgtttgataaatgaaaattacctgtgtggaaagcatagtaagtatttgagaaatatttcaagaagagttatatggcacagtcaatagtacctttagctattcgtttcttttagtgatgtttaaaaccagaagtcatcattcttgggcacccctacaaatacctggagcttatgtatagtcggtattgaaattctgagtggtcctgtttggattttccttgtatgtgccacgtttaactaaagacttgtttaaaagttactggataaaatagataaactaactgaatcaatatgaataaggcatagattatttatggttgcttaaaccaaataaataatttggttgctgccaaaatggctgaaaatcacatggggtgtttgttaagccaacaggtttcatgggctcccacctagagagtctgtgtaggctgctctggggtttggccccatgtgtacattctaacactctccctgggctaatctgatgcctatacaggttcgaggaaaactgacacattgcatctatttgattgaataataagctgcattttaaataaataactcccttataactgtgtccacaatgaaggtaacacaattaatacccaactcaaaaactttttatttattttaaggtggcatgtaattttctttttaaaaattttatcaagcctctaattcattcaggaaacgtgctagacaccaaaattgattgtgtcagtgatgagcccccttagagcagcagcctcagcgtaacctagcaacttgtcaaaaagacaaattcttggaccccatccctaaatgaccaactcagaaactctgagaatggggcccagaaatccgtgttttaaaaattcctccagtgattaagatgcagcttcaaggttgagaaccacgggtataaacactaaaacaccatctctgattacttcaagtaacttgtatttagtgggaggtacacataagcaaaccactccatacgctaccataattatcacaggcgtaagcaaaggagggagtctaagtcacccctgagtttaggaagagctttgtagaggccctgacacttgtgctagatcctaaaggataagcactgggtcacagaagaataaagagaagaacatttcagaaactgggaaaaacatatacaaaggcatggaggaaagaaaatgacattttgggggaaagttcagtggtttgataggcttggaaagaagactgcatgtgaacgactgaagggatagaaagaaagagaagataggcagagtgcagaccttcagttataagagaatcgcattgtgagactaagctaaggaattggtttttatcctgagagccataggaagcaattgaaatattgcagtcatgggttaaaataaaatgttgcagaatttgagtggctcacttaaactgaataaatggttttttatcggaaaatagtgtgatattaggctagaaaagtaggctgggataatatttatctacatatctgtcaggtacctaccatatcaaggtactgttggtaaccagggtatttgaggttgaatagaaatgattcctggcctcaaagaatttacaacctcctgaaaaattcagacatgtcaacctttcactctacataatactatgataatattgactgggagattcagcaaaagtttcacaaaaataacagcatcatagcagaagtggagaggaattggaagaaagacagagcaacaggaaccccagccagagctttggaagtgtaaggtgatcttaggaagtgtccagtacagcagaaaaactttcaaaagctacgtaaaaatctgtagcagagaaggctctggaatttggagccagatcatagaaggctttggatgcagccaactagatggtgatggagttggaaaggcatttccagcagtggagagagggctaagggaactggggacgtcatgggaagaaaagagaagacaaatatttcagtgaagcaaaataatatgtattgagcagtctatccccaaatctaccattatatccttgccaaagaaggcagtgcggatcaagtaaagagtaagttgctacataaagaatacacaggccagcctgagcaacatggtgacaccctatctctatagaaaaatacaaaaattagtcgggcatggtggtgcatgcctgtggtcccagctacttggaggctgaggtgggaggattgcttgagcccagaagtttgagcctgcagtgagctgtgatcatgccacagcactccagcctggatgacagtgagacaatgagacagtgagacagtgtctcaaaaaaaaaaaaaaagaaaaagaaaataaaagaaaacaataatagacaggaagatagcttttgcaggttcctgaagaatctaccacaccaacacaccaaaaaaaaagaaagaaagaaaaagaaagtgtccaatttgcaaagctctggaataaataaagatctaattaattacaagttaaaagtagaaatataatcaaccttcatatccaaacaataattgagcaattatacttatgccatactttttgtagaataattctccctatacataggccttctttctgtttcttaaatactctaagtttcctatcttaggtattttatatgctacatcattttctatctgtgcctctctttgtttttattgtactcatctaatctttctttaagaatatattatacattaatttactcattcattttatctctcctccacacaagccatgaggaacatgtgttcttcctcacatcccccaatcctagaacagtatctagcaaaggcaaaacagattgttttccgtgaataaataaagtgccatagaacaaacccagatactctatacttttgtcaatatttgtgagctccaaatttccatcttttctcggttcaaagctagaacccatcagtatctaatctgaaaacaagacacctctaaaatttatttaacctcatcccagcactctgggaggctgaggcaggaggatcatgaggtcaggagatcgagaccatcctggctaacatggtgaaaccccatctctactgaaaatgaaaattaaaaaaaaatacaaaaataaaaaaaattagccaggcgtggtggcaggcacctgcagtccctactcgggaggctgaggcaggagaatggtgtgaacctgggaggcagagcttgcagtgagccaagattgctccactgcactccagcctgggcgacagagtgagactccgtctcagaaaaaaaaaaaaaaaaaaaaaaaaattatttaacctcttgatcatcatttctgattgagtatgctaagaagcacattttgatctttgcttttacaaaagattctaactcactactttattgaaatcaaaatatatatagctcttcaattaacacacgtgtggaaatatcttccctgtttccagtggcacagcattttaaattaccttgatccattaattcaaacaagccatgttgtaaaagattcttgtgtttctgtacatgctatactttaagtcagctcatacaaaagctaagggctaaaattggcagttgtgtaaaagaatgttagacccttggaagataagatatgacttgtaatcagggagattgtaatcagggacattgggactcttcccacatttgttgtctgtgaagagtgaatgacatatcaaaacttcccctgaattagtgatgggagtagctgaatgagccaagtgtcagcagcacaagtcccaggaatggacttcattttcttttttctttcttttcttttcttttttttttttttttttttgagacagagtttcgctcttgtcacccaggctggattgcaatggtgcaatcttggctcactttaacctccacctctcaggtcaagtgattctcctgcctcagcctcccaagtagctgagattacaggcatgcaccaccacacccagctaattttgtatttttagtagagacgaggtttcaccatgttggccaggctggtctcggactcctgacctcaggtgatccacctgccttggcctcccaaagtgctgggataacaggcatgagccaccgtgcctgacccatttttatttatttattaaaaaatatttattgaggaaactcatctacatactagagatagtgatatataaaactgtctttatggaatttgtgttacagtgcaggagacagtcactaagtcaataaataagcataagctacgaccataaagtctggatgcacgggctgataaacataagttgtttactgatatgtaataaatggtatgttgcatgatattgcataatagattcaatgtgttgtccttcattaacaatgtgtagttcaacaggctgtgcctttctgctagtccctgtacatgtatctgtgatgcattggtatttctgatttttattacctaatctttgtttttagcaactcccggcaaaagtaatcaagacgaatcaatctatataaaaaagaaaataatattgtctatgtttctaccactctgtagaatataattcagataaatgggttctaagaagaacaaaataaggtaattataatagttaaaattacagtgttactgggtgccaggcagtgttctaagctaattcttctccaattttacaatgtctatcaatcatgtggggttcttgttaaagtgcagattctgagtcagtagttcccaggaatggattgagattatgcatttctaatgagcttccaggtgacgctgatgctgctggtgaatgggctgcacattgagtagggagggactaaacattttgtatgaaggtaaattacttccttaaggtttcatagcttgggagtgagcagagctgtgatcccaaaccagaagggctgtcacttggatgtagcttttaatcactgtgccctagtacatagagaatgattgagacaaggataggtgctattttagataggtaatcagaggagtggctattaccagaatggagggaggacacaagccaaagagtaggaagagcacatagtgggaatatctgcaagtgcaaaggcttagaggcaggaactagttgtatgtacctggcaacatactgaattggtcggtgaagggaaggaaagaagggtatgaaattagcactagctcagtgcaaattttaaaactgtgatttctataatagaagagatagtattttcgtagtcaaggacccaggatctatcattaagtagacaggggtttaaatcttaatcacactgtactatgtgaccttaaaggaatcatttaatatcttagttcatctgagctgctatagcaagagaccaaaaactgagtggcttatatgcaatcaaaacttatttcttatggttctggaggctgggaaatccatgatcaaagtattggcagatttggtgtctgatgagggaccactttctggttcatagacaccgttttcactgtgtcctcacatggtaaaaggatgaacaagctccttcaggtcttttttataagggcagtaatcccgtttatgaagtctctgcttcatgacctggtcacctccaaaggccccacttcctaatcctatcaccttgaggattaggatttcaacatatgaattttcaggggacacagacattcaggccactgccctttacttattcaatttcccacttatgtaaaaagtgatcaacatgggatccaaagattggaataacaaaatgcttacaaactgtctggcacatattgagatctaaatgaattagcattattgtctatagaaaaaaactataagtggtcaaagcttaaaattataattgatgcagttaaatctgtaggtagaatggtgatttcaggaataggaatgaatcagaagtataaagaataaaataagtaaaaaatagaccccaaatggagaaatagcaatatttgtctctcactgattttactcttctaggccaggattgagtttcatgtacttttgagacaagctatatgttccaaagaaaaattataatctattctctcatgaaacagtccattaggttgattcttccatgtgatggtttctctatttcttaaaaagtattttccctaagtttccttaaaaatctcacttcaaatttcacagaactcccattgaatacatctgcttatgtttatgctcacaaagtactcatttgtatatagattctagaattcaatatgtagtaccaatataactattcagcacttatattttagttagaaatggatgctccatctttctttaaaagtagttttaattccttaactagtatcgcataacttttcttcgcttggatgactttctcacaatgagaagaagaaataacctgtacaagcctctacatagaagaactcttcaaggactggctaagtagtttatatttttctcatctagccacatttcaacatgatgtaccttttttgctaagcttttattcaaacagctcaggaaagtcaggaatacaaggggtaggattttatgaaaatgcaattttgatgtcttgttcataatggtctacagaaaaagaaggaggctgttgaaagcggcaaacgacaaattgagaacactttaaaagagggcaatgacatactcgatgaagccaaccgtcttgcagatgaaatcaactccatcatagacgtgagtattgggtaaaactcaaaagagagatgataatgaataaatgggagccgatgagaaagctcagtaatagaagcaaatactagtacttgttttcttgtggagataaaattatttttgcattattctactgtgaccatgcctatctattggtgacaactggaatatcactttgttctcccaatggacatgagtgtttgtgtaagtgtactcacacattcacacatatctgtttttgtccacagcgatgaaggacatttcttgttcctagagcagcacttacaatctgcttcaatatttatataacattagttaaaagacaaatgtaaatttacaaacaggcttttaacatgtaatgtctaatgcattacatagagtgatatgtggtcatagaaatgcaaatggcctaagagatcctaatgacatgtatacctatgaagtggcattgtttaaatagataggcttttcttggtctaagttggtttcttaaatttcctagtctattccattaaataatgactttaattctctattctttttgctatgttagtaagtttgaagtttcattttaaaactaaacatgtgggccaggcacggtggctcatgcctgtaatcccagcactttgggaggccgaggtgggcagactgcctgagctcgggagttcaaaaccagcctgggcaacatggcgaaaccccgtctctattaaatattcaaaaaattagctgggtgtggtggtgggcacctgtaatcccagctactcaggaggctgaggcaggagaattgcttgaaccagggaggcagaggttgcagtgagctgagatcgcaccactgcattccagcctgggtgacagagcaagactctgtctcaaaaaaaaaaaaaaaaaaactaaactaaacgtgtagttatgtctcatagagaaattagtaaaagagaggaggcttgaattcacttgcttaaaatgccctcttctctacatatcagtatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatgggtatgtcatttgtttttggaaatgtttgtgtattttgatgcttgtccaaaggttttgactagcataaatagtagagaatcattttcaaatcctgatttctgttaattatgaacacactagctatatggcctttctgtggataggcttaattaggagggtctgggcaaagctttgctacagcagcatcaaaagtctgatttacaagtagactcaaatatggcttagtaggaagtgaacatagccctaggctacacttagaaaaaattattttctgttctttattaaaaagcacagtggttgccttattagcattttaaataacatatatgaaaatacattctgtttcaaatttcagtttcatgtttctaatggaatcaaaacaatttattgttaaaaggatggcttttgaaaatttggccccatacgtagtctttaagtcttttttatttttcctcttttaagctccagggagacattacattttctcctgtaaaatagcagcttattctagctgggattattacaaaggtcataggagggagagtaaagagggaagtatacatttgacttacaaacagccttctgtgtataactgatatgcttttcctacaattttgggattgtcgtaatttaatagcggtgctattagccccaagaataatttgcccagataaatctacatcacatgcaaagctttgttctcatacttaatacttactgttataaagaaaaaatgctaatgtttgaagaccttggacaatatatgaactatcattttattttatgtcaaacttttgccactttataatgaagggtgggtggcagatgaaacacaaagctaggtatcatcagatccaggctctaagtccttacttggggacatattggtcatttggcctgaaacaggccatttaaccttctgaaattcacttggtctcttctgggaagtgcacctaccccagaaagattttgtgaaattaattccagtaatgtagtacaagtgctctgaatctcacagcatgcttcacaaataaggtgaagaattgtctcatatcacacacctgctagagcacctggttgcagagacttttggaggatgctatgggtatttaagatatgttggtagtatttcatagctgaattattagaaatataagtttaggttatagaaaactataggacaatataataagtagatacttcactattatttggaattgtcatagatatattggccatgatcatttggaagccagatttcatataattaggacgttcttcatttgagtaccattgagtgccctgacattccttttttgaatcatcccaccagaatccttgatgaggctaaaaacatctccttcaatgccactgcagccttcaaagcttacagcaatattaaggactatattgatgaagctgagaaagttgccaaagaagccaaagatcttgcacatgaagctacaaaactggtaagaaacaaatggcacatgtgctgggaatggaagtcaacctttttgaatttttcaaatgtaagtcagtctggaaaatcccagtaaattggtatatttgttttgggttatttttgaagacctcttttaaaatttgcctaaaataaattctcggtatgctataattatagcagaactcttttctcagtcacccactaccactgttagggtcttaaaattatctcagaaaccaagcaagtttgtgctaccaactcacaaaataaaacaggcaaagacaacactctggatagggaattttatcaccattatctcaaatggcattagtaaaaaagaaaaaaaagtaaccattgtatataatcacacacaaattggttacatatgaagtttggctataaaattcactttttaataaaaacatactggatcatatgcttctaaacaatttataccatgtttatgaattaatgaatttttatgaatttttgaattaaaaagctcttaacctttggctacaatcattgttcgtaatacatttggaacaagtattttagagtttgggcattccaagttctatcacattatttgaatgccttcaatggtgacaaatctttatgctttagatgtaaagcaacattttgtacatgagttgtgtgatagtaagttggtagtactatttcaggttaaaaaaatctcataggaatcatcctgaataaaatgttcagaaccatcatttatttattttgtttcacatagaacctaccaaacacatgagaattttttgggggagaaatctgattggacatttgactgtgagtgaaatacacataagcagtggtgttaaagaaactgatcaatattttctttgcttcagtgttgggcaaaaatactttctaggatttaggggatattagagatatcccctaaatgaaccagtcttagcaggttcattttgtgatcataatgaaacatcatattctatgagcaatttgtactgtttttggtttctcttgagtgagccctactaatgccatatgttctgttgacttcttattcaaaatagtggcatgatcattgcagaagcatttctatgttcagttatcctttcagaatgaatctacttttcaaatctaaactaaattttaatccatcttctgttagataattttctattttaaagaccctaatttcaagttcaccattttcatttcacctgttttattgtatgattattttcagcacctaaaatggtgcctggcaaatagtaggcacttataaatgaatgagtgtattttttcattataattgacaccttttatgcctgttcataatcttttataccaataaaaatttgctgtagtaattgcttcatccttataaatttcttgtaacattttatgataaggaggtgtttaattttaccctaatttaatacctttaggaaaaatcattttttgccaacatgaagtgtgcacttacttcttaccacccatgcttatacatggtaggctaaccaacctcaaacagagagtgatggtgagttgtaatgcattacaccatgtctgctgttatcattattccttctctctttccacaatcatttaaaaataattaaatgtctgaaaaattacaaaataagtgctatagagaatcagtgatttattaaatgactattggataagaaaaagaagacaatctgtcccagaaattttgttggaatgtttttcatgaacagaatgaataaaattttagtttaatagatcagtataatatagttctactttgctggaaaagaaatatatttgaaaagcattacgttgagtaattatctagataggactaacatcccataaatataagatctgatataaaagctatagctcaacagagaagaatgagattaaatgtattattaagtatagaagagttcaaagcttaacaatacagaagagtcctctactcctttgagtctagccctataaagaaggaagaatgttttcaataacttaaaaggaaaaacaaagaaacaatttatacatttgcaggagaaaaggaaaaggtcaagtagtagagcaaccaacgaccactatgaagaaagtggaggtcagacaatttgagaagaaaaaaagcattgaaaataccataagaaaagaaacaaagaaatgatagaaataacctccaagcataattaagacaatgtttaaaatcaactttgattttttaaaaatttacttgtcttcctatatataaacacacatagacaatcaagaatcacactgaaaggaaaatatgagtgagaaggaagtggatcctttataagcaggagaaagctaatacgatttgtttgtactgcagtattattttgtaaagagtaatagctacttgtcttgcataactaatttctttaaatatcagaatgaaatgttattttaagaatttagacatcatgaaataacaaatgctatttttctattggtgtcgggtgaggaaagtactataaagcatttgttttcctacatataatcaccaagaaaatatctcatttagtacttctctagagggtgcaaggaaaacagaaaggagatatgtcactcataaaatggaataaaaatggaatatggacatcagtaattttttctcatcttagttgctttgatcctataagagactctaaaataacagagaattagatgtttttaaaacatttccaggtcatagtaaactcaaagcctacattatctatcagatcagatttttaaaattgatgaatgtattaatgttctctagaaggacagaactaataggatagatgtatacaagaaggggggtttactaaggaatattgacccacgccatcacaagatgaagtcccacaataggccatctgcaagctgaggagcagggaagccagcccgagtcccaaaacctcaaaagtagggaagctgacagtgcagccttcagtctgtggttaaaggcctgacagcccctggcaaacccctggtgtaagtccaggaatccaaaagctgaagaacttggagtgtgatgttcaagggcaggaagtatccagcatgggtgaaagatgaaggctggaagagtcagaagatctactctttccactttcttctgcctgcttttattctagccacactggcagcttattagatggtgcccacccacattgagggtgggtctgcctcttccagtccagtgactcaaattttaatctcctttggcaacaccctcacagagacacccaggaacaatactttgcatcgttcaatccaatcaagctgatactcaatattagtcatcacaagtccaccccttgtcaacttgaacccatacacatctcctgaaatcatacataatctccaaataaagacaataataacatcataattatacctaacataatacagctatcccttgtacaatcagaagcacactaatccttaacctaaatgctattacataaagttaacaacacttaaatgctgatatgaagtcaataaattttatgtcacatgataaaggaaaaagaaagcaaatgaagatattttcctagtacaagtgtatacatgcacaaacatattcttaacagaataaggaggaaatatatgacaattacagtcttcatttctgcaactggccacgtggttgtagctggtattgatgactaccttcttctactaaccattatgtattccctttgccttctgcaagcacctcagcgggtcatggctttttacctggtggggtgacccaaacctttattctggaaggacctgtgccatttgtagtcctgtctggattgggttggattgggttgttgtagtttcccattgaccttaaacacagaggatggtaatattaagagatgccctatgggatctcctgtattccatgcatgctcttccttgccttcattgtggaatagtagactgatttcaccttgatattctgggtcaattacccagccaacactgaaacccccttcttagcctgttgacttggaggtaggagggccccaattggccaggtggtaatcttaacttccagtttaatggaatcattgttgtatcccttggtgacagcattcttccctctggaactaagatgtctaggccagcagaacataatgttgtgggaacaggaagcaaaattttgctagtgggtcactagtggtgatggtgagtggtgccacttccgcttccaccccttgattctgggacacgtgaacactggctatgggagaaacagtaccatattttggacactgattcaaggcatacacagccttctggagaactttgccccagtccggcaaagtattgtcacctagttggcattgtaattatgacttcaaaagggcattccacaattctatcaatccacctgcttcaggatgatgggaaacatgataagaccagtgaattccatgagcatgagcccagtgctgcacttctttagctgtaaagtgagtgccttgttcagaggcaatgctgtgtggaataccatgacagcgaataaggcattctgggagttcacggatggtactcttggcagaaacattgggcgtaggatgggcaaatccatatccagaataagtgcctattccattgaggacaaacctctgcctttgcatgatggaagaggtctgatataatcaacctgccaccaagaagctggctgatcaccctgaggaaggatgccagacggagggctcagtgttggtttctgctgctggcaaattgggcactcagcggtggctatagtcaggtcagtccatgttgctgagcctatgcataacctccattcctgccaccatggccactttgttcatgagcccattgagcgatgacagggtggctggggaaagaggctgagtggtgtacacagaatgagtcatcctatccacttgattattaaaatcctcctcagctgaggtcacccgttggtgagcactcacataggatacaaatatcttcacagtttttgaccactcagagaggtccatccacatacctcttccccagattactttgccaccaattttttaatcatgcttcttccaagtccctgaccatccagccaaaccattggctacagcacattaattagtatataattacacatctggccatttcttcttccaagcaagtgcacaaccaggtgccctgctcaaaattctgccccctgggaagacttccctttgctactgtccttcagggatgtcctagaaaggggctgtagtgctgcagctgtccacttttgggtgctacctgcatatcttgcagaatcatctgtgaaccaggccctagtcttctctgcctctgtcaactgatcatggggaactccctgtgaggccatcagtgcaggcttggggagagaaggcagggtggcaggagtggaggccatgggcgtttgagccacttcctcatgcaactgacttgtgcctttaggactggctcgagcctgatcatgtatataccacttacagttgatgatggaaggctgctgtgtatgcccaactttatggctagatgggtcagaaagcatccagttcatgaaaggcagtttaggttgcatggtgacttgatgacctacagtcaaacattcagtttctaccaaagcccagtaacaggccaagagttgtctctcaaatggagagtagtgatctgcagaagatggcagggccttgctccaaaatcctagaggcttccacctctaggagtcacctatgggagcctgccaaaggcttcaaacaggatccctgtctgccattgacacctcaaggactattggatctgctaggtcatacggcccaatcggcagagcagtttgcacagcagtctggacttgttgcagagcccacttaaaattggcagcctttcaggtcactcaataaatgggcccattttaacacacccaggaacaatgctttgcatccttcaatacaatcaagttggcactcagtattaaccatcacagtgaatgaatagattttctatgacgttgactccttggaatgaccaccagaggcaataagcacactctcagtgacacgaggatatgaggccctcctctgcccatttacactggaaatgtcttagatgtcttagtgcttttcaatcaggtatatccaaacaacaaacaaacaaataaaataagactaatgcagaatgaattccatagttcagattcttcaagataatggaaaattatcacataatctccacctgttttgaaacattatcttctttccttcctttcctccctttctccctttctctaagtcagtggaatagtctagtttaactttgatgtagaaaatttaggcagtcctcaacctctctaggtatgctgaattaaaaaaaaaaaagaatgacatttttaattcccatggcaaatggagttctcctctttcttctgttcctcttcttcaccttgcaatgactgtcattttgtaaaactttctctctgtctctgtctctcttactcacacatacactcacaatgttccttaatatcttctaatcctgaatttcctttctcaatttgtttagttagatcttcactagaaataagtattagaaattgggaaaagtttatactggttgtattagggttctccaaataaacagaactattaggagatggatagatagatagatacattgattgatagatgacagatagatgaatggatggataggtggataataggctggtagatgatagatggatgatagacagattagatagatagatagatagatagatagatagatagatagataatagattagatgatagacagaaagaataagagatttattatgaagaattggcttacgtgattatggaggctgcaaagtcccagtatctgtgagctgcagatccatgatatagttcactttgagtccaaaggccagagaatcacgggagctgatggtacaaaccacagttcaagaactagagagaaaatgagatgagatgtcccagctcaatctgtaaggcagaaaagaagggaaggaattcctcctttctttgctttttgttctattcagccctcaagagattgggtgatgcacagcaatattgaggagggcaatctcttttactgtcatccagaaacaccctcacagacacacccggaaataatgtttaatttaggtgcccatggccagtcaagttgacacatacaatttacaatgacactggccttcaactccagtgcacaatgtggtcttcctctttattctccaaattcaagttctcttacttgctacagttgtccatatttcttgggaaccatcattctaaaaaatgttgaccaggcctttcttaggcatttctaggaaaaataatataaaatacagaataaagtgaggggagttcagatataatgcatttctcatagaaaaaatgatagtgggatggttagtaaagaactgtgctgtgtaagcaagatgtaagctttaaacaaagtgaagaaaaggggagaagcctagaaaaaataacattatacagaaagagaatattcttaaatatgtcaacttctcttatagcaaatttcccagtgttcattcctaatacaaggagagtaaaaactccatagaaacctcaaaaagagctttttcttgcaatggggttaggtgtctaaggaataaacaggacttttgaaactttactcttatgtgacagatcagtgaggaggaaacacgctgataagaagcactgaactactacaaatacgcttcatttgctataaatacacttcattcactgaactataataaaattcacttcaaaaggaatgtgaacaaaatgaaagaacttggatataaaggggcaaaagtgaacaaaaagatagaaaatgtgtacaaatctaagtaagcattatggaaagcataatgataataattattaaatatgtggaattaaaaacaaagtggaactaaaacacaagagactaataaaatggaaaatggggcaggtagtcagttatttaataaaagtttttaatattcttgaattctggggaggaaagcaaaaagctaattaactttagttttcactaagaatatgtattaaacattgaaaaaaaatctggaaaaataaaattgacaatattcgagttctccagagaaacagaacaaattggaagtgtatatatacacagatatattatatattttaaagaattgactcatgagattgtggggtctggctgcagggaataggtgaatattgccgtcttgaatccaaaggcagtttggaggcagaatttcttcttcttcaggggacctcagtaattcttcttaaggcctctgactgttggatgaggttccccaacatcatggagggtgacctgctttactcaaagtctactgactgaaacgttaatcacatctaaaaaatacattcacagcaacatctagactgctgttttaccaaaaaccaagtaccatagcctagccaagtggatataaattaacgatcacaaacagctaaacattccaaacaagcagacagagagagaaaaaaataaagaaatgtgaaggggaggagaattttcaatcaattctggaaaagacaaaaaaagagaaaaagagaaacaaatcataaatataaaatataatggaattaaatccatatacaacaatcagggtaattatcaccagctgcctcaagaaataacccctgaaatctcacatgatggacataattcaagtttatgtctcacatcacaacacaatgtgagttataccaccttttgcatcttgtagtgacaccatacagtgtagcctccaaggcagggaagagaaaaaatgaagagacatgtaggcccctaccatactggctcatgaagcctggaccacgtctggtctgagtcattgaccagaagtagccgtgtgccccaagctaactgtaagggaggtctggaaaagtaggaggcacataggatatttgatgagcactaactatctctgcttcaggttgtcttcataataaatgcaaacattaaaattgacaggttactatgattttcatattggattaaaatgtctaaaacaaagggattcgtctatgtatgacttacacaaatactgcaaatcttaggggaacagaaagactgaaaatgagagataagatacactatgcaaactctaaccagaagaaagctggtatgctaccattaatagcaatcaaaaagactttaatttttttaaaagaattattaaggacaaagaaagtgatcatgatagaataaaaggaacaaggaaaactaaaaaattatgagcctgcaaggtcataataacaaagcctatggataaataaagataaatatatcagaatgagaacattttcatatatataatagggaatgattttaccatatctctcttaaaaagtgatagatcaagcaaagagacacagattttaaaagtaccttacacaagataacttaatggccttatagaactctatgtcaactagataattaattctacatgccccattcgatgaagtaactcatgaaacaaacaaaggaccacaacctagatcataaagcaagtatcagcaaatcctaatgatccaatagcatctagactacatcctcttatcataatgcaatacaattagaaattggtacaaaacaattgacaaaaagttttaaaataaaaaacatacttcaaagtaatccatggcttgagaaaaaaacacagtttaaatttacgaagtatttaataacagaatggaaataaaatttcacctcaaaatttgtgtgtgcaaataaagtggtaccaacaggaaaatgtacagtttggaatgcagatattaggcaagggtaagaactgatactaattatctaaggtttctgctcaagatgtttaaaaaagtacacagaaagaaataaaaataaaagcagaaattaatgacctaaggaaaggcattagacagggttgacaaaacagcaagttgattcttagaataaactagcaaataaacagaagacaagaacaattaagcaaagagagacaacacaaatgaataggatcaagaatgaaaaggggatcataactgtagatacattatagattgaaaaataaaaatggatatattggaggatatgcgcaattttattcaaacacatttgaatacttaggtgaagtaaacagtaagtttagagcaaaatttactcaaaaagaaatagtacacctgagaactataaccgttaaataaattgcatcagtagttaatacaacaaaataacaatatgtacaaaaatgtaaaggacccattatgcaatttgttcccaagaatggaaaaagaagaaaaatttcctcagcttattttatgaggctgatacaatcttgatggcaagccctacagaggacagtactacaaagaaaaactataggccagttatttaaatagagaagctacaaatgaaatattataaaacccagttcaaatgtacatattttaaagatctgtaaatatacagtaaaacattaacatttgccagatacagatgatgggaatagaggtgtctgtattaatttctaatcgtatctatcttatttcctacttaaatagtttaattaaaatgaacctcagaggagatagaaaatctgtcctgcaataaaatctgttctaaaataataaagaaaataggtctaaaatgggtctggaaatgaaacaacaaccctcatcctttacaccagcaagaagttctaaatttctttctttttctaaattcatgatgcatacatgttttaatttcttttaaatgatcagaggctgataattgcaagcaacaatcccctaacctaacttttctctcaactaagctcacagctccaggatcaacaattccaaatctttcaaatattcttcttttactacatctcttagtaatattattgtgccatcacgtatttcattaagtggggcattatctatttaattactgctatgatgaaggagatgtagttcacttacagaatatcacatcacattttcccacccttcagtttcccaatataggtacattactgtgcttagattcttcatttttaacctaatatactgagagcattatttcctgtataaatgatagactctgcactctttaagatgaagctatttatgtcctcattcttccctttagcttccttttttcctcgtcctctcagcttctacctctttaactttgatattgtgatggtcaataacatttacattttatctataaccataattgtgccatggcagaatacagaagtcccttctctgaagacattttattccttaaaggactccctttgattttttttcagtgggccatttgatgcttgattgccagttgctctgtgcagaagagaaggggtattttattccataaaataacttgcagtgaattattcctttttattttcacaactgactctcattctctaccttacctgttctttctgaggcctggccttctccaaattttttctatctccttgctggcatataccctatagtgcaagttgtgggtacaataactgcaaaagattgaggagcaggaactatctaaataaccatggtggctgggtgcagtgactcatgccggtaatcccagcactttgggaggctgaggtgggaagattgcttgagcccaggagtttgagaccagcctggacaacatggcgaaaccccatctctactaaaaatacaaaaattagccaggcatggtgacacatgcctgtaatccaggctactcaggaggctgaggtgggaggatcccctgagcctgggaagtcaaggctgcagtgagccaagatcatgccactgcactccagcctgcgtgacagagcaagaccttatctcacaaaaaagaaaataaaaggcccatggtggtgtggctaggaaagagtgccaaccctgtccaaagggaagctttctttgctgaaattatacactttctttctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcccaaagtgctgggattacaggcgtgagccaccgcgcccggccgaaattatacactttctttgatcaacttctttttactccgtcatagttttattccccaccaatctcccccggacagtcactccattttacttagtctcttggtactattctcagaattcaaattttaaattaattaatctgtatttctgaagagctgtttgttttcttactgtatattttgctttctccatgggaaagatatgcttgggagcctcatgcagtcttggtgggagttatgtaaccactgggccagatatgtcagggcacacagcatggtgagccattccctggccagttccatcgcccagagccagaccctttgggccctacacagactgcacagccccagcatgtgggggcttgtataagggaagttctgatgtcacaggatccttggggtgtttcttcaccagctggaaacctctgtggccagtggcacctttgcctgagttttgctgaggtccactgggcacattccgcccactcagcctggcaggctacacttggctcacactaccactactgggctggatcccacacctgccaagggtgattcagggcagagtggcgaggggtgtgtgagtgagcgtgggctccagccactgtgcacagctaagcgtgccagctgcagtgggctgggcagctccaggtcctggctctatgtgaggctgtggctgaaccagacatactacaattggcttccaccactggtaccagggaatgcggtggcacccaggagcttggagatgccaggaaccacagagtctgaaagagggtctcacagccctggctcagggagtccataggtctcagctccccaaaaggccacagcccttctctcctgctcattgctgtcaacatggtgagctggggaagggggtgtgtttcaaccctgtttgtgttgtagctctctcatttccaccatttgcgggggggtcccaagttcttgtcccacatcctggaagaatgaggtttgcagacaactggagggttagcaaggtgaagaggtgctttattgagtgacagtgcaactctcaggaggcctgaaatgggtagctccgttccacaggcaggtaattccagcatctgtgcagcaccctcaacagaggtgagacacacagtgggtagctcctatccacaggtagatcatcctgttgtctgcccacgtctggctgagtccggggttttttatgggcctcagaggggaggaagtgtatgctgattggtccatgggtggccatgagctggcccaaaaaaagcaccataagttctcactccagtttgtggaaccgacagtccagcccccttccttcaggcagtccctggcttgaaggtggagcttcactgagggcccacccctttccacccaggaacctgtatgcctcctgccaccaccaacctgccatccacggcgcccactggcacccaggctgttcatgcctagggtcaccttcaggcccatgcagagccaccctcaactcccccttggcctccctaatgtgctccttggcacccaaaatccagaaggggccaagatagtagggggctagagtgtcagtgctgccccgagcatatgcacacctggctgggttgcaacagcctcagctttgctctgaaatcagcctgggtgccgggaacagtgagagaccaggaagaaggagcgggcacttctgagcctgtaggggaagagaggtggctgagggcacagggatgcctgggtccacagctggctgggtggctgcagctgcacccagtagggcagggttcccccaccttcaactcggaaggggacatggctcccacttgttcctggctcccaccagctctgtggagcacaaagccagacaggctgacactgccattactgagaccctcttgctctcagaagagttttcatcgcctgctccctctgttttcactgcttggtgactgtggtgttttgttttgttcctatttccttttctcagaaaagaaagtctttagaattaaaatttaagctgacaatagatcccctctccccagggagcagaaatatggatatccctaaaggtcttgagtgtttcggtctttcactattttatactcaatattccatgatttttatctagatatgcctggtggacaacaggtgatcgccaaatataggttgtccctcccatctccaaattctgatgctagaaatcaggaatggctatgatagtccagattttcagaattgataagatatttatattaccctaagagatacggaagttgaacagaataaaaaaattcaaaataaaagtaaataaaattactttctttccctgtttagtttgagatcatgtgtaaatatcagtgaacgtgatgtcatataggatttttttttattgatcagaattaggttcaagttgtgttctggaaacttctaattaaattgagggaagatgctagcaggccagaatttgggaattagatgatctggctccaaattcaatacatattgtctatgtaattagctgtgtcacctaatgtaccaataatgccttttcaagaaacactgtgcagtctgttctgattcctccattggcttaattcctataataaatatagtttccaaagtttataacttaattttcagaatttatttattttaattgacagataaaagtggtatatatttatcatgtacaacatgatgctttgaaataagtatacattgtggaatggctaaatcgaggtatttaaaaatatgcactacctcacatactggtcatttttctgtgttgagaacacttaaaatctactctcttagcaaagccatgctggctttagtgatttttttttttgtacatgatactctcatttgggtcaataatttttttaaaagtctattggaagcagagaaataaattttttgacccagccttagatgtatttaaaagttcagggcataaaatgatagatgtctcagggtttgtgtcatcagtcggaaacacagaactcttttgaacaatgccacaatgcaatctaagtttgatctaattttcttcaagacaataatgctcttggtgccatcctacctgctctttatgatttctacccgtaggtagaataatcaagaggtgagattgatgttgtttttgattctggacattaactagagggaaaattcgaagccctctaagaatggtatctaacttaatagacacctctccattacctttactcaaaactaagactctttgtggtatgggcccaccccacctctagtagccagctgctagtccagtgtctgtctcactgaagcagtctagtggtacacataggtactgagcaattatgtctgtcatgctgtaattgaggaaaaccatccttacttcattttatatttttgaatgctcccttgattgtccttcttggtgttcccataaagctaaaaattcacactcacgaattttaaattatcatgagcaatttgggggatttcctattttatcactgagtctcctttgagtgctcagctgctttcaatcttgacagatactcatctgacccatctaccacccttagggtatgctatgcgatgccagggacctacagccttttaagagatttttgaccaaagccgtctctttggggtgtttcttgactcattttttactcattatttaattttaataacctatagtacttaaaaatgtacagtactatataaagcaccttaaaaattgatgcatggtgattttcttattttaaaattgtgtatgattttttaaattattataaaagcagcttatgtctattatagaaaataggaaatacagaaaagcaagaagaagaaaatataaaatgtgcatacgagtaattacttttgtaatatcattgtatatctactcatatcttttcctatgcaaatagtttttctacaaatgggtgatatttatataactgtttcataacttactatgggaatgaacatcacatacgtattttaaaaaatattctcaaaaatatatttttaaaatgtatattgaactagattctgagaatttacatcattattatagtaagaacattatccttgattttgattcatagtctaacataccaaactctaaatttcttctgttactcactttacataaacacattgcagccagtcaccaacccttacatatatccctgcacagtttgagcagttttctttattgaaaatatttttaatttaaaatcattttaagttttatattatcttggcacattaacccctgtggaaatgtgtaagacttctcttctaaaataaattatttcataaagagagagagtaatagaataagtcataaaccatgctgatgaatttttagttactactgtctttaaaaagtaaacaaaaaaacagaaaataaatattttacatcttttacagccaactctttcaatgagttcaaaaatttcatctctaataaaaaagtaatttggggaacatttaggaaaaaagcaaaatatataaagcaatgtaaacaataacttttaaacttgcttgtttagaaaatcactggggtacaggttagtcagcctgataaactctaacttgccttcacacctccctcctccagcagagcctcctctgacagccaaacatctaggcatttctgtgttccattatggtaatgattgtctttttttataagtgactatatttgtttgtctttcctcttccctccactccagttccattagggaaggcatagtctttccattttgaatatttggtgcttgagataaataaaaagttttgttgggtaaataaatcaattcacttatctattaatcaatggcagtatgctttagcaagagtaattatgaatatctaataagtagtaggaagaggaaaactaacatgtattaaaatgcaattacatgccaagtcatctgttgaatcctaacagactttataatttcattttttcctgctataatgacgttttaaattatctcacattttcttaaacaattattaactaataaaaacatacagcaacttacataaaaatagactctgttttgcatgatatagttgaaatttttatataacttgtatatccatatgtatgaatatatatatatgtacacagactcagaaagagaataccaagaatttattgtttaaaaaaaaaaacctctaaaaagcaagaaacaaaatatcttgcaactcaaagaatctcatttatatttcacatatgctgtagacacagctcaggaactcagatgtgatgcttatgaatatgtataaagtataattagcttagaaaatgctgcttcatcacctgtcctgatattgttgatgtgcttcaataacttaccaagcaatgctggaaaaggttctctccaaattccagtgagttgaaacggtgcttttcacccataacatgttagtgttttccattcccttatcatgtgaaaagcctgtcctttaaacccagattgctggcagactgcttgtaactgacagttgtatgccataagctctttactttaatattttagagagcttcttgaaacattgaggcatgtcttttcctccaaatctcttgatttttaacctctcaattccacggtgcttgcatgaggtgactattctcttttctctggcctatactattacaataaccaattgatggctccttttttcccacacagctgcccaattcatcttcttggactacagctctgatcacactctcctactcagaaactttcaaggcctccaaattgctcattgcccagtttccttactcgcacattcaaaccttccagaaattgactctgacctgtctaatagccttacttctccacattgcccttgacgaaccctacaaacttagggagctgaaatactcgctctcacatccacacatcaaaagtccctgcctgcctccctgcctttccttatactatttctactatatcttctacattcctgtatatactacctgtctcctttcatctgagcaaggaatggttgactaaggatccaggaagaaatcactgacttcctaaaaagcagggaaaaaaaaattgcctggaagcaaagagcaggtgatattcagaaatgcaagaagatagaaaattagcaacacggaggtctgtatcagtacatagccttcagtcagggctgtcatgtttctggatgaaggtgcaagagccagtggaaaatcaatacattgataatcatccagccagactaatcagaaaaaaatcagaaaagtcaccaactaccaatatcaggaatacaagaggtgaaatcactacaacttctgcagatagtaaaggatgttaagaggatattatgaacaattttatggcaataattcaacaatttggataaaaagggcaaattctttgaaaatcacaaactaccaaaactcacagataaataatctgaatagttctatattcattagagaatttaatttgtagttcaaaaccttcacacacacaaattcagttccagatgactttacttgtgaattccaccaaatatttaatgaagaaataataaactctttcagaaaattgaagaggagaaaatacatccaacctcattctacgaggccagtattactctgataccaatggcagacaaagatagtttttaaaaaagaaaattatattatataacaatatccctccatgaacatagatgtaaaagttcatggcaaagttataacaaatcaaatctaatgatttactcaaaggattatacatgatcactaaatgatattaatgccaggatgtaagattggtttaatatttgaaattagtcagtgtaatttaccatatagcaaactaaaaagcaaactatataatcacctcaattgatacagcaaaggcatttgacaaaatgcgtctatttttttttaaaaactgcctactaagagtaggggaacttcactacctgatcactataaaaacctattttttaaaaaaacctaacagctaaaatcatacttagcacaagactaagattaggaagaaggcaaggatatctgcttccattacttccatttaacattgtactagagagactaaccagtacaaggggcaagaaaaaggaaataaatggcatccagattgaaaaataagtacaaatgtttttattcacagatactatagaagtctaagcataaaatcctggtggttcatgcctgtaaccctagtgctttaggaggctgaggcaggtggattgcttgaggccaagagtttgagactagctgggcaacatagcaagacctcatctctacaaccaaaaaaaaagtttaaaaagcataaaataaaatgctatctattaaaaaaaagttactagaactaataagtgagcttaccaatgttataaggtacaacatctatatgtgaaaatcagtcatttcaaagactggcaaggatacgttggaagttgaaattaaaaggttacagtttacaatagcattaaaaatgtaaaagaccccctacactgaatactctggagataaataaaagaaaatctaaataaatcaagagatataccatgttcatagatcagaagattcaatattcctataatcctagtttatacatattgacctacacattcaatgcaatcccagtaaaaatcctagcaaggttttttcctaaaaatttacagatatgttttacaattcatatggaattggaaaggagaaaaatgttggaaaggttatactacctgacttcaatacttactaccaagctatggtaatcagagaatgtggtgttggtatcaatattgacaaatagattattagaatagattaaagagtccagatatagatccagacatgtatggtcaaatgatttatgacaaaaatacaaaagcaatacaaggtatatttaacaaattctactagaggaattgaatatccatgaacaacaacaaaaaaaatgaacttcagtctgtatcttgcaccatattccaaaattaactcaaaagagatgctagacctaactgtaaaacataaaaatataaaacatctaaaaatatataagaaaaatctttgtgatcttgggtaaagcaaagattcttagatacaccaccaaaagcatatcctcaaaaggaaaacaaaattaacaacttaaatttcatcaaaattgagaacttcttcccttcaaaaaaaaaaaagcacttttaagaaaatgaaaagataactacaaactagtagaatatatttccaaattacatatctgataaaggacccatatccagattattcatatgtatcattcaaaactcaaaaataagagcaaataacccaagaaaatttgaacaaaagatttaaacaggtcaccaaagaaggtggaaaataagcatgtgaaaagatgctcaatgttattagtcataaggaaaacacaaagcaaaaccaaaatgatgaccagttagaatgtctaaaattttaaaagacaggttataccaagtatcaacaaagatgtaggcacatgcagctctcatacactggtgatgggaatataaatagttcagatactttagaaaacaggttgataatttcttaaaaacgtaaacataaattaccatatgatccagccattctgcttctgtgtatttactccaagataaatgatggcatatgttcacccaaaaatttgtacacagatgtgtacatatccctatgatgaaataattaccaataaaaaggatcaaatatggatacacacacaacatagataaatgttgaaactatgttgagtgaaagaagccagacaaaaagagagtacatgcagaatgtttccatttgtataaaattctatgaaatgcaaacctacagtgatggaaagcagatcagtatttgtctggggacagagggaagagaaggaaggatagaagaaagagattcaaaagaaatgatggatatattctctaccatggttgtggtaatggtctcatgggtgtacatattcaaaacttatccaattgtaaattggtttgcatggtttatttatgccagttttaactcaataaaagtattaaacagtattagtcatctctggtcatagtccctccacaatttccacaacttagattttagcctctttcactgttgtttgggccatcttcctcttttctctcttaccaattccatttattttcttttttaaattctttttacttttttttaatttttgaaacttgtattttaggttcaaaggtacatgtgcaggttttttatataggtaaactcttgtcatggaggtttgttgtatagatttcatcacgcaggaactaagtctactacccaatagttatttttctctgtttctctccctcctcccactagctaccctcaagtaggcctcggtgtatgttgttctcccctttgtgtccatatgttctcatcatttagctcccacttataaatgagaacatgctgtatttgattttctgttcctgcattagtttgctaagaataatggcctccaactccatccatgttcctgcaaaggacatgattgcattcgttttatgactgcatagtattccatggtgtatatgtaccacattttatttatccagtctgccgctgatgctattccttattttcttatgctcagcaaatcaaccttttctctccactttaatcctgtgcctcactttgcacacctgaagttagctttaaaattatgacttttaaatgcttgtcagattacattcttacaaaaaggtattcacactccaaggcactggggaaagctgttttctttttttgtctagtttcatctagtactataaatggcctatattatcttgacaattcaggattgtattatcatccttggttattttaccacaataaggttggcatctactgagacctactttacctctatacattttatccctttccaaattgactcagactcctgagcttcaaaaattcctctctccactttttagagttttctcttctctttgctcattgtcggacagattgtcagctgtcacttctgctgttttcatgtgtttgtttagagaatcttcacacattctttcattgtaatttcctgtctctaaattgttttgattcagaaaacctataaccaagggagtaaaaatgacgtgtaaatttggaacaaatatagaatctgagtgggtaacctgaggcttacttcgtgagttaaagtacattgcatctgtgtcattaattttgacactcttttttttttttccaagatgaatgacacttatgtgatgttactgtatctaattcccaagagaactgtagcaatgagaattcctgtttttcccagcagaaaacatcatcagttttctggagaataatttgccaaggttgtcttttgcaagaactatgttcagtgttcttttttatttatgtagatgtttccaatatatctttttgtagatatgatagcattgtacaatcaatctgttctatgagcaatcaattatttacctgaaagctgttagaataatacattaaaataaatttgaccacagccataccaagttctgtaatcttttctagtttaatgttcaaataatgtgactgataaaaataatgtaactaaggcagtccagatgcctttaacgagtgttatgtctgtgataatctgagttcagatttatatcttcaacagtaagtatttagcactctccaacccttcttgcacttgcaatacttttccaatttaaaatttacacataagatcctgtttgatttatctcttggtatatatgaattatgtaatgattgctgaggagcaaacactattaaaatgggtaactagacattcaagttaaacattccttttcccatatcattctattaactttgtgtcaccttttttaatctgagtctaaacaaatatatctttgcttggagataattgtggctcagagattgtcatttagaagattgtgttttgccataccgctttaagatgcattttttaaaagaagcagtgttctttctcatttcagcacttgggagatacaggaaatgctcccctctcagtccacaactagagtgaaatttgcttaaggataaagtcaggggatgtgtttagttcttaatttgcttgacttctgtagcacgtcataatgctgctcagttatgtccttacaacaccgccagttatcatgcatcgagtcacttctgcatctcttaatttccatagtgttatgctctcctaatttctccttttcctctgtggaatgccagtcaccttgccagctccactttctctgcctactccctaaacattgaagttcctaagaactctgttctagatcttcttctcataccgtaataaacagtctcctaactttaactaccgaatatgtgctaataatttacaattctatatctgcagcccagagctctttcctaaaggcaaactctgtgtaccaactgccttctggatccctccactccattattctatggttttagatgtatgacatttgtttttctgtccacaggcaacaggtcctcggggtttattaaaggaagatgccaaaggctgtcttcagaaaagcttcaggattcttaacgaagccaagaagttagcaaatgatgtaaaaggtcagtgtggccatagtttttattatattccagttaatcgggttgttactgataagatattctatcacactattggagaatgtaatttctttagcatgatttttgtgatgattctataatctatttaatgcaagtaaactttctcactagttttacaaaatgttgtctacctatctcacttcaagtagggtaatatctcataatttgtaagtcttatttctatagcatcacttcacctatatctaatgtatagtaacttttagtgtaataagtttttaagagtatcaaacccaggccagccatagtggctcacacctgtgattctagtgcttagggaggccgaggcaggaggatcccttggtgccaagaatttgagaccagccggggaaacatagcaagatcctgtctctacaaaacattttttaaaaatttagtcaggtgtagcagcgtgagcacataggcatagctacttggaaggctgagccaggaggatcgctttagcccaggggcgtgaagttaccgtgagttgtgatcacactactgtacaccagcctgggtaacagagtaagatcctgtctctaaaaagaaaaacaaaattaaatacatttttctttttctgagatgaagtctcgctctgtcaaccaggctggagtgcagtggtgcgatcttggctcactgcagcctctgtctcccaggttcaagtgattgtcctgcctcatatctgggattacaggtgcatgccaccacacctggctaatctttgcattttgagtagagacagggtttcaccatgttgaccaggctggtcttgaactcctgacctcaagtgatcctcccgcctcggcctcccaaagtgctgagattacagatgtgagccaccgtgcccggccctaaatacatttttcttgtattttatttctgattcaggaatcaaaatgcacaaaatatctactgccatattatgggttttatgttaagaatatatcattaaacatggctgctctctatatgagccattacaattattattttatgcacttatctcttgtctcccatttgaattgccacctgtttctctcttcagtttcattccctaccattttctgtctcatatctgtctccctacccttacctaagtattcataattcctcccaaacatgctactattccaagccttcatgttttcagtattatttcttccccttggaatgccccatccttcacctctcttctttgcctaactgctttcttccagaccttcaggatttagttcaaatgccatcatttccaggaaacctaacacctcatctgatttacatgccccctctctggtatagttttctcataggcttgtcaaaccaccacaatcatggactaattaatattccatcttcttttacaatttttaaaacttttttattgatgcataacagatgtataaatttttggcattccatcttcttgaggaaagacatggggttttgctaactgtgtatttctagtatgcataatagtgactagctcaaatgaggaaatacttattttttacaataaatggtgttggcttatcttacttatcttagaaagagaagaggttttaaaatcatttatatttggcatgttttggtctcagtagaagctgatatgaaattacaagttctatctcgattataagtaaaattttaatagtacaattcttcaggctgtgtattacaggtgaaataaaactccctacacacataattctgctcagcaggtacctcttattacaatctgaagaatgactgtaagaagccaaaacctgtgttcctattggacaaatggactcaatcccgtgactttgcggtcactccttcctatctcatacccttgcccagggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagccattttttttccaagagaaaaagaaatctaaagacaagcattgtaggaagggttaggagacagaaatgttcattagtttaaatttattttttttgtagttcaggtagtacattatttaaagtaatgaaaacccacaaactactcaagtaataattcctctagaaaaccaagccaaggctatgacggagatgggaatgttttcttgctacattatgacatttctctgatttgtggccaattacggaggttataaaatggctgttaatcagggaaatgccatatattactaccaggaactgctgaaataggccctacagagcaaaactcttgacagcagctattaaaatagagatttagtcatttctctctctatggtgcctggagttagaaggaataaaaatggtgaggccagtataccctccatatttctaatttgttgcttggttcaattcagtacagttcagttagtttgtgagcttcagtcatgaatgacttagtactgctccctgccatttttatgctgtccttgccttgagggaatctgaacttgccgggagcaatttgttttgctttttaatttttgaatatacatctgttaaaagtaaatttgcccttgtgtgagtttgagatttgaagcctgtctacattgcactgatcgaatgtttgtggagataaaaagtattttgttgatggatatgaggcttggtacaaattgatgactgaaagagtgaaaagatgaattagtaccaccaggtgaatgaacactgctttgcagatagacaagaaattttttaaggccgggcgcagtggctcatgccctgtaattccagcattttgggaggccgaggcaggcagagaagtgggagaataacttgagcccaggaggcagaggttgcagtgagccaagatcgctccattgcactctagcctgggtgacagagtgagagcctgtctcaaataataattaattaattaataataaaaatttaaaataatttttttcagtaaaatgccaacttcattttctcatggaatgtgtacgaggcaaggaagaagtagaccttggtttattaaaagtttgagaatattaagattttaaaattatacatcttaccttatattgactaacttttcagttttatttccttcttaatttatccccaatttttgtctttgcccaagataaatgaaattatttaattacttagaaaaataataggtaacatgttggccaggtgcggtggctcgcacctgtaatcctaacacttcgggagaccgaggtgggcagatcacctgaggtaaggagtttgagaccagcatggccagcgtggtgaaaccctgtctctactaaaaacgcaaaaattagctgggcatggtggtgggtgcctgtaatcccagctactcaggaggctgaggtaggagaattgctggaacccaggatacggaggttacagtgagctgagattgcgccactgcacttcagcctgggcaacagagtgagactctatctaaaaaaaaaaaaaaaaaactaggtaacatacctataaaatagataacacaggaaataaaaagacctattccctggagatctatgacagctcattttaaaggaggcggtttgtctcatagcactgtagcctgtggtatataattacagttaacccttgaccaatgcaggggttggagagcatggacccctgcacagttgaaaatccatgtataacattagactcttcataaacttcataactaaacttcataacataaactttataaactaaaaaaagaatctattcccaagcccaaataatgaatcagtgcattgcttgacatatggtgctgtcccacacagagaacagtatgaaacattattccaatcattaagttttatcaaaccagttgaagccttccttctatacagtggtcctccaaacactcagtcattccgttcagacaagtgggtcttgaagattctgagatcatggatgtaatacacttgcaaacgctaacctgttgagattctgtgttattattttatattttaaaaataagagaataaactggaatactgcagtgctgctaaaccaaagtatgatataggagtgcaattgtgactaagggatccttttattattaaagatatactccttttgaatttgcatattaccctttgcctgaatcagcctttccatagcaggcatgcaaaagacaagcaaaatctgctctattgaccacaattttagactaaaaggatgaaattaagcctgggtcccctggcctactgtggtctggagaacaaagcagtcttttccaggtgaaattgctgatccctcatacaaagttttgattcctcctttagagtgtgaatggtggaaataaaaaaataaaaccagggtggacttccattagagaaaaaacaataagtggcaaaatagtggcaaatatagaggggcaggttctattggaaagattatccctaagagcgagacgtagcttgtcatatccaaccccaccatgtgagtagaggacaagaaacaaacattcagaacactcctgtatatcatctcagcaagagacaaaggcctgtgcaataaaaatggggcttagagctaaaaacttatctgggctttgttgtgtgttcagaatcagagtctgagattctatggcgttttttgcaagtaagttaatttagaccagaaataaacagaaatgccttcaagagacttacagataacataaagggatggtggggcctgtgttaaaccaaagactatttgtcttatttaaaggtattcaaactcaattttcttgctgggcaaaagaaaacaagcctgcaagcccacagtcaccatgtcctagaggagccaaatgcaggtgttgatgtctggtggttttagtttttcattccactggctgcagaggggactcccttttatcccaatatcctgaatctttgcagaacctgctaccagacaagtacaccttccctcctttcctgaagctcctactatgaccccctagtgggaggaagagcatatgcaagcatggtgcttattgcgaacaagatctaatttcttactttcagatcagaagagggtttctccataacctgactccctgtgaaacagtcatctctgaggttcccatatgtggtcactctagtatgtatgtctgtctgtgcagaataagtaatcagatatacagcacatcccaaacttgtgacagctactagggaaagggaagcacaggagtaacaatcatgaaagaaggctagaaatataaaggttcaggaaatgataccgttccgaatcattgtcaccaaattcaatgattgcctgcataatgcagaaaattggagggattttttctaagaagtacaaagattgggtgtagcaaccttatcaaatcaatttgctggagacctaggagagaaatacagttgtagatttcaacttctattcttcctcactcgggtgctcttctttcctacccaggtctcaagatcctgcactgggtatttaggttgacttaggggacagggtctttagaaatctcaagaagccaaaatctgaacacagtcacttatgcctgtaatcccaggtcctttcaaaagtaatcacatttccatgaatttcacccttgtgaatggggcattctttcagggcatttatttgtgccctattcatattaataaaaaataaaaattccatttgagaaactcaactggatggaatttgaatagtcaaattaaacatttccattaaaatttataaaaatcgtcccgatatttagttgaaaagtgaggaatatatacataggtatacatatgtttaggaaatataaaaacgaaataaacttaggttctggaccaagtaatttaaataaaaaaggaataaagtcataaatagcattattataataaaaactggtaaaacacaccaggacaattttcaaaccaatgtcagtgtgttaccttttacttactgcctatggtaaatccagcactttctcatacatctcccagtttatttctcatatcagtcacatgaaggaagatgttttctttatttgccatatgtaaaaagggacagaaatgacatttgaacccacatcttccaactctgtgtcctatagtgatttcattgtaccagactagatttcagagaaatactgtgtagcagttttattttgagatcgtacatagttagttctaatataactaagccctaatttatatttagcatcatgtcagaaacatgataaacaagagtaactgctcattattaatgcaagtgacttgcaactctgccctgcgatttttattctggatatatctatcttgtgccatttcaatgggcatgtgacaaaggaaaattacactgtcattgtgttcccagtcgacccttgctactctgctgcttccattccctcattgtgagtcctgcttttgccaaactaattctagcacatttttcttctactctatgaggaggagatgagaaagggagagccagacttaaagacgtatgtgtgtgtagcctttgagttttggtggatgtgatctttagagagaaagtagaatgactaggcttctgttattgggtttgagagctgaaggaataaggagagggaatctagaaaataaaactatggattataaattaaatcttcttcttattctccagaaatcacaagtaaaaaaattcagttggattttcttttaactatcgataattctatgtcttcacccttgttacaattcaaactgaatcacaagagttctttcttacttttagttatggatacactatgcctcctctgtcttttatttaaaatcagcccaggagtgcttatttttctaggttttcctcgctattattttgtaagttccattttgaaatctgcaattcttctctgaatagcttctactcatctaattctatcaccaaagctacaaaatgtttagatgtagttcaagaaattccagaaactactttagaaaaaggtgatcagcgtaagaaagggcaaattaataaggatcagagtcaagcagctgaaacattaaaaaaaaatcagaacagggttggaatatacacattgtaacttgctagtacaaaaaaaaaatgcagagaatcaaaattagcgctttggaacttgagaggcagcagtaaaaatattcttcaggtcagtcttctgaataattggcccagttgttcagccagcattttgctatcagaatgcagaaagtggtataaacccagggatacccttcaaattaatgatctttctcaccatacatgaatatcttgcttgccagaacatttgaatgctccattattttaaaaactaaatccaatcaagaagctaagaaatgaaatttctacagttccattttcttaagtgttgaagactttcaagctaatatcaaaagagcagccctttattctcaaagaatttgtatagatatcacagtcataatcagactggctttatttcagagagtatgcttttggtagcctatccaaagattttattttagtataaacagtaaaaataacagaagtattataagaaagatgaattgtgattgacagaggagaaaatccaattacttggaaagtatattttgtgggcttagaattgaaaataataatatattagtgactgaactagacatattgatgttttagagccgtgctttgctggaatattttatgctttgtttttcagtgatgtcaggtctttggcttggaatttaacaacagacactttaaacaatgttatgtgcttatattagtataatctgtagtataacagaagtttaaggtgtctgcctataaaaccctttatatgaagtggagtgaatcattaattaatatgtcccgtactcttcttcacatccagacaccgatagttcagaatcctccatctatccacctttccctttgctattcttcacagatgcaggccaacaaagatgaggatagttctccagctgcccatggcctgcacagttcctctaatgagccacatgcacaacctctgagaggggtgtgcacacagtcaaatcaagactgctgtagctctattctttggggcgtattctctcccacctgccttctctgggtaccaggaaagtgatgaaaatcagtcttggtgttgacaaataacatgaagatagcaaataacattcttccccagttaggtggtttaagttttttaaaacattgaaaaacagaaatatatgcacacagaaagcaatttagccagcacaaccgggtataaaatgagaagttttagtacattgtccctcacggcactattaactgcctcattcattcccagtttctacccactattaattactgtaaaggtttttggcatgttcttctctacccagctcccaccagcccctaccatgccaaatgcttgtatatgtgtcagcatatatatggtgcatcttgcttattttcatggaaaggtcttaaggtttatttcacatccatatccgctcatctacttctttttatagattgcacctgtaccattgtatgaacatgctgtgtggatataaacagcactttaatcttattagggtatttttattcccccctccttttttttattacaaatgaagagctaatgagtatccccaaagataaatcttttacaggtatattgaagggtaaatttctatcagtagaattgccaaaccaaatacatgtctatttaaaattctaataaacttattaacttgctcttcaaacaatggaatcaatctgcacgtccactagcactcttgtgaacacttggcattatcatacatttaattttccccaatctcaaaaataagaaatgacatcttactgttgcttagttttacagttctttatgataatcttgagtgctttttacgaatttcataaatgattatgtatgtttattttattgtgaactacgtattcttatattttcctcattatccttaaaaatatggaacactttgcatatttgcctgccagttttgcacatagacaatgctattctactctgaataattacaacttggttatatatgttgcttaggtgaggcttctctgatttctgtaactgtgaccaatttctttaagacaacaaaggagaaaatgagaggaagacaaaggaaaggaggaggacaggaagaaaaggttgagggtgatggtgggaggagcattgctacccaaaatgctctactaatccctagttttgactatcaatccttggtagaatgcagtagttagcattgtttatggaatgggactatgtggatttgaataccaccactgccatttattaaccatgcaagcttaggaaatttactcaacttctctaagtctcaatttcctcatttgtaaattggagataatagtagtatatacatcatcatatacatcatacatcaatgttattgtaaggattaagtaaaacaacccactgaaactgaagaacactaaatgcgtgtaacatacacattcaatgcttgtcaggcattactcttactaaatacttgtccatcctatccaggagggactagaacaacttctctttcttggtcctttctcagtggtcctcctcacttggggactctgtcttgtatttacatgttgcatttctgtggagctaatttaaacaattagtacgcatgtcccaaaacaatttttatggcataagaaactattaaaaatttacctaaaaaatgagctgttgtatccagtcaagagaggtaaataatattgtgggaagtataggatttttcatattttgttttttcaatttgaattttcactaataaatgatgtaagaaaaagaagacagatgaactccatttcagtcttaagatatatttgcagtttaatgcatacctgagtaagatttctaaacttatatcaacagattggatctttattttctttccccttaatgatttcaaattttactctttatattgttgtactcgaatttaaactgcttagttactattacaatataaattaatctaaagtttagagaatattaaaaactagtggaaagcagctagaaaacttatatatgtaatattaaattatctctagcaaatggcatttttgaatattaaagataacattgctaaagtatcaagagaaaaaaactatataaaatttattggacccaatttgtaaaaatattgttttctttatgagaaaaatgactattatcagatatgtgctaaatgttgtttttccatttctttaatgtgtatttttgtccaaataaatattaacaaatattattatactgaagttggaggattctgctaaacaatcatatctgagattttgaaaatctaatccaatgattcattttggtaataaaagtttttaaataagtggaatcaatgggagtgataacaagagggcataattacaaatggaataaaagactaattctttggaggtttcttctctataggaagatatcaaattaagtcagataaagatcagataccaagaagaaaatgtcattgttcaacatgtagaagcatccaataattcaatgataataaaaacacatatttttaaaatatgattggaaatatatttatgtatagatgccaataaattaaatacattttcttgcttttaattaattttatattaaaataacctgaaattgcacatccaagtataagctcagggatgataaaacttatttaatccttttttttgttttttattcgcagaaaatgaagaccatctaaatggcttaaaaaccaggatagaaaatgctgatgctagaaatggggatctcttgagaactttgaatgacactttgggaaagttatcagctattccaaatggtaagcattcaggacactaccaactgtgtcagttgacctgaagttttgaagactgttgttaacttttaccatttttttctaagattattctggtactattatctggaaattagatactgtttttcttactcatgaattcttctttgtgagaatgagaaactaaaccatactttgcattatggtattttttatcttttattgcctttagccagtatccttaggaatgtgttacagaaaggaagatatagacatcttattattataaaactcatccttcagtattggcaggggattggttccaggacccccccccacagatatcaaaattcttgaatactcaagtcccttttataaaatggcatagtatttgcatataacctatgcatagcctcccatatactttaatccctagatcatttataatacctaatataatgtaaatgctatgtaaattcttacagtgtattgtttatgaaataatgacaagaaaaaagtttgtccatgttcagtacagacacaaccattttttcccctaaatatccaaatatccaactctccaaggttggttgaatttacagatacagagcccactgacacagagggacaactgtattgtcttctgtgtttcagcccaagaaatcgtgtattagtgaaatagaataaatcacatagacactaatctctaaaatactgatgtaccaccacaaagacacagtttattaaagtacctgcagtaataggtgatagcccactgcattctctcttgataaaattcaatttctttaactattccaactttcaaaaacattagtggtcaaaccatgtctgtaatatctttctacctattagaactgctggaaatttttgcatggtattagttcctgaaagcacacgttattttaaagatactacttttactatttttatattgttaaagcatgatataataacaacaaagattataaacacttattgagtacttaatatacttatgttaagtgtatgtaatcctcataccaattggagcaaaaacatttgcttcatttgcttgcatcaattggtcatatatatatatatatatatatatctatctcaattggttatatagataacataagtatagataacataggtaacattcagaatagtcacttcactactttaagagctaattaggtattcatacagatacagaacctactgacacagaaggacaacttgtcttctgtgtataacataagttagcactaacacttaacatcagttaagatactgttattatccccactttacaggtgagaaacagacagaggatactgaaggccattgttaaaagtggcacagaggaaacttaaaccccacagtttgatttcagagcctatgatcttaaccactaacctatacacactagtagtcatctataggtacaatatacaaattaggatcaggagacaaatgcacatatttatacaacacagttaatattaaaatctcggtggtttttacttttttaacgtttaaaaacctgagtaacttttcagattttcatgtccctttttcagtagtaagtatatagaaaatttccaatgctgaaaacaagtataaatgcatggcctaacatacctgaaaatgtttctctatcctaaaatgaaaatacgttagtttccctccaacccccaccccaacccctgccctgctttggaaatgcagattaaatcttaagcctcgttttcatgaagctcatgtggataaatttatctcgtgaataagttcagcagcaaatcacaatatgatcttatacaatgaacatttagaatagtcacgtcactactttaagagctaatcaggtattcatagcaaaagtccctgagaaaatttaatttacctaaaaaaatttgcttcatttgctacacctgaatgagacaaagttcagccttttccctttgtaaatgtgtccgaggtcagccagccacagcctcgctttgtcaagcatggattaagccactaactccacaccctttgttttgtttttcataccctcatctgctgacagatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacagtaagatctcctttttcattgtgatgatgtcatttatttcctctcactgtaaaagtatcccagacctgtaaatgctcgagttggaaagaccctcatggtggtgtagtctgccttccttctttcatagattggcctcagaaattgagtgtcatgcagttccaaagctggaatccaagtcttctagctctgccccggtgcttttttcctctgaaatttttccagttgagaagagattaggaattctcaaggtgtgcctaacattcagcagagagatgcaaaacactttttaatccgtgtgtgtaattaaaaacacagttgtacttgggtaattatatcctcagaactggcgaagtgtcatggaacatagaggttaaggggcacgttcatgaacagacttgttagaacaggatatgaaaatgatatcaacttgaaatgcattaaaatttgaaaatcttgatattttattatttagattccagttacatcacatttctgggaaataaaaataaagcatttatctagtttctaaagactattcacatctcttatatattatataaaattatattgacttaaggatttactgagaaaacctgagagaaaatatcataacttatattattagttaaatatagtcaaaatattaagattttaaaatgcatttttccttttccgtcaaatgatacaaggctatattgggccaggtacagtggttaacacctgtaatctttgcactttgggagcctgaggcgagaggatcacttgagcctaggaattcgagaccagcctgggcaccatagcaagaccccatctttacaaaaaatttaaaaaatagccaggcatggtagtgacattgcacctgtgttcccagccacttgggagtctgaggctggaggatcccttgaacccagaagggtgaggctgcagtgagctgtgatcacgccactgcactccagcctgggtggcagattgagatgctgtctcaaaaaaaaaaaagggggttatcttggtatccttgttacatggtttcaccaaaggagatgcttgggtaatctgtgcttttcactttcaagagactagccctctttatatgccaacatttttgggggggtatcaaaatatttggagtataaaaacaaaagcactgtaattggtattatatgccataaaattcaaatgctgtttgagtggggaatggagcctgatttcagcatcctagcctcaaatcaaatcctatggatgctatgatataatagacattattaatacgactccttcatgagcaaggaagagtacaaacacatataacataaacttcagagccagggtgaaaaaggggagataaaaacattttttaaaattttttaatgtaagcccagaaatggcttctcttgtagctcaaagtttacataataacttcttatgatttatgccaaatcacaatattcccactaaaaatgaatgaaaacaaaattttaatcaaatattactatctctgctgcttacttcataatttaagatatatttttaacttttattttaagttcaggcgtataagtgcaggtttgttacataggtaaacctgtgtcatgggggtttgttttatgaattatttatttcatcacgcatgtattaagcctagtacccattagttatttttcctgaccctctccctcctcctgctctccaccctccaaaagaattccattctattttagattgattctcaactggtagtggccttttgtcatatctctgttttaatcctatcctctattatgagaaatagttaattatctataaatattaattaaattgggtctgttttctatcttactaaaacatagaaataatttttaaaatacaaatagtggccactaaattatatattttgtgtacttttatttgataacaattgcttcagttaaaatggggtgcatttataattagtacctgttatgaaaaataccatttttagtcactactttataatatttatagaaaatacttcctcatgaatttataatttttttttgttttgcttccatgtgaaattgcctgcagaaatcagtacgtatatgtttacttatataccttttagtaacgctcatgcttcattgcctattgcaaaaagtttcagctttgcatgtactatattttggttttgctttaaacattgcgtagctattctttccactgttacagtattaatggtagatgcgtaaaaggaatcttcctttataaaaaggtcatatgtggataaaggtgatataaaatgtttttaatagtgttataaaaagtttggtcaggcgaagtggctcatactctaaccccagaaatttgggaggtcaaggtgggaggatcacttgaggccagaagtttgagatcagcctgggaaacatagcaagactctatctctacaaaaaggaaaaatgagtgaaatatctgtatgatagccacataaaagtggaaaactgaatttctctatagaattaactagattatgctgtttctgataacacaaattcaccccaacacacgaatgacttaattgcaagaggattaaaatagataaggtctacactgttgttgtttttacccactgaagctcactttttcctctccttgtaattattctcaacttctgtagaattatatttggagaaacacataataaaactaggtcttaacaaatgaacaactactgggatatcaaaatgttctctcttaaacatcccacagtttaaattgaaagtcaagaaaaactaaaaaaatagctacaaaaaataataacaagaataacaaaatttaatatatcactatttgaaaaatatgaccaagagtgtcctcagcggaaaatgagagcaactacattactaaaccatcattgaaataacaattctaaacaatcaactttgctgactttagaaaaagcagagttaacttaaagaatgaaaaagatggaaaaattaatgaatttgaagacagaaaatattagacctgataaatcaaaaaggtgactccttaggaatatagattaaaaattaagtgattgtcaagtttcatcaagaaaaataaaggacaaataggcaaagctctaaaagaggtatcactagacaagggaggaaatttaacacataagagatcacttggaaaaacttcaactgctccggagaatagaggaaaaagaggggagaagaggaacttccaagttccattttgaaacatttggcaaaaacttctgagaacttgtgaataaaagggtctgtaatttgcctaagtctaagtagtctttaactacttttgctctttctcattaatctaaatctaaatcattttgcctcagttttagaataatttgtagaatgtcagaataacaatggagaattaaaggaagggaaaaatgaacaaacggtttattaaaagcatacaaaataaagggatcactgtgtttatgctatctgtatgatgatataacaaacatttctatccagataacatgcatttcaggaagaaaatactgcactcagttcttgatatagcaaatctattagttaaatttaataatagacctatgttctttttaaatgccgctaacagcataagtcatacttatgagttcaaaatacctactttaaaacctaattttaaaaaaatgataatttacttccctttgagcacatgtgattcgttcctgagggttagttctcagtggttgtatgtcagccgcaaagcagatcattcagagtctaacacagcatgtagccttgaaccttaagcagtttaactttttcatcagagtcacagtgacagaaagttgaacaatacacacttaatcagataataaatgacatagtgtggatgagactgccagcatcccagcaatagaataagtggtttaccacgtggcataggccctcccttgaaaagcacatactgaaagtctatggatcagtgatgaccttcaactattttagggttgaaactttgaaattgccaatatgtaaccctttattttttttaacctacaaaaacagctgtttaatataggtcaacctaatatgtaacacagggtaatcaactattcttcaaaatgaaattgaactgcaccatgaaagatttaattaaatgtaggcctttagtctaagggtttttcaacatcaaaatgttcttcaaaagacattttgatagcttctctctttaagatgtgcaaaaaaagacggtgagaaaaagaaagaaaaccaattttgtgtaaaaaccctgatttaaatacagttctggcttggacagactaggtgacattttaaagatgctttcatttccttgcttctgtgactaaagttctattctgtaaaggttaactttttggctgaagttagaaattaagcattgaattaagttcttcatattctctaccttcaatgctaatttttaccttaatcaaaaagaaaaagtggtggccctctgtcctaacatctactcccctggcctgcttgagtctcaactaaaatattgacatttgccatcacacattttgctttagctgttatggccatgctttgtcacattaataagatgaaattgtttggttaagcatactgctattctaattctgtgtgtgcacgtgtgtgcatgcatatacatgcacactaattttgttctatgcagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctgtaagttctttttatcgtcagtatcagtaactgattgtaattgttggattattcatagagggaatgtctttccccaggattccccgttgaatgatcttgggtccttttcctttaactcgaagcgatttggggtaggaggggttggagtgggggagaggttagttttgttttgtttgtaaatttcaaaagacatttcatgagaatgataatcaccacttattgttttaaaactgggaattctggtatattctattactatttgcatagaataatacaaatagcaagaaagaaaaccttattattgtatactaaaaagccatggatgagagtaccttcctcttgctaaaaacaaaccaaaaaaaaaggccaactaatggggttatggcaggaatgaaggaacaatatacagaataagagcaaagagaaacaaacattttacatatatattcttttgtctggtataaacaacaataaaaatggctttggttatactttttacatttattttttgttttggagtagataggaaatagctgatttgtctcaaaattttgctctttacttacccaattagaagtttactaggatagaaacagagctttctagaaggtagcatgctaatgagccagggcagagttgctaagtggcaacgtgaaactttagtcaaaggaaggaagtaagggaaggggaggagaggggaggggaggggaggggaggcgaggggaggggaggggaggggaggggaggggaggggaggggtggtagaaagaaagaaggaagggcagttttcttgtttgaacaagaaaggcttgaactcaaacctttttagatacctcagttttccatgtcaaaaattctgttttttgaacaactttggaactaggatgatcagaaaagccctttcttagttcatcagtttatatttttagtagtatttaagaatacgatgctccagtaacagcatattctttttcctccttattcacatctaacacttctaaacaactccaagacagtaagttcaaggtgaacattgaaaaggaattcacgactgactgaaaaaaaacctagaaaacaacaaaaagattagtgaagatgatgttacataagatcagagtagtaaatcagtgaaaagatctgagaaaacatatattcagctagaatatgaaagccaggcagtatcgttgacatgtgatcattatgtatgtaaagcacaagattaaaagaaaccagatgttacttcaaggtttgaagttttatgtaagatttagccaacatggaaaaagcctctactatgttcagtgttactttccgtaaggtacacaaagacgaataaaggagttctttcactcacaaagtttataaaatagtagggaaaataaaatatgtacacgtaccttgtcacacaatgcagaatgttatgccacattatagaagccgtgagaagtgacataaaagttctagaaagaacaatcacctctagtagggcctgaagatttcctgaagggaaggatttgagccaggcattgaggtgggatagtgctggggagttgggggtggagtcaggtaacagggagagtattctgagaagagggaatgacttaaaccaaggcagtgggagaaggaagttttagggtccatttaggaaaaagaagtccagtttgcccagagtaattgataaaggaaacacataaccagaaagatcaacagaggccaggtctcgtcaggccttcaataatcagttaagcaatttcatttaacaacactggtacttgggataagcctcactggttaggataagctgaaagctttgagcatggaacacagtataatcagagctgtgctttttaaatataaatccagaagcagtgtatggggtagatgaaagaaagaagaatgaaggacccaactatagctgtggcaagagaaaagaagaacgtgatgtaccactcctatattttgcaatgttaacttggaagaagcaataagagtaaatattattttgtgaatctcacatttagccacattttctgacttagtcatcaagtggagaaatctagacatttttattatttcttcattgtaaagatttctgagtgcttttcccctcctcacaaaacggtgaaattcagacatgtaagcatataaaacctgtcttaaagtacaaaataaaagaaaagtataggctgggcatggtggctcaagcctgtcatcccaacactttgggaggctgaggcaggcagattgcatgaactcaggagtttgagaccagcctgggccatgtcacaaaaccacatctctacaaaaaattgaaaaattacctgggcatggtacatgcctatagtcccagctacttggggagatgaggtgggaggatcacttgctctggaggatgaggctgcagtgagccatgtttgcaccatggcactccagcctgggtggcaaatagaaaccctgtccccccccaaaaaaaaagagaagaaaaaaagaaaggtacaaaagtaacgttaagaaaaagtaatcattgtccatgcatttcaaagaaattcccaatcagttttggaaatggaattacaacacaatgccttattttttgtaagacgttagaaatatgcaagtagccaatttttttccaaatgagttttgtactaaatgaatattacattttctgatttgtaaatatggatatctggatatgaccttaacacatacttgacatgaccaaaacattaaagacatttattttaaagtagctttctctgggtttgttgattctgaaattgagtggctgatactcctttaaatgaatgacctacttactggatgaaaaatgcagtgaaaatccaatagatataataatgggatactcaataatgtttgagttcatcatgattaactggtaaataatgttgcagtattgaaatgccttaaagatacttaatgcttagtgatttttctttagatgtcttactaaggatctgcattagaaataacaataattgatagagccaaacattctaaaaggatgtttgaatttcagaaatttctttcctcttacaagagtgacatatcctaaagatttcttctagagatacagtattttgatttacctgatttcttctagagatatagtattttgatttacctgatttcttctagagatacagtattttgatttacctgttttaagttgtttaaaagaaatacctataactgaaaatcaaaacagaaagtattcaaaaggaaaagactactgattatgtactggctgtcaacagtttgggctaagtgaatgtttcagtttctgagagtatattcaaaaccagaaaacagaaagcaggtaatccaagagtattttctatatgaatgtgtgagagctgggcaatagattactgtctagtccacttcatgctgctgtgacagagtattacagactgggtaatttataaagaaaataaatttattctcacagttctggagactgggaagtccaagatcaagatgctggcaggttagggacctgtttttatgcttccaagatggcactttgaatgctcaggagaggaggaacattgtgccctcacatggcagaagagcaagagagagagagctctcacccctgtaagcctttttaatagtggcatcaattcattcatgaggacagagccctcatgaccgaaacacttcccaaaaggcccccctcccaacactgttgcactgaggattaaatttcaagcaaatgaattttgttggacacattcaagccatagcagttactctgtaggattaattgccggcatattgggtataacaacatcattttgcttcaagaatcatatttgttagatatgtattctatacaatagattggttgtaacctctagtgacattagatactcagttttaaaatggcttctctcttagacttggagttctcagagcagttagattttagtgctgctgctctgtctgctacacttttttttttttttttttttttgagatggaatctcactctgtggccaggctggagtgcagtggagcaatctcagctcactgcagcctccgcctcccaggttcaagcaattctcctgcctcagcctcctgagtagctgggactacaggcacatgtcaccacgcccagctaattgtttttgtatttttagttgatacagggcttcaccatgttggccaggattgtctcaatctcttgacctcgtgatccgcctgccttggcctcccaaagttctgggattacaggcgtgagccactgcacccggctctgtctgttacactttggcaacccccttttcaacacactaatcatggaatcccgtttttttttttttaccaggcttacctaagcaatgactgaaattcattctgtgaccaaatgatcacatattacatttatattgagtcatctcttctctaaataataactgagggatattattcaattgtgttgtttgttttgttttgttttgttttgttttgttttgttttgttttgttttgacatggagtctcactttgtcacccaggctggagtacagtggcacgatctcagctcactgcaacctctgcctcttgggttcaagcaattctcctgactcagcctcctgagtagctgggactacaggcacatgccaccaccatggccggctaatttttgtatttttagtagagacagggtttcaccatgttggccaggatggtctggatctcctgacctcatgatccgcccatctcagcctcccaaagtgctgggattacagatgtgagccatcacacccagcctcaactgtgttttttaaacaaaactgatttattaggaattaaactagccataatacagccatagggccaagctataaagcatttattaaataaaaatgaagtaaactacatacagtcgctttgactactaattcagccccattcagaattggatatgattgtctgccagggataacgcactatgctattcagttctactcatgaattccagtcagatcttgatttcttgttcactttgatcctcttatgatgtcaatggtacgtatagcctgcctcagatattaaattttctcaatgccaaggtcttctctgataatgattttggttcactttcagcagcttgctaaaaaatcactatatctgacaccctttcctgaacattaaaaatatctgaagaccatatttttcccacctgccctctactgtgctgtctttctcttgcttctctctttttatctctaatcccttggatgacccttggtatagctgccattgtatcacagaacaccctttgccaagtcccattgctcatctgctttgccatattaacatccaagtaaaaattgtacatttcctacctccattgttttgcaattcattttcactcacctactctcaacactgtatgtagaagggaaattccatgatttgtgaagcaggaactaacttcccaactgaaaaccaccctatccagaagactgtctccctaggacacagaacaaacactctgaggaccatagttggccctgagtcctgcacccagcagttggcaggctggccccacctttttggggaaggcaagaataagaaagtggtttaagcagtaggcttcctggaatgtccagccccaggccaccacactcaggcctccagcagtcaccctcctctgggtggtggaggaaacagcccctgtttctctccagaacacagtgtcctcttcatggagatacaatttgattagcagatcaggtgaggcaacaacaataaacaaataaatgacttatgcggtctgtgggagacgtaacagatcttctgtatccccagaaggtctcaaatctatatgaatttacctattgcaaaaatccctctttagccttctcttttgaatccaaccaatttggcacccaacctttgcagtatacttgcatgacccttggagaagggccacagttctgcccatactcaaacacaaatgaggctcttggagacacctcctggtgtcatgatcatatggaggctgttttggtttctaggctatcttgttgggagtctgcacagccctttcatggaggtaatgatgatgctagttggttttcttccaaatgtgcaaattacatgagtagcacaaaatgctagaagaaatgaaaaaatggaaattcactgctagtgaaggccaagagggcatttgaacaaatggcaaagagagattttacatcttcccctctctctgcctccttctggagcgctatcaatgaacaaagttacagattctctctgagtccaagcaactattttgctatcctgaaagtaaccctttgatggtgattttccatctgaccctacagaaattaaatcaaataatcaactagtgttatttatgattgaaggaaggctctctaaatataagtaaaaattggtatgaacagtattactctattcatataggcattccttttttagcaatttatagtaatttttaaggtattattcaaaagaaaagggagctgttaaatacattaatagtgatagccattggaaattatttccatttcatttcctgacaacttcatgaaaaggtacaatttattctgaaatgtatgttctgagtagaatgattaatattcttcttattgttagaacatctagaacaaaatctatttgtcctctttcaactgtaagagtataggagggttggtaatttcctcttgaaaactaaaagaaaaatagtttcttagtttaagtgataccaaaaccgctgaaatttcaattgtaaaatttcattaaacaaccttaatgaaggtcattctcattagctccatgtaaaatcacctgcctaaaacgttcccatattgataatggagaaatgtatgacgttagaagtttgttagttgcatgcttcaaaaaatagtatgctaacaagacatggaactgtgaacagctcatagtcaaaattctagtggaaaactgctcttctgtgccctcattaatgagtataatggtgtctgcatatgggtgtttaatgatagtatttgatgatagaaaataacttcaaagaagaaacgatgatggctttgtggttgtatggaagctacttcaaactttctgagagatttactcttggttctttgtatcttgttttttttaaagatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttgtaagtctaatattcaacttttcattaggctgctgtatgtgtatagctagaggttaatctgaaaatgtatagaatccccaaatgtatatggtccccaaatggtctaacgtaggctttcagatttgaaaacctcaacgtcttaccttacaaaattctgaagagtcaaattaagttagaaggcaaatgaaaggaagaaaactacagtgtttagtcacatttactttcatttgtcagtataccatcatttctgttaaattatactttcagatccagtgatttaagaatgctaatgagaataaagctattttatttacttcttatttatttatcttatttactgttcaaactaaattacaataaactcttccgttaatgaaatgaaaatagcaaagtgtgtactattttttttaccaatggaaactcttctaacttgtgttgaatttatgacctgaactgaaataacacagattatatctacaaaagcccacccataaagttctaatttcttccatttgaactatttgactttgcatgcatggggattttccaaaatgaatatgacttcttaacaaatcattcatggcataagtcaatatttgccatttgggtaaggaattctgggtcaatttgggaaataaaatcatagctgccccctcaaaaatgtcagtgtccttggtgaaaataataatggattctgaatttaaatatttgtttttatctttaccacaagtatcagagtgagaaaggctttggtctcaaaattagacttaatttgaattggtaaaattaacaaacatgcctgagcattatggactttttttttttttgctttaaggatataaaaataaaatattattttaataatgtataataataaataatattatttgacaagtattatcatgaagctcctaatcatttcacatgtctgcaaatggcgcttattgaaaaacactctgctggtctcctctttaaaggtgctttatatctgatatctcttgtttttgtatttctctgaactagattgactttctggctatagaaatgcgtaaaggcaaagtcagcttcctctgggatgttggatctggagttggacgtgtagagtacccagatttgactattgatgactcatattggtaccgtatcgtagcatcaaggtaaccaacttaataaagattaagataattaaatgatagaattttgaagtagtttcccagtttataagaaaactcctatttccatttcaataaggtaactgtgtatgcatgtaaacacatgtgtatgaattttatacatgtctgggagtgggtatgtttgtcatacttcttaggaactgacaaaccttccaggtattgaccagaggaacaactccatttctgaccccttcatcttgtgtctggtaggaatttgggggtgtcgctgtttcaggcttcctattttgcctgaagaaagtactgccacttattcttatgcaatacaagccaaagcataagagcaccattattgcttgtctttgttgtacacagctcctcctttagtctacatagccaccatagaaaaatgcagtttcaaaacactgaaattcttatgtaacataccaggtccaccctacttaaaatgggaagtaactgagaactgattcagttattctatctttggagctttaatgcaattatcaacatctagtaccatatatattacttatagaactatccctgtcttcagcacttccctcccattttctcttcttgttttcccaattctcaactccctgttaaacccaaagcagctaacagttgaaaggtatggttaagggcctagggctagacatgaagctgatcagagacagagaagacttaaagaactggttaattgttgactctgggtgatacatagagtttcatgctgtttgtagatacttaattttttccataataaaaagtttaaaagaaagagccatgtgcaatggcatgtgctgtagtcccagctacttgggaggctgaggcaggaggatcacttcagcccaggaattcaaggctgtggtccatgatgatcatgcctgtgaataaccactgcagtccagcctgggcaacatagcaagacttcatctcttaaaaaaaaaagttataaaaaaaaatgagaagcaatatttttagttctttttaaggaagtttttcagcaaaagtgtgtgtgcatgtgtgagagagagtgacagagtgcttgcgtgtttggtggtgttgagggaattaagtacttaaccgggtttaaggacatttatactcataaagtgcagttcttctttcagaaaagatacattctgttaaagaaggtgaaccttatttgataaattcattcttttgttaccatgtatttcacttaacattgcatcctcaaagaaaaaagattaccaaagtgagacagcagtcagggaaatatgacatcgaagttttgttatgactgcttgtctcaaaagagagaccagattttcatatttaacagctcatggaaatcaatcacttaaaaaagaaaatgaaataaaatgataatagctttcaaaattctgttaattgaatttaaaaatgaacttctatgcaatttgtacactgaaatctgaagggtggatattgtactgtatacattagtatgctgtgccaaacaataaaagatataccattctaggaagactacttcaacaaactgggatccaagatattataaagaattttaggagaaatcatgcagcttatgatatgaaagggtggctcatttggggtccactagctgaattaaattagacaaaatgctgaataaagtaatataaacttgcataaattgtatgtgttggtaaatagtaaattattatgtaagccataggaaaaaggctttccacttaaccaatagcaattccatcagttaactgctgctgtgtcatttcatgtcaatgaacacacacagaatcaggacctggtgctcactggttctggttgaaactgatgtaagtgttgagccaagatcagactctgagtattgattcgagatctaatgaatttggaatgttagaaactaaacagccagttttctcttaaattcttaaaaacaagtctccgcattttatatcttttaaatctggaattaccagaaatgtgatgcatatttcattttctgtatgttcctccccttcacttcaacacgtacccttgaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaaggtaatgtgttcatcctcctcctgtttatttcatctttgttgacatctcctgacataattacttcaggagaaggtatgataaagctctgtaaaacttgatcacgttttacttaacttgcatttatgaaaacatgaatttactttgagtaagaattttcttctttgacgattcaacctggaaacacaatatttttaagcctatgtgtatttatttaaacagctgttgttttgtctttatctgtggcatcagttttttgtatattcttgttttagttgcctcaagagcaaagtgttttttaagtatacctcatcttctgaatcgatttatgatttatagatatgaagtgctataaagttcatactcacatctaattaaaagatttatgaatactttgggaaatatcacaggagctataagctttcaaaacatgatctggtttttaaagttctcaagttgctcttattcttataggatgatgcacttaatattcataattgcttcatgacagtccttgcgcatttcaaattgcagaatgcctgccttttaaagaagcttgtgttgattaaatggaattaggtgttgggaaaccactatgggtgagatgcaggagcacaaccaaatataatggataatcctgggcttgtcagaatcatcctgagttgagattagtcagaaaatgtgaaaagccagggtgaccccaaatttatgaggactcaaccttcatatagaatgaggttattttatttactttgagtacgagatgtgactctaaagtatgagaatttattccaaaaccacacgctgaagttatcctcgtttcttagaacttcatataaatgtatatggtacatagtaatatatagtcatattatcaactttctctccttcacagatagataaatatagggatagcacacagtagtacaaaagccatgaattttgaaatcaaatccaggttggatttcctcctcttccacttgctaaaatataaccttagacaagtcacttaaccccttgggctttggttatctcaactagaaaagaatgataaaaatatctaccttgcttgcatattgtaggatacaataatacattttttaatattcttataactcttcctatatgctaagtaatgttctcagtaatttacatgaattaacttgtttaatttttacaacaaccccaaaaagtatgtcttagtccattagggctgctataagaaaaataccatgaaactgggtagtttataaataaacaaacatttatttctcacaattcttgaagctaagaagtctgagatcaaggtactggcagatttggtgtttagtgagagccagtttttcatagaaggaggcttcttgctgttctcacatagtagaaagagtgaacaagctcctttggacctattttataagggcactaatttcattcatgaaggccctgcccctcaccatctaaaactcacctctcaaatgccctgcctgctaataccatcactttggcgggtaggattttaacataagaattttgagagggacacagacattcacactatagcaaggcagatactaatattctcattctgtagttaaggaatctgaagaagagagatgttaaatgtcttgaccatggtcacacagtaattagcagagctgggatttgaacataggttaataggcacagtggtcttcactctcaacatcttgcttcactgccacaatgaatagtgagacacacactaccatagagtgtgtgtataaaatatatggcaaatagctgagatgtggtagtcacaccttaaattgtaccttaataattattatgcaaatgtaattggcacaaaaacagtattctatcagtctcagaaaaagaaagaaaacatgaacaaatgaaatctatagcaaaccttaggaaatcattttggccaagaatttcaagactactgccacaccagaatatgaaccaaaagctgaaaacaactaaatgaacttgctcatgagaattcaaatgagcaggaaaatctctcaaatatagcttttcaggatgcaagaagaagcaaaaagcaagcagaattcacaagtaggataatcaatctctagaaaattaagaggttcagagtgatgacagagcattgcaaggacgactccaatgtgcaagtcaggggctccgatcaacaatctttctatgcggctgtgcaatacatggtcacagcagtgggaaatgtacatgttgatgggtttaacctaaaaccatagcagtaggctataccatagagcctaggtgtgtagtaggctataccatctagatttgtgcaagtactgtacagtctatgcttttaactattcagtaactgattttactatttaaaattttaactattcagtaactgttttcttatgtgtgttctaaaaaccaaatgagtcaatgcatgtttttcccagataatctgagtaaatatgggttcactttggcacagagtttttaaagttgtaggcaccagaatataatacagtcatgtgtcactcaatgacaagaatacattctgagaaagttggaattaggcaatttcctcaatgtgcaaacatcataaagtgtacagtacttgcacaaatctagatggtacagcctactacacacctaggctttatggtatagcctactgctccaaggctagagcctgtacagcatgttcctccactgaatgctgtaggcagttgtaactcaatggtaagtatttgtgtacctaaacataaacaaggtacagtaaaaatacagtattataattttatggaagcaccatcatatatgtgatctgtcatttaccaaaacatttgtaatgtgtcaatgccaaaacagttgtttcaatttacaacaaacttctctaggagggaccaggtcattctctttcttcatgattgtgtatcaagcctaagacttttcctgtgaaaatgacaccaggattgaatttgatcagattatttgtcgattctctatttgactccaggccctgtgctgtgtatacaagcaaacgacaccaatgtggtctcatttcctacaaagttgcttactttttctttattcccttgaactcgaaatcttcttggctgtgaacagaaatttaaaaatttacagcagcactaccatagagtgatttatacaagtgcttttaaaaaatctcttctatgtcatcagcatgtcccctttcttctgatctcaggggaaaaagctttgtgtatgcatggcccaaatttgcccaaagaaaattatgtaggagcactagcatttattgaacaccttctgtatatcaggcactgagattggtgtcataaataaattatctaactttattctcacaaaaattccacattacagacaaaagaatagaattgtggagaaggtcagcagctcacctaaagttagaagctaggaagtgtttatttactgatgatgaaaactggtatagcaaaaagtaatcagcattcgtggattaaatagttgagcttttcccctgttgttgactcatcctgtagtagctctaaggatacggacagactatgatgaaaagatgaatatgtacatatgccaaaatatcagaaagaatggataatgataactttagtttctgctgataataactctcatggataaaccaagattatttgtgaaattccaaattctagcaaataacggtatttctttctgcagaaggctgatgctgtacgtgtgattacattcactggctgcatgggagaaacatactttgacaacaaacctataggtttgtggaatttccgagaaaaagaaggtgactgcaaaggatgcactgtcaggttagttgagatgagaactctcccagggtctgtcctgtgcataataaaagcttcgattttattgcataatattctattatcatgtggatgatgtggagcaggtttgaaaggattatactcagaggtggaattaccacaaaactaatgaatcttcaagtccctgcctgcatttgcacaggcatttttcaaggccctgggaggtatactagcagtacatttgcatagtcatatgtttttataaaatttgcaaaggtaagagattttggctacaatcagttaagtttccactccaatgttctttcatgtcgaggggtttttttgtgtctgtgagtacctcattgttataatttttttttcctaaagagagctttccccaaactgattaagtttcaggtcttgctgagcatgaattcactatatttatgtttataacaaaattagaaccccagcctaggttttatctcttacaggatttttttttaattgacacataggatcctacaagtgcttcaactggaaacctatgggatttaatgattctgcttcaagagagaaggagaacaaggggccgagatagtccaggaggaaagttcctaatacatgacctcaattataagatagagggtagaatgaataggaatttgaaaatatttaacatcctatcatactaagcatgtgtagagaataaacacttttatataaaaatgaatacaggatataaaatatttagctataagtagaggatttctcagcataaaaatcttagagcccacttatcacccaagcctaaagcaattttgttaaattaaaactataaaacatactttaaatacctgcaaagttaacatgtcataacagcaactcaaaaaccattaagtgctaaggagtttgtgttattttccatttaaaggatatacatacgtttctaggacccaaatcctagcaaagtacacttcacatttctttctctacatctctagagtttcatagaagaaagtagccccaaaatgttatccctctaaaagtcttaacttccaactctttgtttctttttgacatcatggacttgtcaacatgaaattgaggatagtttgaaagcgtgacccattcattgtttaaaatggttttgtcaataatcttaaacaaaatttaacatggaaggttgtctgtaaaattctttcaatacatgaaagacagtgaagcccacattaatattctgctactcacaaaccaacaccaacttttccctaagcgtttctttggtaaacttctaagtaggattttcaaaagcctattatcaacaacaaaacatctaaggcatttaaatatccattcagcagtgcatgtcatgtgaaactgtaacatcactaattatcaattctgcaaagattttgcacttcaacacataaagtattatgctaatttatgattataagagtattcctatgtatacgtagggtgttttgtaggttgcagagattcacgtttacaacttctcctgatgctagaatgaatacagcctagtcctagccatgaaaagacatcaccaggaagggaggaaaaaacaaatactaaaatagttcaaatatcaggcataataaaagtccctttaaaaaggcacatttggagtatactacaattacccacatcagattaagggcatcatgatctgcttcacagaggaggtgacatttgaaatggtcttgacctgaggtaagagtccaaaaagaggagatagcagaagaaatgtgaagaacattctaattcctgaaaccagtaagagcaaagggaggaagagtgggaagccggagtgtttttagaaaagaacaagtgtgaattcactcatacaagattggcaaatgggagaatgattcgggtaagatgcagtggccacataggttcatacacacttcttcccagcataatcatgtttttttttctaccctataacggtagctgaatccaaagtaaaccaacatagctgaagacaccaacctcaaagtactgtgccacaacacagcctgtacacagtgtgcattcacccatatgcctgccttcagcttgatttagccaagcactctatctcggaaatgttcgtggcccacgtcttttccgtcattgtgcatttttgccccatcgctaacacttggcagtgtcagccctttcttataccccttgtcatcaaactatattcacattttccttttaaggtgaagtgatatgtatactgaaataatcctatattttttaatgttttagtgtatctttttgagctgtgctaatactttgatcaggattgttattgttttgtgagttctctaattacacacttgtgtaagtttttagcaggtcagccccaaccctattttcccataagccctgttatttgtaagaataatttttatagaactcctggtgtttgtttgtttgtttgtttgtttatttgttgctttcaggaaaacacttatcacatttgaacataaagagcaatcattcctactaaagagcaggagtgatttcatggagaagatgtaaaagtgaggctaaaagaggtagactaagaaaatgtcataaagaccttagaatgtcagttttagaaatttgcatttattcaatagtcagtagaagagataaaattgttgttatgctttagaaagagtaatctgtcaaagatatttttaaaagtgtatcttatttttctcatgcttctaaaattcacattaagattaaagtaaggggaaaaatctgctgcaagtaaaatttagttagctgagcattgaaatggtgatattttaatagacttagccccaatattcacctagaacgtagctgctccaaaatagcataattaatctatactaactttaccagacatcaaggttcaaaagagaaacaaaaggcaaattaagaagcctagcatttattaattatgaaagaataggggcttttttagtaaatgcattcagaatgaataggataactctattctattctatgtcgaaatattatagagtgtacctggaaggactcatattatttctcatcccatagtcaccaattcaaagccagacttaccttgtttctcctagtgttttctaatgaattaaatgaactggggggatctacagctctgtgtttagccactcccagtccacaactctttcccgcaggtatctccacaatcgcagtaacatcagacagataggtaggtagatagacagatacataaaaatagcctcatgtttggaaaaaatattttaaatgtattcacaagacttatcttagatattcattaattatgcatccaatattgattaaacatatattctctgtgaggcaatttgctatactaaaatctttgtcatcctacaaacatcaactggattctaggatccaagtactgtattgtatgtactagatgttttgagtttgtgcctgacataggacctagcccataatctcttagatggtctcatgaaatttacattctagtgaaggagacagaagaaaccataaaaataaatacaggcctccttaatcgtctgaatctaatttgttccagaaaaatttgttggaaggcaaatattcagagtaggatcctatatataagaaatgtaataatgtattctcagcccatccagaaaccccgcccctttgcccaaataccactaagacacccttaagcatcaatataactatctactaccaagtgcttttacaaaacataaagcacttaaaaaaactaatgacttagttattgcacacctcatgaaaggtgagaggtggtttttacttattctagcacggtggcagtagagatggagataagtggaaggaatgaagatgtatttagggtatttcctgccctacaacagcctatagtctcattgctattcagtgatgcattgaataatgacagactgaatagatatgatctgattcatgtgaaatgtctctcttctcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctggtaaagatcatatgcatagcagagtttccgtgactaaaatgcgtttgcttcttttatcagttattggtaaaatcatcagttattggtaaaattatcagttattttctaaaaagcctgggatgattgtctggcagccaagaatgggtgatacagatagtgcttatatattttcaataataactttaatcacagatacaatttaattactatttattttcaatacaactccccacataatcctttaagcaatacatccggtaataatttttcccagcatggagccatacagcagcaaaatgcttccttaatcttctttcagagacctgagttgaaaaggtgattataagtattctttggcctcatttttttctggtcagtatttcttactgaattctttctgggaacataccttttggttcacttaatatgttttcaaatgaactcacattttacgactgtaataaaaggatatgtcttagaaattttgttgtgaccatgtgcatcataatatcacagccacaaaaattcagaaaatagtaacaccaattctattttcaaaatggatttctgcaacagagtgacatattcagcaatttagccacaagaccctaacataaaccacacaagaaaagtgaacactcatatacttctctgtgtatctaaccactggggtatgtttactctattaatagagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaaggtgagtttttacagtaataatgcaatataggccttaatcatgaaatccaaagtgcacatgtacctgatcaagaggaaggctccgtctataattttagctactcacgagttcagtgaaaaatttatacagtcatttttttggcttagattataggtgatttgggttagacatgactgattgaagagccaaatgcttctctatcattttcttttgaaactgagagcttaatttgaaagcataaaactgtcttacaacttgcaaaattatatcctgtaatatgtttgaaaaatgttgggtgcttttcttttctccctattttgtcaagatgtttcctttaaagtggcccacagtggaatctataggagtggtagggcatagttatcagttctttgctcatttaaattgccaaacatttgtatgcctgcaagtaaataattgatcaatagtaacatgacatgtttatgattcggggacattttaaaacactttcacaaacattgttttatctgatcacataagcaggtattttgttccagtgttagagaaagtaaaatatacactcaaacttttatgtggtcacagacatatatataaaagatctcacaaccaagacagaaatccaagtctattaattctgagtgtagtgctattgctttttaagtatataattgctctaattctgtgtagtatggcattaccaatatctgcaaatgagactttgttacttctgctaatataaatagactcaattaatgttgccaatgccagtgtgacatttcatgaaaatttacgtttaaatttaaatttgtaccgtctttcatttctgcatttaatacatatctgccaggcaccttctaagtaccatgtaagaactaaatgaagttctaagttcttgccttcaaggaacttgcatcgaactggggagatagacaagtatcaatggttagaggatagagagctaattgctgtgatagagatgtatgtagccagcgagcaatctcagaagagagacacttgagtcaaacagagaggtcagtttccactggagtgaccctgaggcacaagctggatgaggagttagctggatgaaaagcatgtatggacatttcagagtagtgaaagttgtgtgaaagcctggagtcatcagagagaataacacatccttttccagctgcatttccaacaggaaactctagagaaacctctcatatgggacaaaaactggctttgcaattctttattttggagtgctgctgcatacattgttcctgtgtaagagaggcacaatgcacatttgcatgtcagaagctctgtgtagttagttgttcagtaagaagaatgtttagctgtttaacccagcatttcccaaatttctttaatcagagaaatccttccattcctgtaatactagcattctgctgaacacactttggggaatgctttagtaactacaagtgaatccatagcctacacgaatgaatgttggcaggaaattatcagtaggggccaagagataacagaaccagtgcataaggggacatatgagctaagtgagtgagtttcagctttatcctgaaagccatagggataccgagaactctaagagttttaagaaagggtgtgatatcataagacttgtgctttagtaaagtttctttagcagcagtttggagatatgtaacaatttaggatgctacggagtctggtgagcctagtgtctccccaccaacttctcttctatagtagtagaataacagatttgaagaaagaaggagaagatggatatgcattataaaagaaaaaaagacaacctaaatgtccatcaacagatgactgagaaaagaaaatgtggtatatatacaccacagaatactatgcagccataaaaaaagaaggaaatcatgtcttttgcagcaacaggaatggacctggaggtcattatcctaagtgacataacccagaaacagaaaatccaataccatatgttctcacttacaaggcgagaagctaaacaatggatacacgaagacgtgaagatggaaacaatagacactggggactccaaaaggggggagggaggagaaggggtgaagatttaaaaatcgcctgttgggtacagtgttcactgtgtgggtgatgggtccactagaagcccaaacttcactcttatgcaatatatccatgaaacaaaccttcatatgcaccacctggatctaaaattgtgaaataataaaaataaaaataaagacattcggaacactaagctgaattggctaatgctataaactctaaagatagtaatatgcttggtagatgtacggtataacaaacagggataaaatgattcaacaacttaggagaacaatttttataaatggtcatcttggaaacgctaatttccataatcagtctgctatctcaacttttattctatccattaaaacaaataaacaaaagatctgtgctctgaatcaatattagtcaaaggtcaagttacagaatcatataaatgtgaaagtagttaaaaatatgttttaggtttactgtaactacagcattccatcaattcagaaagttcttcccccaataggtctaatttttccagattttactagagctactaactgttactgttactactctgtggtccagaaatcagaaagaattttcctttatcccagcctactcagtatcttctgtgacatttctggtttctagttcaatccctttgacacagttggctgataccttctcatttataagtcttctccttggctttcaaattgactctagactcacattgctttttgcctttctgaatactcctgtcaaatgcaccaagcagtcattctcacttttattttgggtattaatgacatgaatcattctccttacttctctattgtatctctatggtatcaccgttaaaaagaaattaagccctatgaggtttagttgttcagaattttgattcttaaattagactgggaacttctaccttctgcccatggttgttacccattctctattatctctggtgtctcaccacaaatttctcaagttaaacaggtgaaattttttattataataaaactatagctgttctgtttttccacatgtcttctcatatatccaatatattttctctaatacttttaaagtattttattactatagcaggtcagttaatatgtattaatttttccttataaaaagaaaagcatcgaagctgcaatggaaaaagcaaatgttataaacaaataattcacaaaagaaaaatgcaaacttcttacataaagttgaaaaatgcaatctcaatagatgacaagcatatggtcattgacttgcagtagcaatatccaaagatcacacttaaagcagtaaaatctaaatttaaaaggaaaagaagaaaggcttggcaaaataaccttactacctgctttgataagattagctcttacaggacacatttattaaataccaactatgcatcagatgctgtgctgcatcagtgaagatgcatacggttcctacccttgagtaacttacctgctgcacaagtagcaaattactgtatctgtttaggatacagtaaacaccaagggagacatatggagggagagaaataaggcactaactgagccctaagtccttttttagttgagggggtaggaggggtggaagcagttgcaggcgatccaggccaaaaagcatcatatgaaaagataaacatgtataaaaacatgaattatttgggcagctgttgtaatcagtttgaattattggagtttaaatttcaaaagagtgatagaagataacgctgggcatgttggcaagggccagatcacaggaagctgtttaaactgtgttgaggagtttgcatttcatcttgatgaacttgattttaagtagagatgtgacagggtaatttcaatttaagtatattactcgaggtgtcagtgtggaagacatattgtcagaagaccaaactgaagacaaagcgaacaattggattcaataatagtctaggcaggaggtaaattatgcttgaagtaagagatgcagtgggaattgacatcaaagaaatgcagaataaatccaccatgtgataccattacacagctattagaatgactaaaattaaaaagactgaccatactcagtactggcagaaggtggagacactggaactcatacactgctgctgaggatataaagtggcataacattggaagaggttggccatttcttaaaagactaaatatacatctaccatacaaaccaatcatttcactcctaattattcacccaggacacaagaaagcatattttttatagaaagacttgtaccaaaatgctcacattacttttatctgtgttactcaaaaactgaaaacaaatcacatatccatcgacaggtaaatagatatacataaattgtggtatactcatacaatggaatactagcaataaaatactcagcaataaaaaataaagtattaatatagatacaaaatggatgaatatccaaataggcagacaaaaaaggcaaatttaggcagacacaaaaaaatacatttgtataaaattacatagaaaatgtaaactaatctatagtcacagaaagcagacggatgctacttgtgaatggtatatgtacgaaaaggcaaaaaggagggattacaaatgagcataaagaaacttctggggtgatggatgtgttcattgagtgtggtggtggttctgcaggtgtatacaattacatgttacaaacatggtttaaattatagcatgttaattattcctcagtaaaactgttttaaaaataggacagatattagaggtatttaggagaagaaattagtgaagctgttgattgattagatgtggtgaggagaaagtcaggatgactctctagtttagtagattgggtgggggggtcataagaccaacaaaaaaaagtaagttaagtaatacagatttgggagttagatgataattattttgatttggaatgtttagcttaaagtacgcaaggaaaatatagatgatggtgtctcacctgttgaatgtggacttttaggcaaaaatcaggtccaagcatacatacatttaagtcatcaatacattgtaagtagatataaacttgagtttgcccagatggctaaaacctgagatgtgggcaaaggaagggatattataaaacatcaacattttagaagtgttcaaaaatagaccccagggtaggagattgagaatgaaaggtaaaagaagccagagagcttgacattatggaagccagaagaaatttcctatagggaaggaaatgctaacagcattaaatattgcacaaacatgaattcagataaagtttaaaagaactccactgagtttgggtataggcaggtccctgaggactttagcaagaccagagatgacagagtagtgggagaggaattgaaataaggctccagcaatgtggatgattgctccttttcagtgaccagattatttgttttatatgaattattctcaactagttggcaagagcactgtctcttgaaattcaagtacagtccttcaggagtgttccccatctttcttgagtcagttacagaaccacagtccctgacagaagtgtgccctatcccctaaatgcatcaagtaggatgcaaagttgagaacactcaattagattttcagtggatcaagaaagagaacaaaagaataatagccaaagtaaaaacacttagcttataacaactcagcattgattataaaatatttcttaagtccctactctgtgtctattatttaataaaatccttatttccctacctacttataaatcacatctgaactcatcaactgtgaaattttgtgtcaatagcctacttttctattttgtaaagaaaagaaatagggtaagaaataaaagcaagcattagcatttactagcatttcctggtagaacccacttcatcgctatcactcatgaaggatagagtaaagcactccctttaagtcagtaaaaatatgccatcctgtctctctgccagttaccttttgggccagtgaatttcaattcaattgtgttgctgctctttaatcatgttttcttagaatgatttctaaaaatgcatatattcattcatggataaggaggaaaaccacctccagtcactggcttgcctgtgatagagaggcagaatctcattttcagacaccattaaaatacccaccaagtctgtagaaagagactattttcatcttccagtcaacagccccatatgaaaatacctttgccgatctagataaaaaggaatgtatatgaaaaagtcttgaaaacagttttataaatctattttcttttagcccccagtccagtcaaggagatatatgtgtatgaaactaattatgtatataaaaataataaaataggtgtgtgaaagtaattcaattttaaaatcttaacttgctagctatatttaataggacaattattcttttaggtatttttcttgtttgtttttacaaaagtctggtttgaggtgtccattggtatgtgtattttagtccttttttaataaggcaattgtgtttgattttattgaagacacatctttttgaaatgatagggctataaacttcaagggaattttggaatttgatgtttctctctgttttccaaagaacactgattctgaaagatgatgagttgagtgaaaataatagtatttcgtggtcaaataaatttgggaaatactttttgctctatgtccttctctaggaacattgcattgcatattagcatgctgaaagatctgggcagctataaaattaagaagatacatgtttaactttgtataacccagtatttgtcatatttatttgagccaggaacatccaagaaactagcatcctaaagaataaacatttagaaattcccttataacccactggttcaaatgcccattttcaaacccttgcttattcagatcctacatcagacaaaggtttagaggccaaatctatcatcttacgggactgatgtcaatacgcatcaaggatgcatatgaagtagttaaaggctagatctaaggacatgtggtagaaaagcatgtaattcagaaaaagcctagcttgacccctaagaagggggcggtagtgagagggatcaatgagataaggagttcctgtctgctttctaaacaatgcagtttgaacagagaagtgcctcatctttccttttttccatctatttctgaattcttatcttcatcacattaaaaataccttgagagacccaaaagaaaagcaagaaggcatgaggactgtacctctgtcacaacacttagcatcctggtctaaaatgtaatttacagtgtacctggatctcaccacttccttgtacaacatccccttccacttccatgtacaatcatattttacaacagtgacactttgcagatgagtctaaatcccagtagttcctgtggatagtaaaacttacagaaagagccatagattaggcatatttctaattaattatctgattcctaattagatatctttgttatttagcatttttaaccttgctttattttctaactacttatctagattatagaaaactacatcaaatggatctttgatgttcagttatagttatctcttttatcttcattggtttgccttcactggtgttcaagctattattttcatgctctttgggggatagtttaataatgtattttattgatgttatttctgtaattattaaattgctaaatatagtgcaagtgcttgagaaagtcaatgttaattctcgaattaaaccaaatttgtcttgaagtattaatgatgatatagatgtggttgatattgctcaaataaaatgttaaactttctttctcctttacagccaatatatcaattgtagatatagatactaatcaggaggagaatatagcaacttcgtcttctggaaacaactttggtcttgacttgaaagcagatgacaaaatatattttggtggcctgccaacgctgagaaacttgaggtaatttagtttatatgtaaagctaaggattaagttttaattaaatgaccactatgctcactagagttctgaagtttaattacaataagaatgtcatataacccttggttgcagaaaggcctaatcaaaaacatcatgttgcatgttagaacaacaccaggatttagaaaccaaaggactaatttgacatctttgttgaagagatggattggagtcgctgtttcctttatatgcacctgctgaaaagaattatgaaagtaattaaaggtagaagccagagttgaatgtggatcttgtaattgctgttctccttctacattcactggagataatggcactctgacattgcttagtgttccgaaaattagtcagtgttccaggatgctatgagtataacctattttattgctaagcattagcatcataatggcgtgttggagctttcccatatgcctaatacaagaactatattagttgttctcatgcccatgccaacatttttttttaatttcacatatgctttttagctagcagtatggggagacacatttgcttcctaatttagttagttcaaaaaataaagtaactaaaaaatgtcagaaaatactcacgtgctgtgtagttaatttactgctcattataaaacataacatagtctataaggatggtacttggtgctcaataaatgttaattacactctaattagaatgggattaattgatttggttaaaccgtaagagtttattacagactaccatgtttttaattttttgttttgtttaattagtttggtattttttaaagggtataaaagttctgtccaggtgtttctactccaaaaagacagattatgtttggaaaaatcccagaatagctgaaaagtgtgatggtcagttattttcacatttctaaacgagcagtgaaagttcagtctcattctatgacagctagtgtgcaggctgaaatttcttctccccaaatctaaactcatagatgaagcaactgtctaattatctgatgagcttcatggtgcaaataaattggctctgcattcattgtaatgtatttgtgttagaaaaataaatttaaagtgtcaagtcagaaaaacattacaaatcaaatttaaatagtaccacagttattacctagaaattcatttgccagtcattcaccaaaagtttgttgagtatctactatgtgacaggctccataccaaatactaggaatccagtggttgttcaaatctaagatttgctttacaagatcattaaccatatattattgagtgaattaaatacagccaaacctaaggttattcaaatctagcttcatttattctagtgatgattttaattatcataaaataatttttaggaattatctataaaggtgtgcctgttaaattctataaaatctgttaaaatctgaatctgttaaatgaatctttatcactaaaatgtttttactttcatgatacagcattgcataattacagtatactatttccatggtgtggcacattatttcaaaacagccattagaggtatatttgtgattgataaaggaaccaaacattcatagttacctgttattttgcctgcagacaggttctcagtatgacaaagtgcaaaagatgtggtaaacataaattatttttacatgcattgttaagctcaagctgtttgagaggcaatatttataagccattcatgaacactacagaatagtgacattgtacattttcccatttattagattgataagaacaagtactttaaattcatatttcaaagtaaaaattttccaagctgatattgtgagctacggtcatattttgattctaatttcactgccgtcaagggtataagtctatttttagttctattggggcttttgcatttctttcctttgtagatccctgtgaaatgattttttaaagatttatgattaaagtttattgttttactaaatgaaaatgtaattataagtaaattgtttttatttttgttttttttttcctctttcccgttatctagtatgaaagcaaggtaaaatttaaatttatgcatgccttcttcgagtgcatgggttgggtaaatgtggcttcttagataaagcagccgtgcagaagcagagcaacaccagtacagctttgttcatagtatgtttcacgagcaagccgtgcattctgtgagagttctcctgctgccccttgctggccgacattctgctgcttacccaccatcagttgggctgcaatttgagttgtctcaccagcagtgatgagatttgctctgctcacttgttcaaccatctgcacacagtgcccctggtgaccagcagcacacactcaaaaggcagctggtcaatttctggtacacagtctagttctgggaaacacggtaaagtggtctcttgagttgaaccccgggccctggcctccctagtgccatgctgtctgctgaagaatcaaactgtgctctcacatgcttaccactgccttcttgctttttgcaggcctgcagatatgcaaacatttacacagcctttgcacctcttgtcaaagctgtttatctattgacatgtttatttaaaactagctatggtgccagatgaaggaatctctggaaatactatatttaaaataagtatttgcgttaatagtaaagaagtgtgagatagttctcctagcttctcaggagcattttaattcttactagcattagcataaaagctgtgagcaatgggcctccataaatggctgaacaaacctcagagatgtgcagggctggtatcctctggctagagctaaaagcctggtgttttggcatttcagagcccagctgtgccagatttctggaaagaagataataaagccgaactgatccaagaaatttttaaaaccgaggctagatttttaataagagaaatagaatatacagaaatgaaagtagggaaaaataaaccatgcgttttatcatgatacagttgtaagaccactagttgtgctacatttgctgagatggctaaaaagcgaaggctggctttcatggaaatatatgttaataaaattctgggatggcactgtgtaggtttgtaattttgcctttgagtggtgaccctcaagaaacagggacccgtggttaccattgagtccagtcaccttatgtgactatttatcccctgtaattgtcctaatattgaggttgctaaatcatattttggaatggttctttgtgtttccatgaaacaataaactatataacttgtaggagtgatttactttagtaacaagacctctgaaaaaaatggtgataagtcagtctttccataaaggaaaatatggaagcaagtgaacactgttaatgaaattcaccttctctgtgcattatgcaagaaaaatataagcagaattctcaccctacagttgggcatgttctttataacaaccagctgactgactgaacgaaaagaaaaccttgggaacaaggaaaaattatcaatgaaaataaagaagttccagaaaggagtgcgggggtggaaacagacagacacctgacatgaaataaatcacctgatatacactgccaaggtctaatttgtttttccacctgtttttcctcatgccatgtgtttttcattaagataaaaaaaggaacttggcatcatgggacaatgaggagagaattaatcatcaccctatcaactacaatatattgatgccgactggacagtttttaccgatgctgattaccaccacataaagaattatctttttcacttctatataccttcactattcaaaatagtagccacaagtcacagtagctatttaattgtaaattaaatcaaattaaataacaataaatattcagtttctcattgagacaagctacatttcaagtcctaatagccacatgtggctagtaactactgatttggacagtgcagaaaacagacaatatccatcatcacaggaagttctgtggaatagcactgttataattaaagaagtatcatcatcactgacattctgatagcctttgtttgttgagcacttactgtgtgcagtgctattccttaatttattaaacctttgcaatttgattatgtaggtactatgattattattatcatgcccatttcacatataagaacactgagtcttggagaacttagatcacttgcaacatctggactcaagggcaaggacttcatttcctaatctgctggcacacttgccccattttatgaagtagtatgcaaaagtaaacattcaagtgtagtttgagtataaaagtcatttttcaattttattgaaaaaataaaatgtatgggtttttgcatttggttgctttattttgttattgttctaatgtagaatacagactttggggtcaatctgtaaactaaattaatctgttaaaaaaaaacatttttttattttgagacagggatctcactctgtagcccaggctggagtgcagtggcacaaccataattcactgcagccttggcctcctgggctcaaaagatcctctctcctcagcatctccaagtaactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaaacatctgttttttagactatataatccaaaagaatgtttcttggactttgttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttctctttggtgaaaaaaataaaacttatttcattacacatataaagcatcaataagaagtcagttaattcctgtacctcatgtttaaatgctgtgggtgagattattgctaaaggggagaaggactacaaaaagactccttctgcaggataacatgaacatccatttagaccaaccagtagacaatggaaaccagagtttgctgggtacacgtgtgcacagtttgatagacatgtgcctgcatgtgtctgctccacaaggcttccttcccatagtcagagactacactaccatcaccctaatgatattgcttttgcttttcatttgactattcaataggccagaagtaaatctgaagaaatattccggctgcctcaaagatattgaaatttcaagaactccgtacaatatactcagtagtcccgattatgttggtgttaccaaaggatgttccctggaggttggtctgtttttgatagttctctaaacacatttatatcagatttcacttacttagtgtggctgctcctacaaggatcagtcttttgttaatatattttacttttctactgatcctactcttaaacgataaagcaagattaaagcattctctaaattaccatgataaaaaatggtattatgaagtcctagaattgtgatccaattttccaaatgtatagctctttatagcacatatcattaatactaatctcttttctgtttttctctttttttccaacactacttttcccttttccttatttttgtcatccattttaaatttattttacttttatgtgttgtatatagctttattagcaaccttacattttttctggaaccattgaagtttacacaagtagcaagtagtaatttacaccgtagccattagtgcatagtctgttgtctacaaacttgaagtctagcccccttgtctttgaaataacatagactgggacctgtggcaatcaactctgcaaagacttgtgtttgacatgcctgcaaagtcctttgttagctgatatcctcagtaactcttctttgatgctaaagcatcctagcattcccctattttcgtttaactattttgcactgtttcttcagttgacactgacccatatgtgagaaagaccccggccatagctctactctcttaaaatatccataagcaagagtcaatagtcaacagcaaatattagcaagaattttatagaaactcaatagtgatcagcttgtttttaaaatgaaaacgttaaatatgtcattctcatacatttttaattatcctatcataatacaattattcattttgtctgctgcttctaatcaaaattatcttaaaccactccaatagaattagggaaatgaagggaaaatgtgggtaaagaaaaaagtaaatccaccacttgaatgatgaggtttaaagactggaacagaactttcaggatcttcattgttcatagctacaggctccaatttggaattggccatagacacccactctgagaagtttgggaataagaaaagagaaaacacattaagaactaaaactgtaaggacccatactggcttcttaaaggaagttttactgagaattttaatcttcaaagcctaactctcattcacattcaaaagatatatacatgaggatggaaactgtccggaaaatgaatagcctctgcacgtggaaattatgattccctaaaggcactttgcagtaaccaggaattattttgcaactaaaatatgaggcagaaatttgatgtggataaatattgaaaagtctgcacagtagttttatctgaactatctaaaactccatgatttgaaaattggaatagaaaacagattatacattttaccagctcttgtgtcatttaactggtcttgaaacactgtgggaggaaaatagcctacattaaaggattctttgcttttactcctacaaaatctaggactttaaaaatgaatattttaagcactttaaattcctaactacatgggcttgcttaaataaatactagcaaattcataaagtagaaagtcctcctgccattaaaagtgactatctacatttactgagagagtgatatcttccacatatgtaagaaaaaaaagtcattaggaatgaacatgtctatcaagattcattttaaatacagggaggaggagagaggaagatggcaaggttgtgaaagagtgaatgaatgaatgaatgaatgaattatagaaagctatatgcttctgcacagctttgagattgagatggggagctgattttctcccttttgcaccttatttacatttctacttgaaatgtaactgttttaattttatactgagcaaggacaatggtattactttaatattgagaaaaaactagactatgcgatgtttgttttatttatttttaaggtttggtcttatcactggggaaaaatgcagacacagataatggtcatacccatctgtaaaacataaacaattaagtgatagagtttattcaagagatattcgttacagtgttttcaaaggaaacttagggacaatctccctagacatgtacctgcttgtgtgtcagtttgacttaaatctttggtttaaacaacaacaacaaaaaaaggtacctaacagtgataatcttctatatttaaaatcaaaagctctagaataaaagtagaggctataattctgattttaacaaaaactgctcagaagatttgaagttatcatataactagaaataatatttcttcaactgctcttaaactttccatgttttcctgctttctaaacctatgatgtatttcataatcacattaattgcatcgaggagggtgagtgagatggagaacttatttaaattttcatttctaatggtttctactcttcttttcctttactcacagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggtaccctcacacctagctgataatgcattttccctaatgcttatataaagcagttaacttacttttgtatttttagtttcgtatcatttatttctgctctcatcttggctagcaaggactgaacattccatatttccatgctggcctcctatttcactcacatcatctccccaggacaattgtcttctctaggatgttcctgttgatcaattgtaggtgcaaagtcaccctcatatttgcacctatatttcctatgggtttaacatatgcatatgtaaagaggacagcttaaaatatattcacattatcttaatttctactgtctccaagtccgactccttaccaaatctgtagacagtcagcttcggtcccttaaatttaaatgtaaattcctctaagatcattttcccagttgcacaagctgaagtaatagtcttttgggcctgactcatcccatcctctctggacacaaagaagggcagaaaatggatctgggagaaagcaagtagaacacaaccaacacagacagggacaattttatcccaatagcattcaaggatgttaaagcctaaagaatgtcaaccagccgggtgtagtggcccatgtctgtaatcccagcactttggcaggtcaaagcaggaggatcgtttgagcccaggagtttgaaactaggctaggcagcatgataagaccctttctctacaaaaaatgtttaaaaattaaatgggcatggtcgtgcacaactgtgattccagctattcaggactgctattcagctgttcacgccaccacactctagcctggatgacagagtgagactctgtctcaaaactttttttaaaaaagagtatcaattttgcaaggacataaactttagtatctatatcccctgtccatttgattctgttaaaagcaatccctcaactgcccagatttaagcatcatacctcttattgccttggtattctttaatatcttcaatcacattttttaaaacgtaattttccatttaatctagtttttctcaatgaaagggttcataggaattattttgtctgccatgaccaaaagaacacaatgctttacaaatatatccttaagtatgcacatacccttgtaaaccagatcatgttatttgtgattacgtgttttaaaaatcaattttagtatgtaacatttagtgatcaatcatattatgtaacaaatcttatttatttttctaaaaaatacaaagcccacacaaaatattcacaaagagaacccaaagatgtataaccacgagtaacttggattatttcaggaatgcagaagtggtttaatgttagaaaatcaaaatatcagccaggcacagtggctcacgcctgtaatcccagcactttgggaggccaaggtgggtagatcacaaggtcaggatttcgagaccagcctggccaacatagtgaaatcctgtctaatttgtatactaaaaatacaaaaaattagccaggcatggtagcaggtgcctataatcccagttacttgggaggctgaggcaggagaattgcttgaacctgggaggccgaggttgcagtgagccgagattgtgccattgcactccagcctgcgcgacaatgtgagactccgactcgaaaaaaaaaaaaaaagaaaaagaaaaaaaagaaaatctaaaaataatataatcttgtcaatagatagtaaaaacatttggtaaaatttaacagtcattcatgatttttaaaaaatacttaagtaaactaagaggaaggaacttccttagccatctataaaaaaaaaactataacaagtattcctgatttaaaaaaaagacattataaacatttgctataaaatcaagcccaagaaacagatgactattttgactgcactgatcttagctagcatagtaagaaaagaacaagtaaatatagcacaagaacaagaataagaacaaatatataatttaagaatcattataacaaaatagacataaagcccatatggagaaaattataaaatttcattgaatgataccaaagtatttctcaatgattatagtcaataaattggtatagtcaacatgttaatgaagatattaaagactcaatattaaaaatatgtcatttctccccaaaatgatatgtagattcaattataataaaaatatcaccttatttttctgtgaatcatgacagcttattctaaaatttatatcaaagatgaaattcctagaatagaagaatagcgtagttggggctgttccaccagatatcagcacattagaaggtaaagttttgtattgtggagctatcatgttaattcatgtataactgtgcaaataggaaagaattgagaaccctgaaaatacacaagcatagatggaaacagcatttgacaataagtggcattgcatttcatttaaaaaagacaacagtgaactgttcagtgaatgatttcagggcaattggttattcatatggaaaagatgaaactaaatttctttttcatatcaaaccaaaaaataaattcacaataaattaaagtcttaaatatggaaggacaaaaatctttaaaattcttagaagaaaatataccaggattaaattttgaccttcgggaaaagaacacttgattgaacaaaacaagattatgagtggaactgcattaaaattaaactctttggtcatcaaacaacacaaaacacaagcctcagtctggaaatgtacagtatatataatctacagggaatacagtccttgtccccaaaaggggaaaagctcactgcagtttataatgggatatcgaaaccatactggttgttatagtattagaaagaacagtattggaaagatgtgaatcaaagagtgcccttgatcactgctggtagaaaaagtaaatttctaaagtcactttggaaaacaatttggcactatctcctgaagttgaacatgtgcatactctctacaagccagcaattccactcctgggtacagacccagatttttgcacatgggcataataagacatgtacaagaatgtttatagaagtattctttataatagcagagaaactagaaacaacccaagtgttcatcagctggagaacagagaggcaaactgtggcacttttgcataatgggatatcaaggaataagaaaaaggaataaattataactaaatataacaacataataaatagaaaataaataaaaatgaaaaatgtgctatatggtaccatttttgtagatttctcatacaagtagcactaaacaacatattgtttacagacacatgtgaatttcaaaaatattttttaaaagtaaggtaatgataaacataaaatccacatttgtggttacctctgagatggagaagcaaggagatggtattagaaagaaactcataagagatgcaatggtattgtttctgaaatttggtggtagatttacaggtattcatgttattatacagtgttaacgcagcttcatcgtttacatgtatatcactcatattgtgaagaatatatcaaatagtcgtaataaaaatatttttgaagagtagagggagaaaagtgttattttatttcatttcttactacacataataagcactaaataaatataaaatacaaatgccctcgtcaatttttttgtttatcttgaaaaataaacttttttctcatattgcaaatgataagctagttataataagaataccagatcaaatattctgaaatagatttccactaaaggatacttgattccttcatcattgccagatatttaaacactacctactggctccaaatttctcctcttcaagataaaagaaatgaatgtgaatcaccagctttcaggatagtgcttaaaataaaacagattcctattaaaacaattacaataagaaaacactatgtagtatagtataaagtaagttaaaatgacattttaatgttttaacattttaataactcatatctactttataaaatatcatagtatatgctatctgaaggaggaaccaatgttaaatagtataagtctgttagacataattagatttagattcagtgctggttaaattgacaagttttatatttcaaagctaacggttttgatacccatagagttatttgtgattcctttctgctaaatgggtttgatatggcaaaccatccatgagctaaggaatttttaattgagtagtttgtgttttccctttgacagatggtgagcacttatccagatcctcaaaatgttctgtggtggacacgtaactacatacatgatttagtaaattattggaacatgatgatgtttgatggaatctgtctctaccaccatagatgactcatggagaactgagccatcactgtgtggcaggtgcccccatactccacaagaaagggagagcacgtggcatcagctctagggacaaggactgcattcaggctccctggggttcatgatgggatatcaaaaccacactggttgctatagtaacagtagcaagaagaaagcaggcatgcttgtggatgaaaaattatcttccttctttctaaatgtgggaggcaggttacatgtttgtgatagcgatctattctaccagctcagagaacaaattgaagtctaaatactcagaatgccacaaggttgggagtcaggcctgattctcagaagctagctgtccacttgtgaatataagggagagggattttgttgacaccctttgtctcctgatgggttttataagttagaggaccaacgcaagcacagctgttactttcagcatcacaaatctgctttgcagagaactgctatattaatatatccactttccagatcatctcacaagcaaaaatggtaaatgattagaaagatatttccagctgttttcaaaaccgtttgagaaaataaagtcttaatttctcaggtaagatctcagagcagacgaacctgtggttctgccagggaatctctaaagctaagccataaatgagacttctgtttaatcttcaataaccacttgctgttgcaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagagggtaacaatagcactaaaatatttattattgtaactcaggtgaacttcctttgctagcatcggtatctatcagtatctgcctgaacctctgtgtgtgtggacctactatgcattgcaaaaggataccgtagcttaattccctcttctttacttttcatacttcgggaacctcatttgcctcagcccttaggagttctacccttaacatttttattcgtgcagttatctccacctttggaaaaaccaaatgcattttctgaagctataaataagaaaaatccctccctctgcccctcttaaatattacctcctcaaataaggtatgcacacagcaaaactcacaaatcagctccactggagccagcaggctttggcggtttctatctcattcaggttccaaagcagttatggcagctgcttagctgtcacagatacagagtgtggcagcagctgcaggacctattgagcctattaagtgcatatcttgtccctgtcccccttcccaaggtttgcagggtccctgcagagtggctttctgagggaacagaatcaagggaggggaggaaaatgactgctgccctgagcctggccacctttttacaaatctaccagagtgcttgccccagccctgggccagggaattggctttactcatgcacaaactgatgactttctttagaatgctgcaatactttatacttactttattaggaaagtcatctgtatttttcatcaaaatattgtatgacaactcagagagataattagtttagaaggacaattagagaaaaaagaaacagaagcccagagacttcaggggttcagacctccaagccagcaatccatttatcagactgaagacatagaaaagaactggaaatccaatttgatgaggcctcaaaacacagaggatacttttaaatgcaacgagtatgaatatgtagcagtagttcagccaagccaatactatcctgcagtgaaagacctacatttactaattatcctcttggggaaaacatttagataagcaataaagatttcttaccttctaagtaaacaacaaagctttcctcagtttttattattattattattaggtagaggattaggctgtaggatgaattgatacaaagcgttcatgcagaatggctactgagacgtttagaaaccatgatcgagacaaatgagggatcatttatttggacaaactgagaacttttactaatctaacagccagatattgtagtcatggtctctgaggagaaatgcaaactgaatgctctcatttgaatcttagaatgctttagaatcctggtttcacatgtcttctagattagatgttaggccctttgacaaactttaatccttttcattgcggaaaggactttttaaaagatttaaactttagccgggcgtggtggctcacacctgtaatcccagcactttgggaggccaaggcaggtggatcatgaggtcaggagttcgagaccagcctggccaatatggtgaaaccccgtctctactaaaaatgcaaaaacattagccagacatggtggtaggcgcctgtaatcacagctactctggaggctgaggcaggagaaatgcttaaaccagggggacagaggtttcagtgagccgagatcgcaccactgcactccagcctgggcaacagagcaagactccaactcggaaaaaacaaaacaaaacaaaaacatttaaactttaaggaatttcaataagtaactgcagatttgagaaattagtttaccgaaatcactcaaaatgtgttattttgttgagaaagaattctggaattcccaaatgcattacactattgtaccactatgccactatgtccttttaacaggtgcttcttcaagaagggcattttattatgccaacttcacagctgttgaccatcaatccaacctttatttgattaagctcagtatatagtacatcactggaaaccagtcatttagttaattggccatataaacgaacagttttgccattcattgttaattacaggataatatatgacatattagtgtgtagtcactgaactctgtgccaaaacagtaatacatttgctaccataatggctcattcggcactctaaggttaaaatgcaatctactctataagcaagtgccacattaaactgattgaccagagatcgcaagtgaccatgagaacttcacccagaaaaaatttttaatgctttatatgcctattctatggcatgatttgtgtcacatactagacaaagatgatttgttttcattgttctgaatgtatgtgagatctgtaataacatcctttcatcacagatgagaaaatattaactaacctgcccaaaatcatgtactacaaataacaggaccaggtattaaatgagatgatatatttgacttaaatacctccatctatgcacagccaatagattattcttacatttttgtgtgaccataaaggtttatattactaaatgttgattatgatgtatgattattaatttggagatatttgcattatcccaacacttttcagattttcagactatgcatgtcagtcatcatttcttttcctaaaatcctggacaaaatgatagctttaataccgcctcacaaaataattggattttcaccaaactgggggccaagcttctcaagaagctccttctcccttgtcctctgcctctctttactcctcctccctcattctctctcccttccaccccttcatctggaaaaatctccctttagtcactttggtatctaatttcttggcactccagtgacctctgcctcctatatctgctttgtcctctgatccttctcctggcatccgccttggtggccagcagttcttactggacaaaaacatcaaaccctaagagcctgaagtagttacttaagcaaataggacaagcaactgaactgagtttttcttctgggaaagctttcttcacacaggtacagaaataggctaaaggtcaggaagtagggtgagatattttaggagtcatttggggtttccagaatgagataaagattttaacactgaaccctaaatattttctttcttaacatccaaagtatgttcaaacagaaaaaagattagattctatttattatgtaaattacaaacattaggacacatttctcttaatatcttcttccacgtatgcaatccaactgatatggttttaaaaaaaatcttaaacccacattccaaacaaataagaaatagggtataagtaatcaagtaattatgaaactctaagaatcagccactgaaactgtaaaaaaaaaaaataaagctgacctattacaatactaaagtaatacaaagtttaatgtacctttttgcacatagcaggcctcagtaaaaagctgttaaataaatactttttaaaaatggaaaacacaccagaatcataatggacatattggcaatgtccttctcaataaaaactaaagaaatgatctagatttgatgttcctaaaaggtaaaataggagcaggatttagctgtagttttctagcaatgccctttttaagtaatacagcctcagggcaatcccttaattaatattttccgctgtttgaagtaggtatttttatctccatcttataaatgaatgaaatggacctgagcatgattaaataacttgcccaaggtcacacagctagtaagcttccacactagtacttaattccagtatgttcctcctgaaagcccacactcattctccatcaccaccctgtgaattggtttaaaaaaaataagggtcactatgatggtccttgtggcagaaccacactacagagagaggctacaccagaaagaggaaggcctctagctttttaaaattctaatcaagaacagagatttactctccttggacaatctttaacagaggcttatatccttcattaaaaccttagaagccctgtgatatcatgttgctaagaagaggctgctttcagctaaaggggaaaaagagtgtaggggaggggcttctcagtgagtcacacatacccggaagtgagtggttttctgaaattctcgtctcaggaaaccaccgacactcttagcaaggaagctgaacctcctgggttttgccaacacatttttccatagtttggtaaagaaagaaacctcaaaagtatgtcatttccccctattttctctttgaaactaaattttaccggtcccttcttcacccccttaacagtgacgtttttgagccacagcgaaatccattttttgtccctttctcttacttttgaattatcttacttgtaaagtgccaattcagagcatctttaccctggcttattgttttttccagttctacatgtggttttacttctttataaagtcaagtaagagggtactttaggactgaggtttccatccaagtactccggttttctctccagatatgaagtaagttttcagtaatccattcatgatccccaggctagtgactaatgcttatgactaatagcaccatgatgactgttaagaccgaaactcaaaacttgcttccggaacaaaagagaaaatgcctttggtcattttcatcagaactctttgtctccttctgattcttggcccagggatccaaggattgttgtaaataagtagcatgaggttctcaattagcagtgtgtgagttctctctcataagcaaattaggaaaattaatgaaacagccactaaggaaaatcattgcaaggaacaattagcagggtgtccttgcctgcctcttctattcaaaagccatcagctacattctttataaaaggtgctttaagtgtttgctgttgattcctgcaatctaagctctcaggagcatggtttgttccctagcaagaagataatagccagcacaacccaaggaagaccccatgctttgctaaacctgccaacccttatacggttagacattactgcacactgcagaagcctcagttctcacaggctcatgtgttgggctgcacagcgctgttgtcagctctacaagaggctaatgttgcagtgcgccatgacctggtttcagtaaactttcaggaagagtgaacgagggagtcatggaacgagatcctgagaacagcgtttgcttagtgtagaattcctaagcatccaattttggctcccttaaaagctatggttgagaggggtgaagggtggcaggaaagaatttgatttccaactgtattgaatcagatgtgacttatacttgtttatttttaatattttatcagcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtgtaagtggatctcctcattactactactaattttttatttttatttcttgctattaggggtcccaatgcatctacattgtctacagctatgcaggggaggagggaaacaatgaggatcttcaacttagactgagaaaagcacactaatggacttaaaaaggcatgcggggattgggcttaattgtaaggaagcaaaaaaacgaaaataaaaaaatcttatttattacattctattagccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatgtaagtgtttatattatccccattgctttctaatttttacccagtattctgagtcatttcagaaggaagattattcaggatatctagtacactctgatattagaattgaaagaaatataacctatctaaacctattcttacatcttcattgaatgacttacctatatttccatcttcaattttgtttacaaaacagtacattttcagttgaaatgttggaaaacacagaaatatccagaatcatgaataaaagacacttataataccatgacagaggcaaccatgttggtttccaggcccttttatctgcatagtagatgtcctaccttgtatacaatttggtgtcctgtttttagaaactagtaatacaccactaaaactgtttctaggccaggcgcggtggctcacgcctgtaatcctagcactttgggaggccaaggcaggcagattgcctgagctcaggagttcgagaccagcctgggcaaccacggtgaaaccccgtctcttctaaaatacaaaaaaatagcctggcatggcggtgtgcacctgtagtcccagctactcagtaggctgaggcaggagaatcgcttgaacccaggaggcggaggttgcagtgagccgagatcacgccactgtactccagcctgggcaacagagcgagactccatctccaaaaaataaaaataaataaataaataaaaactgtatctaaacatcatataaatgtgtatgtctaatatgattttatgttaagtatatatacacacagagacacacaactattttatagtattggaggtcatatagccttgattagagcatgggctcaagtcagactgctggtattcaaatcccagcactgtaaccgaccatctgtgtgaatttgggaaagctacctgtccaatctatttctcagtttcccatccaagtactaaccgggcccaaccctgcttagcttttgagatcagaaaagatcggatgctttcagggtgatttggccatagactatttctgtttcctcatctgtcaaatgaggatattaacagcacagacatcaaagactttgtatcagagttttaaaagataatgtttgttcaatgactcacatatactgaacgtttaataaatggcataagtactatgtagtaatgataataatgagtactttcaccagcccagggctaaacaattttcattcaatattatatgtaattctcataacggctctgtaaaatatagtctttctacttttagtcgagttaataagaattagctatcttaagcaaccaacccactcacaccactagtaaaaggcagagtaagaattttattctagcgagtcagactccaaagtctgactccttatctctggaacactctgcctttccaatttattctacttttaatagaccatggtaggctattgagagtgtttccagtttttcactattagaaactatactctgatgagctcctctatgcatcaagctttttcattatttccagttattcttaaaatagataagtagttaggaaattataaggccaaaagatgaatatgtctaaggttttcaatacacatacctgaattgtttcttccacaggctatgccaatttacattcttatcaccaatacaacaaagatggtcacagtcactacactctttacagctcatgtgttgtggttatattccataccagtaatgggtgggcaatgttgtcttgagtgcagatcttgaaaactcttgaatatctcattctcttccttagtgtccacgatggaattggttgagcaatgtgctccttgcactagaaatagttattcaatgagaggccagataaccatcattcaagaaaactggttatttactccaagcatcctttcatcctttgtaaaatagagatatttcatctatcttgcctacaacatagagttatgaaaaatcaaatgggataatgtatgcggaagttatctgaaaactggaaaaagcatacccacatagacactctgaggaatccctgcatttagtgaataactactatgtgtccagtactctgccaggcatttcatatctgttatttcattttattcccaccctattgttttatttacatttatttatattgccagaagtattatatttcacaaaggaaaatacctaagatcacacagctagcaagtggaaagctgtcagtcatggggggttagttccaggagttgatttcatcctaaagcattcctgagatctgccacatggatttcagaatgtttcctcagctctttcataattcagccacaggttagatctttgcttagcaaaggtaaggttaatgatcctcctcttcaccctcatatacctgaaaatcatgtgtttctcagactcataaacatgttttcagttgaagaattagaaaacatcatgagttgaataaacttttttgaccttggatcctaatgtccacttataaaaatgtttctaggagaaaacagcctaatttctaaatgactaacttaaaattataaactaaaattggcaagagccctaaagatcatctggtccaatcaccatcttaatgcatgggttccttttacatgatacttacagcctttgcttgaacatttcattgacaagattttccagtgttatgacaaggcaggctcgagttgttagaaagccatcggttacattaagttaaaactgagtccctaaaacttctatgtaatgattgtatttctataggcaaacacattacatttatgtgtcctctgtctaacatcccttcaataatttgaaaatagctaagtcttctccttccctaggctaaccatttccctagcttaggtattctttgtattatctcatttctaattactatcccctccatgatcagtattcttaaatttgaaatattcccttcataatatggcacctactgctcaaaaggaagtcaccagctcaggggacagtgtgacccctccctcccttaattgttaccatatttctattaatgcacctaagaatgttttaatgtttttaatagatatatcatgctactaattccaaatcgggtaccatattcaatcaagcagaacctcatggaccttcttctctaccactagaacatcctccaggcaggtctctcagcctgtgctggtttggatttttagggataaccctgccagcctccatggatcaccttacttttctaagtacttacacaaactgcattttatagggcctctcaagcacatttttctgtggtatttagagatcacactttttccttttttctcaaaataaagatacttgcccatctgggaatggagatttttactcatttaaggttcttttttttttttataaccttctgttctaatttcgatttccatttcctctcagcagtgtatgttttaacttttccgaaaacagagcattccacttagtagatgagacagaagcaaaaagttgagtagcatgccaaattggttggtttagaaagaatcacagaacattagagctagaagacaccctaaagattccaactcttaacttgcacatgaggaaagaaagccctcaaacttacagcatggcccagggggttacacacatgagcgatagttggcactaaaacccagatatctaaattccaactgctatttcaccttctttttgtttgtttgtttgtttgtctgttttttgagatggagtttcactcttgctacccaggctggagtgtaatgtcacaatctcgtctcactgcaacctccacctcctgggttcaagcaattctcctgcttcagcctcccgagtagctgggattacgggcatgcaccaccactcttggctaattttgtatttttagtagagacgggatttctccatgttggtcaggctggtctcgaactgccaacttcaggtggtctgcccacctcagcctcccaaagtgctgggattacaggcatgagacactgcgcccggcctatttccccttcttttgcacattataattagttatgactgtgtggtcagaattagattttttagaactttccatctctattaattgtattatattttagaaatcagatcatgaagccacacatatcttctgttttaatttgtttcctttcttatgttctttttgtgtgtgtagggggaaaagggtgtcttctttttaaaggttactaaaagttaaaagttttacagtttattttgtaacaaatatttattaagcacctactaagtgcaaagatgaatacgatattatcattgctagtcagagaaaaagagggagagttgctttttctgccatagccctcccacttttattccatgaattctggcaggttacttgtcccttctaaatgtaaaataattaatggacaaataaggataataatatcttccttctaggattactattatgagggaataagttatacattttatgcaaagcacctagcaccatgcttggctcaaagtaacattccatctctctatttattcttttgttagtttaactttaacttctgtgtttctttaacttaattattctagttagtttaacttttcacatttttagggtgggtggcaggtgctggaaaaaaagggatgtggtgagtattcaatttttaagcaattccaaacccttttattggtttgatatgtaatgatgatatatacattgtaatgatgtggttattaaataagtcctctataattttcacttctcaccattttccatttttgtatcagaatttagattctttattttttttttcttgctctgtcacccaggctggtgtgcagtggcgcaatcatggcttactgcagccttaacctcccaggctcaggcgatcctcatgcctcagcctcctgagtagctgggactgcaggtgcattccaccatgcccggctaatttttgtatttttaatagagatgggatttcaccatgttggccaggctggtctcgaactcttgggaagtgatccacctgcctcagcctgccaaagtgttgagattacaggcataagccaccacgcctggcccagaatttagctttttaagagttgttatttaagaactaagacttaaaagttaactcctgaagtgagaactgcctatttatgagctccatatttgtgctagcacagttgacagaaaagatctattctcagtgcccttctttttcttctttacacccatcacacccaatcctgccagcaacttacagcatgaggacaacattcactatactacagggcaatgtaagggtgtcttgagaaagccctgccttgtgaaatggattatgtcaatcttatgattaattcatgttgaacacgctagattaaagagcatttcatgcatattatctcatttgatattatggtagcttgtcttctctttatacttctctcttattctttagcccatcgagagctagagaaaacatttctacatgttctatttgtggatatttttcatggaggatggcaggaggtagaggtagataagaggctgaacttcaagtattacagaaatttgttgacatgtggaaacgtgacaagttctctgcaagtatgtgcactgtttagaccaagtctttttaacaaggatagcctgtgtggatttgtagataatgagctggctgcattcttttacttgaattttattgaagagttcagccgtaaacctcacagtttaaaatgtgaaaactaagaaaaacaatacaagtagccatggagaattcctgtactgatgagctctctttgggatttggggaaaagaagtgagcacagaaggaaagaatagaggaaaggaaagcgatttccctagcagctttagtgctacacctttaagacctaagtacagtcaaggccaaaggataaactgattggatactgatatgtatttaaagagaaaacatacattttccacttatcaaggaatccttgtttagacattaatgtataaatattactgtaaatgcccaagacccaccaaaagagcttaagtgcagtgttaacaataattcagtttctcaataaacatcttgagtagggcttttatattttagaagaagattaaagtcagtgctataaaaagtatcttccacttattcatccataaagaaaatcatgacaaataagcaccagatgtgattttagcccacatttattagagaaattaattattgactcatgaaagaagaaaattatgcaatttctatgatgattcattgtttggtgctttcaagaacaaagatgccagttttgataaatgtaatataaatctctgctcaggacccaggaaattcaagagatgcttatcaacgaatcatacgcactcctgaatctaagaactcatttccaaatgtcagccaccaatctgcagttagttagaaaagaccattgctttattctgacctgaagttaaatgagtgacagtgtgggggtgaaaacgttttggccccgttaccaatttggtgcactatctacttccctaaacaaggctttgggagcatggcttcctccataattattcccaaccacatcactgctctaatcaacaggtgcaccaccacgcgagactccccacccaagtcctgtctgcctacaacttgtaacctgccaagcaaaggcaaatgaaaaacaagcgtatctgtcctcctttcatatcccattttccccattatctatttctagtactttaaaaagtccccacaaggtggcagaattgtaacacgttgagattgatgagcctctactgagactgtgaatttttttttttattattattgttgttttaacacatttgagagattagtgcgtccaaaacaacacaggtaaagcatcacatccatagagatgaggacgccttcaagtatacactagcttagaaaaggatgattcatcttgcaatgaccattctttaaaagttccttaaaattacctcattagatcttttctcttacccttttttcttagcttagatttcagtggcaagcagagttgaaaacatcatccttagtgacaagatcattttatttctgagcaaagcacagggcagtttctattccatctcacttgttccccctttaaaatgctagaaggaaaaaagaagcttgagcagctggatgagcagctccacccactgtgggacatgaggcagaaggaagagaagaggaagcaacaccgggcaaagcaataaactggtgctgccctgaacacatcatgttttttttctttttgagacaggttcttgctctactgtccaggttggagtgcagtgatgcaatcatagctcactctaaccttgaactcctaggctcaagtgattctcctgccttggcctcccgagtagctggggctttcagcatgcaacaacatgcccagctaattttttatttttttaatttttttgttgttgttgttcttttggagagacagaggggggcaggggtcctcactttgttgcccaggctggtctcaaactactagcctcaagcgatcttcctgcctcggctttccaaatgctgggattaaaaacatgagccaccacgcccatcccttacacccatcagacttggtttcagtttacccaaggaaaagtgatgcaaggaagacaccctttaaccaagcaagggggaggtcgagatttgtacaaaacactaccaaattagagggtggggaatttttgtcccatttaaatcctaaggtacatatttttaaaaaccctcttacaccagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaactcttttccataacattggctcatctgagaataccgttttattaagcactgcttctgcctgcttcttgagggctgcccgttgcagaaacggaggatctaatccaggaggtgttcttcttcctaaatttcaagtggatgtaacctgtaatgattcttaaaagaactttgacaaagtccctgtccttttctggtcaaaggtttttttctaaaatggcttgaccagtgccttgtccatctagaaaatctcatagtatacaacgaaacaacaacaaaataaaaacaaaccaaaaaactgctgcttagctcaggaccagttttggatacacctgtccagtctaccagcaatccaaaagttccccataacatacagctgctaccgggagtgtacaactgccaccttgaaaattttttaaattttaatagagaagttatattgacatttacatatagtaattagacgagtgactgtaaccgcaataatatggacataacccactggtggttctcttttaagctacatgtaattgtttcctaattcctcagcatccatccacctttcttaatccctcaattttcagagctgagggtgtaaagatgtttcagtgaaattctgcccccagtggactcacagcagataggattatcttagtgatttctgaggaagactgcaagctgcgtgtgtttatcgagacggtcctctgtccgggaaatatcgtgagaggctgataaaagatcccaattctattaatagaagtattcatgactgagatcttaagctacagaggcctttccattcgggctctttttgcaggcagcgtaataagaaaggtgccacatgctgcctctaaaagaggccattcagctgtgcgaatgaatagcattttcctgtcctacccacggggttttgcatagctgtgtgaatttcggccacagtctgctctttataactgaccatctcctgggaagcaagaagggaaatacttccatgaagaccaattttacggcatttcaaaacactttaagccttttacctgctgtggcagagtgcttcgtttgactaagatcaagagaaaagagaacaaggcttttcctcatcaagtaaaaatttcctgtgtgctgatgagtcatctctgaggtacactctttgggaagaacactgtgcatcaaaagcctgccttgggctgcttgagaacctctgctgagtcagcactcactggggcagcggcccagccagagctattaagtgcagatcttaaaaacagatgtgttggtgagagtgtgcaggttattttctcatgtactgcatgttctaagagatgtcataagcagcctgtatatcgacctatcttgtgaaaatagagaacagggaaaggaattgtggctttggtaatttaaggagccttgattatttatggagctgtgtgttatggtagccaaatgtgatctactcagccaggactgctgtatgctttgcaaggcccagtgcaaaatggaaaatgcagggcccctcactgaaaaattattaagaatttcaagatggtgacagcagagcattaaaccatgtgactgcacagccccgcacctagctctccccctcagcaccctaggaagctgatctttgaacagtggcagttgaaatggtgtatggtgggttacatttttaaaatgtgctgggttgcctagcaactggcaagggcctgaatgggctgacgtgcaggtttagatacaccatcttgaaagtctacattcatggaaaccttctagtggactgataattttcaagaaaaagtaatatagtgggagatggaaatggggagggcaagaaaaaacacattttgctactcttataacccaagtggctagcttgtcattttccctgttcgatcttctaagaatagagctcttcatatgtgaaggaaaaatgaaagggaaattccagttttctcagaaatatacataaatttttagaggataatgaaactatgagttaatcaataaatatgtctgagcacattcctttagccattccagggtgtgatatgagaaaactgattcacacgcactgagcactcaataataagtacttactatgcagtagactacagagatgaataatgtagtttttattcttaaagaattacgctaatatgtaagaaacaattagacagcatcattacctttttaaagaacagtccataatctcctgtttttctctcctgggtattttacagggtccttgtgctgcagaatcagaaccagctcttttgatagggagcaagcagttcgggctttcaagaaacagtcacattgcaattgcatttgatgacaccaaagttaaaaaccggtatgtatcatcctgagacactgggaaagaaccgataaatgaagaactgagtatttgtgtttaatcaagttgaatctactacacttattaattaatgaagttagcttttcttttattcactgagtacaatagagaatagaattttatttgtctgagcctgaggagcccaatttaggaaatcagtagcctgataaagtcctcatctctgagaaggttttactctcctttatgaaaatgcagccacgatctgataccgctctattttagcatgagaatgctgttatttttctgtttgactttgcatgcttttgtttcacagtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaaggtaatagtcccctggatattggcagtaccctaagggaattactgagtggcagccatcagcattctcctggtgccagtatattttgccagggcagacactgactctggcagaagctaaaaataaaataagtgccatatacaactaccacaatcttggaaaatgtgctcagacctgtgtaggtttgcatttgaccactggcatgcctcatcatggttccatcactgctatatggctgtggttttcaaacatctacccataaactgaggccaggtggctgaagacatttccactgctctaagtgagaaacgtagaacagagtgtgttcaccatcaagctcgatgtattcaattttaaggaataatatttattctgagattatattatagcatttttatggtggctaaaaggcctttctattatgaaatagtatttgccaaaagcaaaagttggcaacactaaaatgggtcccaagactccccacctaaccacacagtggtctgtgaaaaccaggaatccaggaatctctggttgatcgtgtttaaagggctctaaggtatcatttctactgacagttatttggaacaactttaaaaacgttggccttacacccagaaactggtactattatgggcacagaaggctcatttgccagcttactgtcctctttggcatgactgcaaatagataatatactgcctgattaaaacaaaatctcaacatttgtctctgcacctgcgatagcctattaaagcaaagcttccctaggtagaccaataaaatttttaattttcagagtacgatattattagatgttagatttggttaatgttaacatactttgacttgtcatattctagaaagccaaagaaccttaaaaaacgcgaagccaaccaatttgttatcatggaaataagaaaaggaatcttcatttttgctgggagcttatgactagcaaatacagatccaaatgaaggagctctcattaagagttcttccatctctagctaatagaataataaatatgacatttgagaaaaagacatattgttgaaccacaatgaggctgggattaagaaagggaacttaaatactataattagtcaaattaataacggattttatttttgatggtttttaaaaattacttcccaaaccagaatagatatgtgtaaaatgaagtgtgaaattactctaatcctgacccagactcatttttaaaccatcatggtactttagcatttcacaggctttcatgctcctttacctaaattcagactcaaggtttttatactccagccagtctttacaccccttatttcattctgtctcagaagataattcactccaccgccctaaatttcagcctcagtcacttctctatcttactcccccactttgtactcatcaggttctgcagaaagtagtgcagcttatttgtgccactctttctttaattctgcacaagaagggcctgttaggcaaagggatgtagcgtatctgaaattgtgttgggagcccaggctctttgctcaatcaaactaatgcacttttaaaactgtgcatgaattttgctacccacttaatttatgaaagtgctattagtctgcagggttccttacaacattcctccctctccacacatatccacatttggcaatctaccgaggagacttcgacctaaaactgacccaggaaaatttggtattcttttggtgatagtagtcatggaaaagacagaatttgagatattctgtaaaatgggtttaactttcccatatataatgggcttagcgcatactaagcactgtgtacattgtttcaatttttcttggtaacatcgttagagtccttatgtcttatactctgcatatgtgaaatttgttcaggattggcattaatgactcctttcttttttgtagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtaaatatctgatttcttctttattacttaaatatatggctgattcatttattgatatattttgacttattaggtcacatgggcccatgaaaactgataggtgaataggaagtcatcttttctgataagggacagaagggtttgttgtttatttgtttgtttgtttgttttgagacagagtctcgctctgtcgcccaggctggagtgcagtggtgcgatcttggctcactgcaagctctccctcccgggttcacgccattctcctgcctcagcctccctagtagctgggactacaggtgcctaccaccacgcctggctaattttttgtacttttaatagagacggggtgtacttttaatagagacggggggtttcactgtgttagccaggatggtctcaatctcctgacctcatgatccgcctgcctcggcctcccaaagtgctgggattacaggcctgagccacctcgcccagctgacagaaggttttttagatagattagattatgagagacaatgccacggaacactgagtggggaacctggagccaaactgtcttggtttgaatacctatttaactattgactagctgtgtgttttggagcaagttaatcttttttaacaaagatttctcttttgcaaaacagggtaatgataatactaaacaaaaaggattgcataaagattaaatgaggtaatttatttaaagtgattgggttgggcatggtggctcacacctgtaatcccagcactttgggaggccaaggcaggcagatcacttgagaccaggagttcaagatgagcctggccatcatagcaaaaccctgtctctacaaaaatacaaaaagttagccaggtgtggtggtgtgtgtctgtagtcccagctactttggaggctgaggcaagagaatcacttgaacccgagggtcagaggttgcagtgagctgtaatagcaccactgcattccagcctgggcaacagagcgagaccctgtctcaaaaaaataaataaataaataaataaaaataaaaataaagtgattggaagagtagcaggcatataaaaagcactgaaagatgaaaatgatggtatgtattcatggtgtttcaggcatagagatttagcaaatattgagaggtgcagtagttacagtacagttatccaattttggattcagaatttaaagccctcacagttttgtaaatcaatattcacaaaataattttttattagaccgtgtatcctagtttgctttggaaagtgttactctgagagaagcacgggggattgattggtgcttttagagaacacactagatacaaatgtgatacatttctatactcaaattagaacacatgataatgtagatttgttcattcatcaaagacaatcacccattatagttgtaattctcagtatttggcttctcttgtggatgatcagtattacttttctttcataggtattggatatgctttttaggtctatcaaaaactaaagtctctgaagtgacactggtacaagcaattcacttgaatttctaaaaacagataaaatataatggaccagagtgtgattgagttacttctaaattccttgaacccccaatgtttcatgcaaactttcaagttttatgcatatttgcattttcttaggggagggtctgctgctttcattagatattcaaaaggaagaagcactgaaccaaacctaattaccttttcaaatagaaattgaacataggctatgacaaaatgggtatatagtaaggttaataaactattaatagaaacataaaatcaggaacgtaagagaccaattaaaacttatgataccaacatggggcccatagctctgtcaaaccaatggagacatagtgtgcagtatttagactatgagaacagtcatattccaggatagacacatccaagttgagaagcacaacacaggattttctgcatccatgccaggaggcctggtggtaacagagaacccaggcagctttgggggatatcccatcctaagacaactggataactacacacatagagcaccctgcaaatgactgtattctacataaaggcaaagttctgctaaaacctgacatttgtttcttctgatctgaatgtttaggtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcaggtaaggctctttcatttccttcctgttgattattaactagatacaaatactaacttcttgctagtaccaaataataaaagttcctagagtcctaaactagtatcctttatttaagccaaaaagaaacttatggaagtaatttcaaaaatgcctcttaaaaattcatgtatctgatcctgataagaattaatagaagaaataaagtaaaaggtctatttagagaatttattccatctccttcactggaggttaagaacagcaaaataaataattttgcaagaacactcatatgtttatactatgttgtttttctaccttccagtttctggagatgagatatgatttttttcttcaattccctgcaaggctgtatttcataatctcctccccatcaacacacacccatacacacaatgcacacccatgtctgtttcttgttgatagtgacaatgactggcatctttcctggctttctccactccgtttctaatgaacatttccagtatggttttatatcactggtcatgaaggtacagttaggaaaaagaaataggaaataacctctacataataattttttaatcctttaatttttaatttttgtgggtacacagtgggtgtatatatttatgggtgacctgagatattttgatgtaggcatgcaatgcataataatcatatcagggtaaatggggtatccatcacctcaaacatgtatcctttatgtttcaaacaatctgattatactcttttagttatttttaaatgtacaattatttttttttttttactgtagttacccttgtgctagcaaatactaaatcttattcaaactatttttgtatcattaaccatccctactcctccctgccactaaccttcccaacctctggtaactatccttctactttctatctatctccatgagttgaattgctttaatttttagctcccacagataagtgagaacatgtgatgtttgcctttgtgtgcctggcttatttcacttaacataatgacctcaagaaccacccatgttgttgcagatgataggatctcattcttttttatggcttattcatatccagtatgtatatgtaccacactttctttatccgttcatctgctgatggacacttaggtggcttccaaatctattgtaactagtgctgcaataaacgtgggagtgcagatatctcttcaatattcttttgggtatatatctaagagtggaattgatggatcatatggtagctctatttttggtgttttgaggaacctccaaactgttctgcatagcagttgcactagtttacgttcccaccaacagtgtacaagggttctcttttctccacatcctcgtcagcatttgttattgcctgtcttttggataaaagccattttaacttgggtgagatgatagctcattgtagttttgatttgcatttctctgatgatcagtgatgttgagccccttttgatatacctgtttttcatctgaatatcttcttttgagaaatgtctatccaaatcttgtacccatttttaaataggattattagatttttttcctatagaattgtttgaattccttttatattctggttattaatcccttctcagatgggtagtttgcaaatattttatcccattctgtgggttgtcacttcactttgttgattgtttactttgctgtgcagaagctttttaacttgatgtgatcccatttgtctatttttactttggttgcctgtgcttgtgggtattactcaggaagtctttgcccatttcaatgtcctggagaatttccccaatgttttattgtaatagtttcatagttggatctcttagattcaagtctctaatccactttgatttgatttttgtatatggcgagagatagggatctagtttcattcttccgcatatgaatatccagttttccctgcaccatttattgaagagactgtcctttccctaatgtatgttcttagaacctttatggaaaatgagttcactgtagatgtatggatttatttctggcttctctatcctgttccactggtctatgtgcctatttttatgccagtactatgccgtttggcttactatagttctgtggtataatttgaagtccggtaatgtaattcttccaattttgttccttttgcataggatagctgtggctattctgggtttcatatgaattttaggaattttttctatttctgtgaagaatctcattggtattttaatagggattatattaaatctgcagattgctctgggtagtatggacattttaacaatattgattcttccaatccattaacatggaatatcttatttttgtgccctcttgaatttcttgcatcattgttttatagtttttattgtactttcctctaagatctggaacacgacaaggatgcccactctcaccactgttattcaacatagtattggaagtcctagctagagcagtcagacaagagaaaaaagtaaacggcatccaaggaagaagtcaaattatccttgtttgcaaatgatatgattttgtatttggaaaagcctaaagaccccaccaaaaaaccattagaactgataaattcagtaaagctgcaggatacaaagtcaacatacaaaaatcagtaacatttctatatgccaacagcaaacaatcagaaaaagaaatcaagaaagtaattccatttacagtagctacaaataaaataaaatactaaggaattaaccaaataagtgaaaggtctctacaatgaaaactgcataataatttttaaaatctgcaattaatgtactttaagatagaatattcagtcccgtggtatcatagaaatacgtgtatgttcattagaaataaactaataagcacataatatgtggagattatgatgggaaacagaaataagtaacatagttctttctatcaagaatatattatcaactggtaagaaattgaaagaaggcaagtaaaaatgattaaagacaaaaaaagcacagttctgtagatacttagaaaaaaagattaattttgtttgggggatatcaggaaacgtttcatggaggaatcagcatttgagcaaggcttcaggtgattttaacactcccatacaaagtagtgggtgatagaagagtaggaccctccaccaaaatataggtaggaaaccccacctacagggaagcagaaaacagaaaaacacaggatatgttaaatattgaaacgttacaggttatgctgaaccccgaattccatgtgctatgaaagtctaaaagcttcccccaagatttctgcaaattcacagatggctggcattctcttagtcaaattttatgacaagtttcagcttcagcttttgcacttaatggattgacttgccatcctgcctgggctcttataattctggatcaaacaaaaccagaaaattactcacttcctctgtttctaatgtcccttgccatcccctgaacacacagtgtaatacaatttacataagacttgggtggtcagaagagatcacttcactggaaaacatacaattcatcttaacctttgacatctttgttcttaaaagttttccagcgacccaatcactggggcttttttttggcctcttcattccttctgtcctcagccgaacttcctcatgtcattcctctcttctccttacttctccctttctgttttattttgcagagcaattcagcttcttctaccctttactttattttttcgtttatttccagaaggggtgtcactatgttgcccaggcgcaactggctagcttttattcataaaatctgctataaacccacctttgccaatccaaacccatcaaggttctcagtagaacaaaagtctttcatgtaacagctaccatccttcattgcagacagccgtggctacacatagcatttatttcttgcctaataaatagaagacttggagaaaattcccctgagtatttctctgatactcagttcagttggtgtggtctagacagatcttaacatatcactttgttcctaagtgatgtatctatcttaaatacttgctcaaagattaaaaaaaaaatcaaagagtcaaatatggaaaatcatagaggaaagaattaactggatgaacaagataagtctatttatgtcccagaagcttcccatcaacattgtacttacagtttctctctttattaataaaatgtgtggcaacttttgaaacctttcagatgattgtggcaccatttagtgtgccccactaaaactttactgaaaaataactgaaatgtttttctttacccaacagagagacttctaagataataatacctgacagtgagattctttaagtcaatctcagtgtgtatccatttattcaaataatacatagtaaaccctcatgttgtgccagatactttggtaagcacagggataaaatggtgaaaaatatagacaatgcccctgatctcatagcacatacattctaaaagggaaggtagcccagaaaataagcaataactaactatggagtgtgttacatgatgcagtggtggaagataggccaggcaggatctgaaacttatagccctcattagaattagctagcatttgaattgaaatataataaaaagtcatgcattgtacacgtttgaattaacaatccccatcctctaatccaaaatattttaaaatcttcattttacagttggtggattcaaagtgggattggaccttcttgtagaatttgaattccgcacaactacaacgactggagttcttctggggatcagtagtcaaaaaatggatggaatgggtattgaaatgattgatgaaaaggtgagtgtcagcaatgcaaacatttctgatttcttcatgatattgttgatgtgtagatatcatccatgtgtgggaaactcgaatattttgaagcccggctgtattctttgttgggagaaagctaaattgtatgttttcatccttctggattacttcaatttgtgtatgttttcagcatgttgtaggccagtataaattttaaatgcattaattgtacagcaagccaatcgtgttgactaataatgaaccaaatagtttgagatctcgagttcttactgtgttgctataaacacactcttattctcctcttaaggaacacacagtctatgagactatggactccagtgggagaaaaggcagagaggtggatcatctaaaattagtctgcctcttttaacaggctaggcatctcttagaagccaaggtagccaactgacgcatcagtttctcaatttgtttaaaaaagcatccagctaccatttcaaaaaacagcaaatttataaaagtagtgtgtcagtttgataataattgataatcaaattctaaacacctctttcagccctgcattaagacaactttgcactataggcagcaggtaaacagagaagggaaaacaagaaatttcacaagttttctatttggttattaaataggaatcgtacttcaactcagttcacgtttccacccttagtgttgcctcccaagaagaaaaatcacacagtgacctaaaatagttttttcttgctttcttcctctttctgctcaattttcaaactgtcctccaacaaaggtaatataggaaaaaagatccaccagcttagaggtaaaaaggagtgaacaaataagtaacactcaatagttttaccaaattttcaaacatacttttactacatctttttcaagtaacatgctcttaagggcagttaccatcgatatgtcactatcatgtgcgtttctcaccaagctccttttacatgcaaaagcctgttatgcaaactccacccaatatagtaaacatttcattaataattacatcaatagagtttacaaacttttcacctatttacttgcatttttaatctttcttcttaagacttcatttcttttcttttaccttgtcgaatgtcttgccaaactgactaatgtttttagtgtttcaatatgtttcgtttcttcaccagcttcaaaagaattctgtcatctcaaatttcaggggcttttccacattactaaaaacagatttttctcatttagaccagaacttctagtctaagttcttcattgttaggaatttaactggccttctggctcaggtctttggcacctgtgacatgaaacgggctccaaaatgtaatttatgtaactctcaatcttgtatataaaatgaaatccatgaaggaaaaaaatataattaaaacatcaaaagtttaaaatttaaaaaatcctttactttgaatttgtaaaccaaattaatgagtcactttaaacaatatcttttaagaaaattttataaggttcagtcagaactctcacattctaaaaagacgtgaggtagaatttttccctgtgtacactaggtccttttcttgtcacctggcctcaaatttttctgaaagcagaattattaccagctttacgtatcttgcctattaactcccaacaatgccccaaagcaaagagcataatttgtggctcctggtgattagatttatactttaatttgtcaagttttaaaatttttttcaatatgcccagttacatccatttcaaatgattctggctgatgtctttcctagagacctgatcatttgtatgtgtgaaccatcatgatacttctttaatgaaaccatctgtgactgttctatttcctactttccagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccaggtgagtgttggctaccccagcaacaatttctttgctctcttatgttactggttttgaaaacatttatatttacgtgtgtctaagaatgtgtgcttatgtgtacttgcttcctagctttagaatctgcttagaatctgcaccttacctaaaatttccagtgtgtaaaatgaacatattacttatataaaccacatgggactgaacttttcatgagagcccccaaagtttccttcgtggagagattgaagctggaggaaatgaatttggcttataaaagatatgaggcatttaacagcaattggagccaaacttggtgttctttctgatttttttaaaattaatataccagaggaatcaatcataaaatgttatggaacttatttcctcaagttctggaaatcattgggttaaacatagctaatttcccccttatgttattatagagtttatatttatattacaaagaaacgcaagcaataaatcctcattcagaatccttctctagcacattaaatatagcatgtgaactgtagagatttacctaaagtgcccataaacaagagtggccaacttgatgagaagtaagccaagtgcctcttaataagtactgtaataacatagcctcctggaatggtctttcatcattttgtcaagaggaacttttatccctgtttatataaagctcctttgctaaatgaaacaagcaaaatgtatattcagcaattgttgacagagcaatgttgatagaaatgcaatgggggcccaacgacagctcctctttccaaagtggcttctgtgttttaaaaagatcttttgcttcaatcaggataaattccaagatattatgaaggaggtaatgtacttctccattcagtctatgataatgggatcctaattaacacctagtaggcctactgaaacaagcacctctataataagaggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagttatttcatgtcttaagatgtataattctagatgttttcatatgttataactattaaaaagttgaggctggacatggtggctcatgcctgtaatcccaacactttggaattacactttgggcatagatggggagatctcttgagcccaggagttggagagcagcctgggcaacacggcgaagggaggatcgcttgagcccaggaggttgaggctgcagtaagccttgattgcgccattgcactccagcctgggcaacagagcaagaacctgtctcaaaaaattttaagttgatctttctttctctacaattctattagtaaggctaaaaacaaaaccactaactttgcataaaacagcattccaatttaatctcaagctaacagttgactttgaaacatgctcttaatatttggtgcaggacatttcaaagctgagccctcttgcattgcctttttcagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattct

SEQ ID NO: 36709 - DNA, 17575 bp, Homo sapiens
ggcggcggcgggcgcgggaagatggcggcagcggcggcggcggctgcagaacaggtctgtgagtaccgccgcggccgcgggctggaggagcgggggaggccgcgtcctgccggctgggcccgcgggagccctggccgggggtgcggggggcgcgggccgcagggtctgggttcggcggggccgatcggggcggggcggggcgggaggagctgtgccccgccgaggatgctggcacaagctagggaccaggagccaggggcggcctcgggctcggcccggcctggctgatcctcggagggggtgaggaggggtctccttccggagagcctgggaggcggtcgagccagcctggaagcctgcgctgggacgtgccagggacgtaccccgttcagccgccagcagagatttggataaaaataaccgcagccccagcgagaaggctcctcttacaagaaacgggtcagctgttgccccggtgtcagcttgccatctttgttttttgtttctgccatctccaatatgcagacatcccagatttcccctcacgctttggtttttgaagatttagtcaccagtctaaaactatctcctgttcacttttaaaaatgatttatccaagatttcctgacctgcattgtaaacttgtaacttagaatggtttaaaaggctcctcatccccccaaaatctagttatacgtatgcatacatgtacatgcatatgtgtgtgtgttaatatatacatacacgtaatcgctagggtgatttattgtaatacagataattttcagtaactttcccccttacctaacttacttttcctttgaacaattatagtagtttctctttaaaaagtctcattctaaaacattgttgaaaaaaatgagtcaagttttgacctttggaacgattttcttagataattaactttttagagacctattagatatatgtcactggagggctcattctgaagataaaagacgtaaaatctctcttcaaggagcttaaagtcatacagccaaatacatgcagaaaaaatcagctaaagacaataggcaggctgcagatttgtaacagtaaaataaaacatagaggaatgagtgaaactgaaaggagacaaaacttcttggagttggtatttaaattgtgccttggctttcctcatttcccgcctaagttatcagcttctgtttcagatgattgtttttccatctggttctatttttgctttacacataagtggggcagtctgatccgttactcagtctccacttcaaatttacgcattacgtctccagccctgaacttaactgaattttccataggcacctcaaactcaaaaatgttcaaaactggactctgtcatacttactattaaaaaggctacaaccatccattcacttgtttaacctagccagaaacttaggaccaaggccattttaagggagctgagaaggacctgcacttggtttaatgttctgctgtcctgggcttgagatttaaacagtgagccccacattttcttttccccctgggccccacaaattatatagccagtcctatttgggagtcatcttcgacccctttgtgccacactcatatccaaacaatcacgagatcctgacagttctacctcttaacacctttccccagacttcagcttcaaagtcaaacctcagtcagtacctcattgggactcttagagaaacctgctgttgatatcttcacttctaggctcttcagttccagttcatctctttttggagtgattttactacaatgcaaatctgattgtataggaaacctattttaactcttcagtagttcccctttgccttcaggataaagtccattgttcttgtcatggtatttatgttgcttactggcccctaagcacatctctcattgtatttcttgcttcatccctacacctatccttctcaccatccacataaagtgaccaaaattagttctcccagagatggttgcctctcaaagtctccatgcttcttcctctgcctagagtgaccttcttagctcttttgcctggttaactcctgtccatccttcaagagttaactcaaccttcagcttttcttagaaactttccctgatgcccttgcctgctaggtggagatgcattcctcttctgtaccctttctgtattgtatgcattgctccactacagcacttgtcatgctttgtgaactgttagtcaccttgtctgtctacctgactggcctgtaattaagctccttgagggtggacactatgttcatcctggtagcttggagcacctggcttatagtaactattcaataaatgttaaatgcatcaagatgaagacagtaatgtgcatggtttggcagagaagagtaaagactacgtctcaggagggatgaattttgtcctttctctcttttatgtggacctatattcaaactttggctaacacttttaagttgcccatctgttagggctgtcagaagcctgaggttcttttttggaacctgactacaaattctgttaagtcttctcttaaagtatctacttaatctctcctttttcatcccactttagtttaggtcctcttaacctcaatcctccattactacaacatccccagcagcttacttactggtactcctctttcttctctctcgtacaaatgcccacacctttaacactctgaatttgtgctcaaaaacctccagtgactcccaattaaatagaacataaagactagaatttgtaccctgctgtccaagaaccttcacaacctggccctacttttccaacttcctcttccctgccttgccatatctgacccatctacttctccccatttccctaacaactccaggtcatcctgtctctcctccctttgaactctgcagtgtgtattgcctagactattgattttggcacctgaacatacagagtgctttattgcattgttaaatattttatgttaacatgtacacaaatcatatctgttaatacatagaggataaggaccctttcctatagttcttttgtattcctatctatggaattagtgtttaagcgtaaagtgcttaatacatgcgtattcaacaactgaattttctcagagctttaagaaataagtaggacagtatccatttctgcccatttcttttgtgctcttgatattcaagattattacccaaaatgtcattcaaccatagtctaggtcagaggttctcaaatcattttggtctcaggttctctttacactcttaaaaaatggaggattccaaagagctttggtttatgtgggttatattcattgatatttactataggagaagttaaaatggagaaatttttaaagtacagggctatacaagcatacattctgttgagtgatgatgccatcacattggtcatgtagcctttacattcatgggcctaggagagtaaaaacagcaaacagtatctcagtgttatttcaaaaatacagccccccaaagggtttgtggaaccctcccaggactccccaccctgcatttgaaaactactgatctagggtaatgtgagctctagtcagtgaaattataagtaacaaactatgtcagcctttccggtcttattttcatataaatgaaaatatataccgttgtccctcaatatctatgggggattggtctcaggacccccaaaggatagccaaatccattgatgctcaagtcccttatataaagtggtgcagtttttgcatgtaacctctgcacatcctcctgtatactttaaatccatctgcagattacttacaacactgaacacaatgtaaacactatgtaaacagttgttatactgtattgtttagggaataatgacaaggaaaaagtcgtacatgttctgtacaaatgcaaccattccctttttttttttttttttttttttttttttttttttttttttttttgagacggagtctcgctctgtcgcccaggctggagtgcagtggcgggatctcggctcactgcaagctccgcctcccgggttcacgccattctcctgcctcagcctccggagtagctgggattacaggtgcgtgccaccatgcccagctaattttcttgtgtttttagtagagacagggtttcaccatcttggccaggctggtcttgaactcctgacctcgtgatccacccgcctcagcctcccaaagtgctgggattacaggcctgagccaccgcgcctggcctcaaatatttttgatccacagtggttaaatccatggatatggatcccatggatatggagggccagttgtatacgtaaaaaaattaataaattattaataaaagcagttactcactataggatacgtatgacaactctgctcagaaacaagctgtatactttgacagtgggactgttgaaagcagagaggaaaaatatcagatagtgaccttgaagtttcttctgtactttccttctaagcacagttatgcccttatttggaactgcaactcaatgtgatttgcagtttattcatggaaaatgtgtcagtaaccaattcagcttgctatagctatgaatttgcacctaatagataaatgcaccaaaacgagagggtatagctgttccattatgttgtatttcatttttagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaatagtgagtatttgtaagaatactcattttaattgccatggggaattttttatctgctttatagtgaaatcatagactttattttctccttttctatacatgtcttgtctcttactgaattttaatgaatactttattaaaaaaactagtgtgctaatattttcatatattaatttcatttacaaaaaaatgtgcatgggtttatccctttaatggacttaatttttagcaaggatagaattatgaggctcccacctagctcaatcggtagagcatgagacttttaataaggataggatcaactcaatagaagagaactttgccaagatgattttattgctttcacatctccttaaaaatataatcctttctgttttcatttaacttttcctacatttaatgttgcctcctcagctggattttaaaattttaaaccctttgatggcagtaaaaggttatattttatagtcctaagtccccgttgtcaaaggatgcaagaatctggtaggctgattcacactaaagtactgaggacctgataggatgccttttccaaagatatttgcttttttaatgaagaaatccttttaatctgaagttgtgactgtctggggttaaatctgaaactctggcatgtgcatgtacagatattttcagaaggaatgattattgatatacttaagactgatcatgaacatagtctgcagcagttttgaagtgattctttttgtgttattttctacttctaatgcatgcaaggcagtctttttgtatttatgtatgtccaaagcacttctgtctaattcttcactcaaatcagaaagacctcttcctatatatttcatattagatatataaatttttactaggagcacaaatctgaatgcattttattttataaatgtattttatcggagacttctggtcaagatggcagcataaagacatttttatcttcttctctaaaaagctcgttccaaagtaacaatgtcacgaaacagaaatatctttgaagaaagtcggaagcaactgaaatcctaaatcataataaatgaagacacaaagtaggaggaacaatggcagataacttatcagagaggagaatctgcttgttggggaggggatgttggtggaagtaccttgtagaaccctaaaaagccttgggaattagaagttccagtaccttgaaaagcagaagtgaggcaagaactgaaaacagagaagtcatttgaaaatctgtataagaagcagtgagatccctaggcctcctctcccttccagccagcagttagacagctacccctcctaatgtcatacaaaactagtgtgtctctggacacactggaccagagaggattctatctgcctgcggatactggagggtaggggttgggtttccatactgaaacaggaaagtctgggtcctgagactccctttcccacgctctcttttcctcattctccacctccagctccctggcagccaggcaagagacagaagagccttctctgggattcctgatgcatatagaaaaaagatctgaagatactgtcatttggcaagtcccggtgaaaaagccatgtaatttccctcttgtgacacctgtcagtcacaagccctacccctcaaataattttctatgaattcatcactaagtatgaatactgagccagggatcaatagacttttgaggaaagtgccaagaattgaaaaatgatagagatgaaaactcctaaaccatggaaaaaatagaaactcatggaatagagaaaatgccacaaaaactaccaaaaaaacaaaagccctaaattcagtattttcagagaaataagaatatactgcatcaatgaaacaagaataacatgccatttaaaaggcacaagccaggcacagtggctcatgcctgataaagtgagaccctgtctctaccaaaaaaaaaaaaaattaaaaggaacaattaagaactcatagatatgcgcgtgcacacacacacacacacacacacacacacacacacacacacacatacacacacacacagagatgaatgggtgggtgggtagatggatataggtaggtaggtaggtaggtaggtagatagacagaagacattagaagataaaaaaactcttccagaaatttcaacaaaattaatcaactcaggagctctaacatgctgttaataggagtttcagaaagagcacagaaaacactgggggggaaatgatcaaatacataagtcaagaaaatttcctagaacagattgaaaactaccatactgggtccagcgtaatgcataaaaagacacaacaaggccattattatgaaatttaagaaaaccagtaataaaagatcctaatatcttccagagggggcaaaaaagcaggttatgtataaagaatacaaaatcagaatggaataggacctcccaaaagcagcattgggacctggaaggcaataaagcaatggctttcaaaattcagaaagaaaataattttccatctagaattgtatacttagccagtccagcaatcaaatatgaagcattataaagacgtatttttgccatgcacactttccaaaaaattttacttctcatacattgcttagaagccactggaggatgtgctctaccaaaagaaagatgaggatacaggaaactgggtgtctatcagaagagaaagacaaaaggaagttcagcatgaacgtaagggaaagtttatgattacagctgtgcagggggcccatacagaccagtccagcccacgcagaccaaaccagaaagatacaggttccagaaagatttcctgagagagaaaaatagaactaatatattatctgagaggctcagacctacagaaaattgtattgagagattttacagaaatagtggaggatttgagattaattagatttttaaagaaactaaggaaaatgaagtattaaattctgagagacaaggtacaggaaagaaactgccattataggacatatttggtttggtaatgaacaatatttatatggttgtaatactgaaaataatgaccttggatttaattaaaacttgagattggagctggaaaagaaaagagatataaatgagctaaatttatcatctgctaaaatagaaaattaataataaaacctaaattatgataaatgaagaaataacatatttagaagaaatatttgttagatattttagaaatatatgtttagaagaaatacatatatttagaaataaggagataaattctagatgaaatagctaaatttgttgaaagtgattgttcctgggaatgagatgtggagagggtagaaaaaataagaaactattcattttaaattatagacctttagcacattttgacttttagctatttgcatgtaataccttaataaaaataaaattcgttttgtttataagtggaaaattaattgatatatttacctcactgataaaacattttaggaggtctttaacattttggtgataatattttctatttgttttccaattacattaaatgtatgcggcctaccaacagtggacttgtgttctttttcagataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctgtaagttgccacattaactgaaagaaatgcaaacaggagaggggcattagagaaaaatactttgcaaaaacctagttgattattggaaagagatattttcccttagaaaaattagtatatttataatatatctataaatgtatgaatatagtgaatacagtttaaaacatccataaatattaatatttaataatactattgcttttatcatctgttaaaattagatgatttcttaatatttgagattttgttcaatggtagcattttctatgacagatgtaatttgtatgagaatacataggttactcttttctcctccatatgaggaagccattaagaaagcactttcccaggtgagaatactctgtagttttgggggctcttgaagagaatatgccaatctagtcagtggcatcccatgccaagagctgaaaacatagttttcaactgaataaaacctcaaggaggtattcttaccaccacccctgcctatcttaggccttgggccatgttcctccatgactcatgcatttttgcagagctaatgagcaaataaatgtataaaccttcattctaaagaactcttcttccaagtggatggagggagaacagacagagttaaacgtatttgaagttagtctgttattggggtttttaaatttctgtaatttttgtaatttttaaaatatattgttcaggaattttgtttgcagtcttctttgaaaatatattcacaataaactgttttttttgaagattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaagggtatgatttattggctttgttttactaatgggagagaattattctctagagttataaagtgggaagagagttatactgttgttgttttttttttgagacggagtttcgctctgtcgcccaggctggagtgcagtggcgcgatctcgactcactgcaagctccgcctcccggattcacgccattctcctgcctcagcctcccgtgtagctgggactacaggcgcgcgccaccatgcccggctaagttttgtatttttagtagagacggggtttcaccgtgttagtcaggatggtctcgatctcctgacctcgtgatccgcccgtctcggcctcccaaagtgctgggattacaggcgtgagccaccgctcccggctgagagttatactgttttaaagtagtataaaagaatatattccagaacaccggaaaggattaattctagatttgtaattaactagcttgtgtgatcattatcaagtcatctttatctcaatttccacatctctaaaacattaatagaaacatttgactttcatctctcatgactgaagcttctatttctctatctctgataacaattctcacattaatttagaaactctttttagtacttgttttttaaattttcagattaccagcaatgctaccagtgatttaaatataaaagttgatgggcgtgctattgtgcgtggaaatgaaggtgtattcattatgggcaaaaccattgaatttcacatgggtggtaatatggagttaaaggcggtgagtattcttttaagagcttaagagaattattaggttcttgggtacataaatccatatgtggaatagtatacaattattgaaaatgatataattgtctattttttgacatggaaagatgttcaaagtgggttgtgaagtaaaagaaagttacaaaacaatttgtgaaattcattatttttatttttcagaacatatgtatgtttataaaaacctagcagggtgtgccagaatgtcaacaatgtttagctgtggatagcaagataacagattatttgttttatttttatttctactagcctgtattttctgtttctttctctctttttttttttgtataatgatcacttgtattgttttagaaggcaaaaaaaaaaaccttctaaaagagaattctggaagatcaaagtaaatattcatgccttgtagttgttgtttttaattaaagatttttcacatccctccctgagtttcatatccaatgatgtgaaaaaaaacaattagcaaatttataaaattattttatttagatatttttattaaaaatgtatttttaatctattattaattgtaaaggaaagaggtttttgtctttatcgtggctgttgaaagtgaattttctttgtgcttaacagattaaatctgaactttaacaggtatggtatttcatgtgccataagtccaaaaactttttaatgtctcacaattctggtcaaagtatacttattcaaaatgcctttgggtacctgcaatatgctatttaattaaagcgaattaaatttgtcttaccaagtattacatgacaaaagtgaacttaaacgtagggacttatcattctttcttattaaaaaaaatttcaatttcatagttcctgggaaaaatactttttaaaagtagttgttttacttttataagcagtttttcccccagaacacataatcccatctctaaataataaagatggacataaaatgtaattcttgccagaaactcagttgcctacagagttaatttgtatgtatattgtggtgtaagaagccattcttctaagaacactgttgaagaatagccacagtacaactgctgttctcagcagtagaaagtcacagaagcaagagatttgtttagagaccattagcaacttaccaaaccttttatttttttctacctgccacttcttgtcccattctaccttgtagttaatatgacaaatatttaaatactttgaaatatacatatacacatatcagtttctctactgttaaaggaaaataacctagtattaaaaagataattagctttataacttcgttaatatcagtggttagttctaaagtgtataagccaatcattagaaataattttatcaattaaactgcttttttgaaaaagctgtttaagaagcaatttaggccgggcgcgatgacttacgcctgtaatctcagcactttaggaagccaaggcgggtggatcacaaggtcaggaattcgagaccagcctggccaacatggcgaaaccccgtctctactaaaaatacaaaaattacctgggcgtggtggcgggcgcctgtaatcccagctacccgggaggctgaggcaggagaatcgcttgaaaccaggaggcagagattgcagtgaacccagatcgcgccactgcactccagcctgggagacagagcaaaactccgtctcaaaaaaaaaaaaaaaaaaaaaaaaaaccaacaacaaaaaacaatttaaagaaagtaaaattaaatgaccacaagatggcagcattggaacaaattggaaaactagtcacttaagaattactgtctattccatatactaccactgcataatcagttaaccatctccattatttataaccaattttctctctttgctttaaataccctctgtaagccgatgcctcccaaatttggaattgtgctttaacctctcctctgaactaagagttacatatctagctgcctgcttaacattatccattttgatatctgataggcatctcacatttaacaattgaaaagttagattctccatccccacaagcatgcatttctttcagtattcttgtaccattaaatgacacccatcagtccatagcaaagccttctggctctaccttcagaagatacagagtcttgctgtttctcaccacctcggccatcaccaccctgatgtaaactgccatcattccctgcctggatggttggaacagcctcctggctgatcttcttacttccaagtattcactcccatagtctgttttctacccaacagccagagtggccattttaaaaagatcaagtcatttctgtattcagaatcctccaaatgcttcccgtataatttggaataaaatctaaagtctattccctgcctacatgtctgatcctcagttatttctttgactcatctcctactggttgttcccttcaccctccgtgcttcttccacactggcctcatagctgtccctggaatccaggcacatcttcacctcggggcctttgcagacactgttacctctgctttgagtacccttccccagttacctagacagcttcctccctcacttcctctagtttctgttggaatgtgtgaccttatcaaaccacaggtggtccttcctgagcaccctgtgtaaaactcagtccccatctgctcactctctacttatcctgctttatttctcctcatagcatttatcccacctgatgtcttatgtgttttactgttcattttttttattgtctccccctaccccattaaaacatcaactcaataagaacttgggctttgcctgttttacttactgctgtattccccagcacctagaatagtgtctggcatacagcaggcactcagtaattatttgttgagtgaatgaaaagaagaaaggaggaaagggagaaagcaagagagtcctaagagtcactaaaaagaaggattttaaggaactacaataagagaatgtttctggaacagtgggcgtgaagaacctccagactagagtgcctggtcttcaaattatatggtttgaatcttcatttgcagtgttgcaaaaacattggaaattaaaattaattccctctaggaggaaaagtcttttttttttttttttttttttttttttgagacagtgtctcgctcagtcacccaggctggagtgcagcggtgtgatctctgctcactgcaagctccgcctcccgggttcacgccattctccttcctcagcctcccaagtagctgggactacaggtgcccaccaccacgtcccgctaagtttttgtatttttagtagagacgaggtttcaccgtgttagccaggatggtctcgatctcctgaacttgtgatccgcccacctcggcctcccaaagtgctgggattacaggcatgagccaccgcgcttggccaggaaaagtctttttgtactcatgatcacaaacttaccaatcagtacctttgttatagttctcttaggacttacaaatgaaaatgatctgaaactttatcaacatcaattttattatgaacttaggaattctgatgtaattttaactaacaatagaggaattatgttgcagatttatttacatatgttatggatatatgaagtgaagaagtcactcattgaatcctgatattttgttttttattgttgctgttgttgttttgtttgtgactttactctttcttactgcttgcttttctcattgatatttcaggaagttttgtttactgactttgttctgtaccccctcatggaggtaaataaatcatattactattctcctaataggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagaaacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagttcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagacgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattg

SEQ ID NO: 36710 - DNA, 24753 bp, Homo sapiens
aggtgacagctggagggaggagcgggggtggagccgggggaagggtggggaggggatgggctggagctccgggcagtgtgcgaggcgcacgcacaggagcctgcactctgcgtcccgcaccccagcagccgcgccatgagccgtgagtgcgaccccggtgcccggtggggaattttcttggcctcctggtggagccttgaatgccaggctcagcccctcatctctctcctctgcagggagtctcttgctctggttcttgctgttcctgctcctgctcccgccgctccccgtcctgctcgcggacccaggggcgcccacgccaggtaggcggccccatccctccccaagggaatccccggtcttgcgcccctggcctggtttcaaccccctcctttcccctccagcgggcccagcttcccctttctgctcgcggtgctgagaaagactgaggctgagtcttttggtgggatgggggctccctgaagcccccccggcggtgtggccttggctaatgggctatctagttctttcaggggaaacagcagactgggatctggtgccaacttggggagaagggacagtccctatccatccccctcacctgttctgggccccagatgtctaagcagcctctgcacccaacaaccccgctgtttcctataggggcctctttgggaggaagccgcaggcaccaagggaaatgagttccctttctccagcctctaaccgtctgggaacccatcctgattcccattgccagtggagaaggtctcccctggtgaagacttcgggagaacatgggagatggaaatacatttaggagccgggatgcttcatctggggtttaagagatccccattgagcaaatgaggaaaccgaggctcagtaggtgccatgattccccaagctcacaaaatacatggtgggcccaggatctgaactcaggtctgtctgcgtccacacacttcgcaaggtctttccacagaaagctgcttctacccacaatggacccggagccactctgggtttcatgggggaggttgatggggaaattccgcccttccctcccccatgcatgtgccaggttccaggtgaaggaattcagctcctcgctcagccaaccttcctcccccagctcgctgcttgtgtgtgtgcgtgtgtgtgagcatgtgtcccagttggatatagtttcctccaccacctagctgtgtaaaatctctaaaatgaggcccagagagggcaggagggagcagagggagtccgcactttctgctgtgatgctctaaggatctggtgcgtgggggaaagaggaaagatatgtacatggattttggatcagaccaagtttcctgaaacgggctttgggtgggtggcatttaggggacccaaagagaggacggagggtgctctaggaaagggattgcgttgaataaaagtctggtttatgggaagaggaggaggaagactcatgtggccagcactttaaagtttacaaaggttggttgtggacatccacctctttggtgctctcaacagccctgccagagagatgcgttagacccagtctacagaaggggactctgaggcccagagggagtgaagccacttgtctgaatcctcacagtgagctggtggtggggagtagaaggggctcttcaggttgcctcgctgacccatcttgtcagtccctggatcagcccagcacttcctctgaggccccatctggcctcatccaggcactcttggtatacaggtcccacccgtctgtattcttttttagtccattcactaatgcacaatgagccatggtctgtgctattttgttttttgccttttctgtttccttttgtataataaatgtttacacggaattgtttttttttatccccaagggttatttatgccagtctttggctggggcctggagacacggagctgggaggagctgacaggctgatggtggagccagaaatgccaacagactgtcatccaaggggaccagggctgtgcggagctcatgggaggaagcaggggtatagggagcccagggaagggagcaggggtgtgcggagctcaggggagggagcagctgcctctcagtgcgaagaattgagggaggcttcttggatctgatgacttttggactggacctcgaaggaggtggcgggtgggggaaacactaagagactcgaccaggaaacaccgtaagggtaatgtggagcaggaggctgaggttggatgcgtaatgtggggatgagactggaggccagaaaactggtaccgaggctcctgcaaggatctaggaaagaacgaatgactggtggagtgcaggggcagaaggtctgggttgccctcatatttccaagtctgcgagtaaactgagggccaagctacttgggcatctgccccaggaagccaaagcctgtcttttacctctagaggcaaaggagatgaagagatgagggctgcactcacctaagagggcaggcggagggagagaatgctgcttttgcctctctggtgggtgaggagatggaggccagcctggaggcaaggctgtgccgggggcgccctgaatgctcaagtacttcccctctagtctctggacttgactcagtgcccatcttctagatggggatagggcatgacctggcaaccagagctgcatgccaggcagaggagccccaggccagctgacccgggcacatggggcaagatgccagctgtgccaaggctgcccgggtgcctgcacctgctctcgccagcaccagttgggtctgtgggccgggagagggcttccccaccagcaggctcttccagctgctgggcccagttgtctggatctggtgtggtggtgcttaggtgtggggactggggcccaggccaaaccagtcagggttccccaccttttttttttttctctctggctgccaggtccccagagactctctaaatattactctttaggggatttgggtcctgcctcttcactgggcaatcttgcagcctgacacctctgcatcctggaggacttggtgttccctggctgtgcctgtcccctagtcacgctcagtcctggacctggagccctgacttttgggctagggggtgttccttgcccaaacccttggaaaggtcctggaaccaggcagttctggacagtcctcatctgtggggatggggactagcagcttggcctttgggctgcgtgtgtctggcatgcagcgtggtgtgctgatcatctctgcctccgcgtgtcttggggactcagtgagagcaaatgggaaggttctctgctgatggggcagttgtgggagggttgtattgatacaaataatggagagggacagattggctctacccagagtagagggcctggacgtcgaaaggaaggcctcctttagcccgcctgctaaacccccttcatgggatatacagaaaaatgaggctccagaggtgggagggactcacccaagaatgcacagccagtaagagcagccactctctaatacagctctcccaagcaactacttggtgcctggccctgtgctgagtatgggggactcaaagtgaattagacttggtacctgcatctccttggttttctttcttgatgaacaggggtgtcctccactgagcatagaactgagttggcatgaaaacatgcaggattgaagttagaccgaaggaaggccttcctgtacgaatacttcctaaagatctggttgtggcaggagatggtgatccccctggggtcctggtttcattcgttctggattttcaaggttcactttgaaggaatgtgacaaatccaactcaactgggtcatcctcagtctgcatcaaagcgactctccctttccatcccttccccaaatccagtcctgggtacctccaggagtaggaggaggagggagattaagtcttggctccgcaacttcaaagcagtggggtctgggcaagcctcctgctttctctgggccctacattcctcattatgcaatggggagtctcacctacctctcttagggagtgctggggagataaatgagcgtgggtgtggaaggttgtggacttggtcggctggagccctggctttctggctgggctgtgatggtcaggctgtagtctagtggcacccagtctcctctccgcccaccctgacaccttggggcaccagcggcaggcccactgttgtccttcctgggagaacttttcctgccccagagcagtggtgtttatggaaagaacgtggcgggggaggcgggaggggggaagctggatgggccggactgggagggaggagcctcagctcccgcacagcctctcttggcagggagggtgtgggcagccgttccagcttcagcgtctggagcttgtggctcttctgcctgccgaggcagagctctagggccatggcgggaggccttccggctccacctcagacagctgttgagggcctggaagatgagggactccttttggtcaggctggaggtgaccaatctcctcacttcattttatttattccacaaacattcgttaagctctggctaccacatctggatcccagacctggttaagccccaactgtgtgcatagcctgtgctgggggaagagaaagccttaagggaagcgggggtcccttctcctggaagcttatggtggagaagagcaggttgaattggaacccggagccagggcaagggagagtgggaggagggagtgtggacatttggggaagacttcttggggaggcaaggcgtgggctcagctgatttggaggaaatgtattaaggaggctaacagcctggatgaaggatggagatgctgagggtttggggctaagggaggggctggcgcagaatgttggagctgcacggacctctggagttcattttgagatccctgctgtggcagggatggggaaattgagcctaggggaggcctaacccctgtgcccttagagtggtagaactagaccgtgagtcctagcggaccttgtgtgccagggttgggagctgggcagtgggtgctacaggggctcctgggcaggtgagagagccaggccagcaggaggggcaagaagaagagttctagcagggtgacaagtcctttcttgggggaaccagacctctgagccagcacgggggctgctccagaggcttcttggcctttctgggcctgtggctgggggaggcgggggctggggtactgccaggccctttccctggatcctgcctgccaggtttgcctgtggctgcctgataaagcctttttgtccagccttcttcccctgacccctccctcctacacccctgctggggccattgtggggctgtggggagttgccagggcttaagcaaaactatttgcatgattcttgtggtccttgcttgtgtgtgtgtgtgtgtgtgtgtgtgtgtgtgtgtgtgtgtgtgtatttgaggtggtgttgccgtcttcgaagtggggaccaagaggactctgctgcccaggtcaagccctgtgctgtgaagtgaggagtgaggagactgagaccagggcaggggatagggggcaggtcttgcccagggtcatgctctctgatcctagcaccctgagatgacagcatttcaccctcagctgctctggcctttcactacccttttgacctgcaataaccagttgcacaaagaatccatattccctgtaacgttggctctgagcccagataaggaagtatgtttgcagaaaggagcccggcgttttctgtgtaaggtcagagatggagcctcctgccaggcgctaggagtttttggtctgcccagctctgttctgtttccttggccaagttatcacctgtccctgaacctcagtttccttcactgaacagggtggtgggggtgatggtggatcctactgaacctgaggagtctgtaactttgctgctaaagaatcactgaggcagatttagcaagggggtggtggtctgagggatctgggttagatgccaagagggatttccttatagagtttctccaggaggcagcagggcggatgccagagctccatgcaccctcccaggagattttctagccctatctctcctattcccttggtctgtgaccttcttctggatcctagagcccagaccccaccctgatgtgggccaagtctgattccatcaggaatgggggctgaggcagctgagaccttggagtccccctcctcctgcacacccaccctctgtccccagggttctggaaaacttctttccttagacttggctgctgaggctgtgggggtggagtggaagtgaagggatgggcatttggtctggtgagacttgtggggtgataggtctggctttccctttttctggcttcaatttccccatctgcaatgtggacattatgatacctgctcttctctaccttctgcagaaatggaggaatggtgagggatctcgttttcctagtgttcatggggtggtggtctgggagaagtccccgtcctcgtcctcgtcccttttctgaccgcccccccaccccccgccccggcctgctcttgctactgaactctgactaggcaggaagtgaacgctctagaagcccgtggctgaggagttttatcagctctttcttaactttcagtgtcacagccggggaatcttctcctgccgccgtttggtggcaatagggagggagggggcgcttcccctgggggcctgatgtgggctaggctggagttccagagcagggcctggaaatgtcaggatgggtggtttatgttcacagaggtgggaacaggggtccccttgggggaaccctgaagccctggcacccagtgattcaggacggagctgcgacttaagtccatgcctctggcccctcattcccccatcaggggctagatgggggtcaggaggccaccctagcatggtctctgacctccatttctcacccacagtgaatccctgttgttactatccatgccagcaccagggcatctgtgtccgcttcggccttgaccgctaccagtgtgactgcacccgcacgggctattccggccccaactgcaccatccgtgagctgggccttcagccctcactccttccgtcttgagcccttctgctccccgggccctttctcctagaccctaacttcctaccctcctctctgaccatggccctgttctccttccttgcctggttctgcccctctccctgacctggcttcagcatgagctctcgctcttggtccaccctcactccctgcttctgagttccatggtgagtcttcaccacatgccctggcccctgtcctcacgcccggttctgtctctgtcatgtgtcattgctcccaaggttccatccttacccacttccccataggtgctactctgttccaccctggcccttgtcctcagtgccccatcttccaccctggctacttctggttctggtaggagggaccaactgagtgactgccattgcccctgcagctggcctgtggacctggctccggaattcactgcggcccagcccctctttcacccacttcctgctcactcacgggcgctggttctgggagtttgtcaatgccaccttcatccgagagatgctcatgcgcctggtactcacaggtgggtgtggggcagggccccctgacctgggggagcaagcaagcctgctagtccttttggattcttggcatctgataagggtagtgggtggggagagtctatgatgcctgataaaataagccccaacccaggaggaggcaagaactgggatggagctgggggtggaaacacccttgtcaccgttatttttgctctctgcagtgcgctccaaccttatccccagtccccccacctacaactcagcacatgactacatcagctgggagtctttctccaacgtgagctattacactcgtattctgccctctgtgcctaaagattgccccacacccatgggaaccaaaggtaaaatggggtgaggagctgggcctggggattacaggaggtgctcagttcttctctttgggaaaaatcaggcgaagaacaattattgacccaattctgcagatggctagaccaaggcaagacatatgacatgtccagagcctgggctgagaacaggcaagggcagcagagggtcttgcctgaggtcacctagagtcagaccaatgtttccatagttccagggtgcctctttgcttgatccttttctaatgatcagttgggtcctgccggggtggaagtgacttagaagttgagatgtaggaaagaatagtgagctatttattgggtgctgtctctgtgtttgggtctttacagatgtaaatagttttacatgcttcaccagtgtaaggtacaaataagccacatttttttctttcgttactcaagacttcacttagccacactggcaggggtcttccttgtaagaccttcccatgccacctgtaattatccaaaaacctgggatattattcatttcagacccatcagttcagcatcaagtacagagaggacaagagaggctcatcagtccactgctgctatactccagttcctgccacatggtggcactgttgaatgccagtcctgtgcagcctcatggttatgtgcttttttgggttcaaaaccttgcaccatgtccctgcttgggtctcaagagcactactgtgacggttttccatcatatggttagctgcttttcccaaagcatgactattctaccaggatagctgagtcttgccaactttgctgaaatcatgcttgcccagtgtcagtgagtgatgattccaaattacggttgacagatcactccctctaacttcccttttggtggattttctttaggggtacttgatattttttcctgccagaggaacccagtcagccatcttaatccaagtaatttccattgatcttgaaccttcaacatcagggctcacatcttgatgcattgtgaagagatgcctttaccagaactcaaaaaattctattcctttctgtgagggcaattgggtgacaactcatttgacactgacataattaaggaaggcctctcaatacttattctaaggatgacttgtctttatgccagacatagaaagattggcatcatttaaaataggttgacacacctattttaaggggagcaagcaagcctgctagtccttttggactcttggcatctgataagggtagtgggtggggagagtctatgatgcctgataggtggtggtgtggtggcacacgtctgtaatcccagcactttgggaggttggggtgggtggattgcttgagctcaggagttcaagtccaacctggatgacatggtgagacaccttgtctacaaaagaatacaaaagttagctgggtgaagttgtgtgtgcctgtagtcccagctactcaggaggctaaggtgggtggatcaattgagcccaggaggtcgaggctgtagtgagccataattgcggcactgcactctggcctgggcaatagagtgagaccctgtctcaaaaataaataaataaataaataaataaataaataaataaataaataggttggcaaactacagcctgcaggccaaattcggcccacctctccatttttgtaaataaagttttattggaacacagccacacacatttgtttatgtgtcatctgtgactgctttcccgctacaatagcaaaaactgaatagatgtgacatgtctgtatggtctgcaaagcctaaaatgtttactatctggctttttccagaaaaagcttgctgacctatgatttaaaaaattctacccactggttctctgccatgcttacattatctctcgcagtcctcagattcactgtatcaaatgggtatcatttgcccctttttaaagatggagaaattgacacccagagagatgagatgatttatctgtattcacacagctagcaaatagcatagtcagttgcaaacacaggctaccttgactcagggcaagggagttcatgtttgtttttttctgtttctttatttctttttggtgaaatgtttcattatggaaaaattgcaaagatacacaaaagttgagagaaaagcagaatgaactatgtacccatctttcagtttcaacatttacccacagtttcttcatcttatttcatttctcccctctcatatttttataaagtattttaaatcaaattctaaaaatcatgccacttaaaattctaaaaatcatgccacttcacccataaatacttctagggtcttttggtagagagtgggttacttggtggtggtggggaggtggtcctgaggaggccactctgggcttcctgcttgggccagtttgcctggtgagcccagatgtccccagggcagcaagatccagataggagaagctactgctgtttcctaccccccaaccagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtgagtacctaggaggggctcaggactgctctggacctaatttggcacgcgtatgtcatcgacagtgggccggcaccctggtgacctgagggaacccctctctgtccacaggtagacctcggccacatttatggagacaatctggagcgtcagtatcaactgcggctctttaaggatgggaaactcaagtaccaggtagtgctgggccagggggtagggcagagggaggggtctcccatggtcttccctggcaaagactgcttggggcgggggtctgggtcatgtcctgagagggccaaccacgggagtgggaagcttgtgccaggagcgacagtatacgctgggaggaggcagcaggtatgagaagccagggaggagcagacgtggcctcccatgtcagccagggaggtggattttggagctcaacaggagatgaacatttgtagtctgcatttatttatttaattattccacaatattaattggacacgagaatatacctggcacaggtgattgagtagtgaccattatagttaatgggccctgccctcaaaaaaccacaggcaaactctaggatgttcattctatgagggcttttgtttaaatcagaacggtccaacagaaatataatgtgaaccacatacatagttaaaattttctaatgtccatattaaaagagggaaaaagaaacaggtgaaatgattttaataatacattttacttaatgcaatatgtccaggtaattagcattttagcatgtaatcaatacattattaataaaatatgtcacattcttttttcatgctgaagcttcaaaatctggtgtatatttcacactcacagggcatctcaatttggatgctctattttcactggagtgatctaatctgtattaagatttcataaaatgtacagctgaataagtagagtgacatgtccgacttgttccacgcatacttaaaggttttccaatagctgaagtatcagttttaaaattcaaatagaaattaagataaacctaaataaaataaattaagtaacattcagttcttcattcacactagccaaatttctagtgctcagtagctacacgtggctagtggctaccatattggatcgtacaaatcttaggcaagcaccaaaacaaagtttgatgctgaatctttagggctaagaacagtacttggcatgtagtagtctcttggcatgtatttactgaatgaatgaagaagctgccatataattaggtacacttgtagctgccaccaaggagaagctgtgagtgccactagagtgtttggatgatgggtaaaacttccctaggaagttacaaataaacccagagttgcataaaggatgaggaggagttagggatgctaagaatgggagagggctttccaggtagagggtttagcaagtacaaaagcttagaggtggagaacagcttggtgacttggagggagtgtaaaaatgggagcgtttgctgagcctagtgatggagcgtaagaatgactttacaggaaggtggagatgtctgtggggaccgtgttaaggaattctactttctgccaagagcagagagagtatttggaaaggttttaagtcagctcatgatgcaagatttgttgtttttttttttttaagttttttttttcttttttttttttttcttttttgcttgggtgcagtgcagagactggcctgtctggggataggagtggaaatagggagcccacttagggaaaggagtcagagtggaagatgagcgggggttgcttgaggtagtggtggtagagatggagagcaggggactgattttaagagacattttggaggtggaatcaacagccttggctgaggggaactggcagctggaggcaggagtgggagggagttggttgtgggcagctgtgggtgacccccaaccccaggttgccaggtggccccatcccacaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggtgaggactccagacctgccctgccctggaaggtcattccctccatcctgagaagttgggggcgggggggtacttagaggtggaggctgggattagaatcctcacccttctgcttagtggctagaagaccttgagcaggcccctcaacctctgtgagcctcggtctccaaatctgtacgttggggtgaacgatgattgtaaggatttattgagatcatgaatgggaaggcaactagcacatagcaggccttcagaaaatagatgactgtgatggttgattattagctgggtgactcagcacatttgattagccaccctgagtctcggtttcccctgtgtgctgcgcccggatgcatacttgtggtccccagcacgtgcagggtcaaactgtaacttgcccggccttcaggaatcttcatgttcccttccctgcatgtatctaccttcctgcagtttggtagcttctaggtgactcagggacaggatatttttgtgttccctatgggggcgagtctgcaacctaaaatgtcagatggtttcctgcctgggagcttggcccctgacatccctgtccagaccatgttcgctctgagtcaccagtaactcccttcccccacctctggcaccactgggcatggctggtcccaattatagagcctaattcactggagccatgaagagccaggcattgggaataggaacagtcattagagggaagaggggctggttctgaagtttcagcgttgcaaagaccttgacctgagagagctggaggctgtccagcacactggctggagatgaagctgtgaccaaaggcaggaccctagggcaccatttaactcccctacaacctcatgagccgggtatgattaccctgtgaaaatcaagattcagagaggtgaagtgaactctccagggacactcagcagatggagacttgaggtctggttgccaccaaaatctatgctacttccactccatcacaaagggggctcttcttgaatgggaaggggttgcaaacctgagtctgatctgtgacatgtgagtattggaaagggattccccctcgcgtctacacttagtattcctacttttggctgacatatatggacaccccgtcttatgccaggcactgtgccagcagttttgctgtattcattgtctacttctctcaacaaccctaatatagtattgcattgatgttattattattattatttgagatggagtcttgttctgttgcccacacagtagtgcaatggcgtgatcttggctcactgcaacctctgcctcccgggttcgagcaattctcgtgtctcagcctcccgagtagctgggattacaggtgcccgccaccatgcctggctaatttttgtatttttagtagagacagggttttgccatgttggccaggatgatcttgaactgctgacctcaggtgatccacccgccttggcatcccaaagttctgggtttataggcatgagccacagcgcctggccgcactgatattattataacacacattttacagttaaggaaagtgagattctgagagattaagtaactcagcccaagctcaggtggctggaaatggtaaagccaagatttgaatccaggtctgctgatcccacagtctgtagctccaggtcgatttccaaaagccaatttgtctaatggctaattggcctgcatatcagtttctttcaatatctagttgcccagttttaattttgttacagaatgttcaatttgcattttccctggctttttgctttctagctggttatagctacaaatggggcagaggaaaaacttatttataagaatcctgttatataagaacatataggaaatatgttttttgaaatatatttagggctaggctccccttctgtcctcagtattctcttttgccactgcagcagctctgagtggtctccttgaagtccccctctatcaccgagggtgtcagcatgatgacagctctcaccagtaaatcctccacttttccatcttttgtagtctctccaccttcttttaatgggcttcaggagggaggtcataagaccaattcttggacacctcctttgcatgtcctgcttagctgggcctagaacctccctctgaaatgtgggagtagctggtgctcttgtcttgagacctcagtcaaaatagaccaaaagttctattttcacatcctgttacaaagagacaaaatggaagaggccaaacaaaattaaacatcaacagcaaggccaggtgtggtggctcacacttgcaattccagggcttttgggaggctgaggtgagagaagtgcttgagacttgcagttcaagaccagcctggataacatagtgagaccccatctcttaaaaaaaaaaaaaaagaaagaaagaaagctgggtgtggtggtacacctgtggtcccagctacttgggaggctgaggtgggaggattgcttgagcccgggaaagttcaggctgaagtgagctgtaattataccattgcgctccagcttgggtgacagaccaagaccttgtctgtaaaaataaaaataaacatcaacagcaacaacaacaataaagagaccaaaagcaagcacctctcatgaactggcctgctttccaagctgggcatctaaatcactgtgcttggctgaccctatttccaatcctgccctgcccaggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccgggtaagccccagaggagtgctggtgagggcaggtgggctgagggatccagcagacctgggtccaaattccaggttcttcttctgtaaaatggggctgatgtcacttctacagggcagttgtaagcattcctgtgtgagttcattggttcatttgtccattccacaataccagacattactccaggtactggagatgtagtgggaacaagacttttgtggttcttggctcatcttttagtgctcccaccctagaaagtgatggcagtcatacgacagctgacagcattagggcccttactgcgtgtcaggcactgttctaagagcttctcctatgttatcagaattctaagagtatgttataaaccatagtagaaaagcccaccatgctctgggagtcaggaagggacatctgacccagagttgcgggttatgggaaaagaagggatgtccaagcagaaattggaaggagggatagagatttcccagggtaagaggtggtgttagtggcaggggatggctgtgttccagatagagaggacggcatgggtgaaaggcatggaagtcagaggacatggcagtttgaggaacagaaggacattcagggcatggtaatgtatgtaacagtgcccgcctatggtgtttattaaatcataagcctccgctctgggctgaattgtggctcttttaaagttcgtatgttgaaatcctaaccgccagaaccttagtatgtgactgcatttggagacaaggtctttaaagaggtaattaagtttaattgaggtcattaggctgggccctaatccagtgtgacttataagaagaagagattaggtcacacacacagagggaaggccacatgaagatgtagggagaagaaagccatctacaagccaaggaaagaggcctcaggagataccaaccctgctgacaccttgatcttgaacctctggtctccagacagaggaaataatttctattgtttgagccactcattctgtggtacattgtcatggcagccctagcaaacaaacacattctctttccctggaattcccagccaacgccttcctcaatctccccttctccacattcggaagctcccatctgcttcatcgcagtctctggctcccctgttgcctcacagtcctctgcttctctctaatccttgtccctaaaccctgtcatgaagctgtggcacacatggatttccatttccttctggtaatttgactgaaattagcatttgctgccccggtgggcagctgctggctgctttatggcctctttgtcggtttctttatggttctttgtggggacacaagacatgaacagagacaatagcctttgtgtgaggctggatggttttcagaacgttttcaaggaatgaccatgatgatgtacgtgaaaagccccggcgtcgtacctggcacaaggcagaaaggccgcagagatgtatggactgtcaagattttttttcttttttctttttttttaaatagagatggggttttgccatattgcccaggctggtcttgaactcctgggctcaagcgatctgcccgcctaggcctctcaaggtgctgggattataggcgactctcaggatattaagaagagtgagtgatgataagacagggcttcccctgataaccattgtccatggctaccctctcaggggttcccatgtgaccaatactgagataacagctttgcatagtttatcccatttaaattgaccacagccatatcaggtagatgctcttcccttccccatttttacatatgcgggaactcaaacttagcttgaatagctgcccaaggtccctatattagtttcctcaggctgctgcaacaaagtaccacaaactgggaagctcagagcaacagatggaggctagaagtctgaattcaaggtgtcagcagtgccatgttctctctcaaggctctatgcctccttggcatctggtggtggccgacagtccctggcattcctcagcttgcagaggcatcgctctagtctctgcctttatcatcctgtggtgctctccctgaacttgtctttcctcattttataaagacaccagttattggattggagcccaccctaatccagtaggatctcatcttaacttgattacttttgcaaagacttcatttccaaataaggatgcattcacggatgcagagagttagggcttcaacacatatttaatattttagggaacacaattcaaccctcaacagccccacagcttgtaaagctgtaattggcaccatcctctgcttgctttgctcatattatttcatccaaccatgcctttcttttttgcccaattatagttgttgatcaaaatgactatctcttaagcatgaacgttattatttcatcctaagcaccagagctttcttttctttccttttttttttttttttttttgagatacaatcttgctctcttgcctgggctggagtgcagtggtgtgattttggctcactgtaacctctatctcctgggttcaagtgattcacctgcctcagtctcccaaatagctgggattactggcacctgccaccacgcccagctaatttttgtatttttagtagagacgagtctttgccatgttggccaggctggtcttgaactcctggcctcaagtgatccacccgcctcggcctcctaaggtgctgggattacaggcacaagccactgtgcctggtcagcaccagagctttctttagactaatgcgccttaactgttagtaatcagaatctttttctgcagcttttttatcttgccaggttacctgggctttgagttctattttccctcccttcacagggggttacactacctcttggtgtaattcaacggtctggggagcagtgtgagccacaaaagaggtcctcttggcccattccacacttcaaagatgaggaagctgccggatgtggtggttcatgcctgtaatcccggcagtttgggaggctgtggtgggaggatcatttgagaccaggagtttgagaccagcctgggcaatatagtgagacctcacctctacaaaaataaaataaaacaaaattagccaggcatggtggcacgtgtctgtagtcctagctacttgagaagctgaggtgggaggattgcttgagcctgaggaagttgaggctacactgagtcaagatcatgccactgcactccagccagggcaacagagtgagacagtgtctaaaaaaaaacccacaaaaaaaaaatgaggaagctgagactcagaggggcttcctgagagagcatgacagcagcaggcccggggcaggtctgcagcatcacaactgctaggctgcccaacactctccatcctagctcagaagggactcccactggaagctcttgtcccaggaacttacccaggctccaggacagcctggcctggctcccagaccactgctgtgcttctctctcggcagatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggtgagcagctgtttcctggatgcagtccctgcccttgagggactggcagcaaagtcagggagacatcaaggaaatagaacgggacaatacatgcggcaatgtgtaacaaccagacttataatgggcgtggaagtgctgtgccagggtggtaaataagcctgcttggggagagaaggtgacttttcagctgggtttggagaacaaatggcattttcagtgggagaagagagggaggagtgttttaggcagagcaatagaaagtacaaaggctgccgggcaaggtggctcgcgcctgtaatcctagcactttgggaggctcaggcgggtggatcacgaggtcaggaaatcgagaccatcctggctaacacgatgaaaccccgtctctactaaaaatacaaaaaattagccgggcatggaggcaggcgcctgtagtcccagctactcgggaggctgaggcaggagaatggtgtgaacctgggaggcagagcttgcagtgagctgagattgcgccactgcactccagcctgggcgacagagcgagacaccatctcaaaaaaaagaaagtacaaaggcatagaggtcagacagcaggtatctagggaaacagtcatagatgtggctggggcaaggagcttatgttgtgggaatgattagtgatgggaggttggggccaaaccgtgtagaatcttggttttcatactaaatattttgagttttatttggtctagtgctttctaagtacccacttacgggccagctgcataaaaatcatttagaaagctgattaagataccaaatctcagatgcctctcctacggattctgattcaaccagcctgggtggtgcccaagaatctgcgtattcatatgaataaagtatatatacatatatatgaatatatatatgaatagagtatatatacatatatatcaatatatacatatacatatcaatacatatatacatatacacacacatatatatgtgtgtgtatatatatactatatatatacatatatatatatacatatatatatatacatatatatatacatatatatatacatatatatatatatatacatatatatatatatatatttcccccaatatcctcagatgttgggcagccaagtttccagcccttgtcacatacaatggggagccactgaagcaggtgtgacatggcccatgagagttcccagtggaggatggatttgaggaactgggcagggaagcagggaagctccatatttgtctccccttggccacatgaacatgtggatattgcagagtggagcagattctgtgcatgagctccttgtgatcctggaacagcatcttattctttactctcccatgacaaatggtccccgggggcagaaggaacactgccactgaatttctgtgtgagctcggacatgttacatctttgagctctagtagtaaaagggcttggcccaggctaaggtcttgaaatctgtctgtgaaggaagccagatggggagcattctcccttctgtgatgatcaggtaattagggcccagagttgctcaaggttataggctgtttggtggcagatctaggcccctgactttctctttagtagcattttccttccctagacccagtccctgaggaggggcaatttgtgcttttcctcttgacccttttccccagtgccaaccatgccaaattctagggcacatgctcagttgctcaagttagtctcctggagtccctattatccccagaaaaaggtggacctggaagggtcccgccccaggttgaccttaatggcatcatggatctgatgctagcatttccccttatctccttgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagcc

SEQ ID NO: 36711 - DNA, 24753 bp, Homo sapiens; identical to SEQ ID NO: 36710

SEQ ID NO: 36712 - DNA, 5458 bp, Homo sapiens
cctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacggtgagtcagcgcccggccctccgcgttcactcctcgcctggtccgcgggccgcgccggacgccagccccgcgccgccacctggccagcccggcccgcattcagccaaggccccagctcctgccgctctgcgactgcctttttttttttttttttaaagcccacactttttgatttggttctaacttgttttgtcctgggcgttggtcctcgcaggacctcgcaggggctctaagaaggggaattttgtggctccccaaggggcttttgggtccctactctcgtgcgctttcccctccatctggggcacaggcatggcgatatggacagggctggagatcgagttcccagttcgtgaaaaggaagaaagttaaagggctggggaggactaaggggctgggtttcttgggtccctccttgcacctggcaccctagctggaactcctggccagggagcctgggtggattcctctgcccttctctgtccccagtctcctccgcggcttcttccctcccttttatgattcgaggggaagggaggtggcaggagtgttccccgcccaaccccctgtccagtccccacaacccccttctgctctgtcctgtcctctgggtgcggagaaggccagctgcacaggcagctaagcgtggtccgccctcccctcctcaacctgcagaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccaggtaaacttcccgccgagccccccgtcccactcgggaccccttcagtccagcgatctaggaaatggctctcacctgaccctcttgttcgatgaactctttaggccaaattaagagaaggctgattgacttcaaatccaagccaaggcaagcaatactccacaaaaccccaacatactgaggaatgtacacctgagtggcacgcctctaaaagggtcccactccctggtgtgaaagccacctgcttctctccactaatggccttttggacttttagtctttagtgtcttctctgccttatacacttcattttcttccttgtcctctcttttcagtcctgtttaaaacttctaacaatatcacctctcccaaccaaccaggaccaaatccacattcctctctcatgttcacagccagtttacagggttccccaaaggtgtaatcaatctatctccttcctggctgttgcatttttagaagccaggcgtgacagaggcagcaagtgccatggtgatagtgacataccacctcgtttgttaaaagacatgccatgctctctgggtttgtcacatgcctggccagacaggctgccaagcaggagagcttagtcctcagagctggtgaatgactccagaacagctctggacaggctgaatttcactgttggagtgaggatggcatatcagcccatcattatgtgttcacttgaatgtcaaaatctttttcttaggagaaatacaatgtgtcattaattcagtcattccaaaatgcagtcatctatattccagttgacatgggtgatgagcttaataacttaatgaaggcatatgatatttttaaggtgaggtgaggctctgcttcttcagtggaatagcttcattctctcctgagttatattctcaacaatagaattatacatctttgggggagtggggagaaggtagaagattgatttttaaataattcttctaaattggggtaaaatcgtattgcttgttatttctggtatttaaatatgttccttgacttgggcagttagatataaatggacaagacactgattatattcctgacatggtgagagcatgattttctcattttttcttctcatagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggagaagatgactcagatcatgtttgagaccttcaatgtccctgccatgtacgtggccatccaggcagtgctatccctgtatgcttctggccgtaccacaggtatgctgggctctggggacagttactgatgaatcacattcccaagtcaccgaccttgctgtgaatcagatcccccagttgaaaaagggataatccctttcctcccattccctagcaaggtctgtgctaagagaaagagttaacagtagtgccctgaggttagtttcggagcacaattattgttggagctgatagcttgtggagataggtccttccctcatttaaagctcagcgcagtgtagcagcttggagtgcagcagtcattgttatgtgtttaaaccatcacatcacctgggcaagcatccccaaggagaatacattccatacagggtctgagtcaaaagagagagaaacgtgtaagttcaataggagcaaagaaaaacacccttgggtgcttacataatgtgctcgtggctgacaagaaagatggtcatttgaaagtgtcctcgggaattttttctactataatagttaaaaagatgagctgcagtttgcttcagatttagtattcctgatgcgcatttttattctttgtgtgtaaggaatctaattttatctggatcaatgcccattgctagcatctcttagccaagattggaagcgggctttgccgtggctagagcagtggtgttgtcctcaggaatttaccttgttcttgtctacttccccgggcaggcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactggtgagtgtgtgtgtctcatctgccacagtgtgggtctgctttcctcctctctcactgaatccgcctacctccctataattgacttcttgcttcagagcatgactgtgatactctttatttctgtagctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtgagttgtagggtctggtgcagaggcacgattttccctggaaatcttagggtctcccagagtaaaatctagaaggctcaagaagcccttgagttaaaagaagtcatagtttggattcccacacagctcaacctcaagtcctgatggctcattaaaggggaagtctatgttctgctctagtgatataataaaggatgacacactgagttcatctcaaaataaaggatgacacagagtagtaactgaatagcacgtatctgcaggaaaagggctagttcacaagagctgacttattcccgtaagtttcactaccaagtagctggactttccaagttcctcatcattaaatgcaataacattcctactcatattaataactgggcacttatatgtcaacaaatatccttcctaagcaatgctttccataaggaactttgtcaggatctgatttaagtccataaacaaaaattacattcattttagtttaaacgtgtatcttttccttttccaatacatcttcatacatctgagagtttcaggaggtgtttacttgaaacaggtgctaagcacagttgctcctttcttggcattgtattgtggattaactgtgaggcacccattccaccctgcagtgtgtcttataggggaacatatgtttcagagacaaatggtgacagctcccccacacaaagaagttctgttctcttccctctaccttgacctgaatgcactgtgatgtgtgtgtgtgtgtgtgtgtgtgtgtgtgtgtgtgtgtgtgtgtgactcgttcccaggtatggaatctgctggcatccatgaaacaacttacaatagcatcatgaagtgtgacattgatatccgcaaggacctgtatgccaacaatgtcttatctggaggcaccactatgtaccctggtattgctgatcgtatgcagaaggaaatcactgctctggctcctagcaccatgaagattaaggtaaagaacttttgtgagtgggagatccgaggcaagtcttggtattctaagcagaactacgttccaaattccttttccctcatactcagtttcttgtctcctacaaactttacctgttagcttttctaccactttttctgattttcttagcacttttcccaagataggtaacttccaaaatgcttttaagcagtgaataaaaataaatctttgacaaaaaaaagacacacacacacgcaacaaaatctttgaatacatttttaaagctcccaacttttgggctaggctccactacacatttagcttgttgccaaattacactctaggtaagtggagaaattccattttaataatagaatatatctttaataatataaatgatgaaatagaggtgagttcatataacttgattggccacattatttcgtggtatgacatatcccacattatagcgaattaatatctaatggtttttttctgtgaatcctcccaatgtgttatttgctcccttgcttggaacttcagagttcactggaagtttttgttttctttctgcagattattgctccccctgagcgtaaatactctgtctggattgggggctccatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacct

SEQ ID NO: 36713 - DNA, 3125 bp, Homo sapiens
ggggcgagcgcgcctgcgcgctgggtgattttttcacgtgtcgccagggccggactgcgagtctctttgcggcgctacactagagcagagtacgagtctgaggcggagggagtaatggtgagtcccgcgtggccccgaggcctgcaggcccgggcctgtctgaggcgtacggggatccctgacgcccctcttttgttgggctgggcgggagggattggtggccactcagtgaccagcgcccgatggcaccttggagcggcaaggcccgcccgacccttttctcccccagggctctttgcacgcgcgtgtgctgccggtgtgtaaggcaggggggcgagaacccgggcgcacgcgcagcgtctcacctgcttctgcagggcctttgtggatgtgtaatatcttgggtaaaaatcatggtgccaggcagggagcttgacccagcgtttcctgaaaatttctggaaaaacctgaagaaggaaaacatttgaccttggaataaactaaggttgaccttaaagctggtctggttgctcaccggaggagcgacaacgacccctaacagacgtaaggaatcgggaattaaacttggaatattggttagtacattcaaatgcgcttccttaacgaataagctgaggtttggtgttaactttcaaagccaaaacgtgttgagatgtatagcacggtggcgttgcctgttgataatgtgattacatttagtttttgtttcaaaacatttctcttcctacaggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaaggtaaatgggagctgcagtggaactattttttatagtgtgcagtggagggaaaagaagtaattctggagtattaaaagtcgcttattaagtagagtttatgtcgttttcaagatcattaactgctttggttctaatctgtttcttaaagggaaatgactaatataaagttgcttattttatatgaccaatgctatgatgcttattttatgtgatagtttcagagtattaaaaattgtcctcaataggccgggtgcggtggctctcgcctgtaatctcagcactttgggaggccgaggtgtgcggatcacaaggtcaggagttcaagaccagcctgaccaacatggtgaaaccccgtctctactaaagatacaaaaattagccgggtgtggtggcatgcgcctgtaatcccagctactggggaggctgaggcaggagaatcatttgaaccctggaggcggaggttgcaaggagccgaggttgcaaggcgcccctgcattccagtatgggggacagggcgagattctgtctcaaaaaaaaaaaaaaaaaatcccctcaatagcaatttggtagcctagtgtgatcagtgtttgccttacattctaaatttttaataagacaaaagaggctgtgcgtggtggctcacacctgtaatccttgcattttgggaggccaaagcaggaggatcgtttgagctcaggattcaaaatcaggagttcaaaatcagtctgggcaacataatgagacctcctgtctacaaaataaataaatacaaaagatgtgcttcaaggtaaaatgagggggcatttaagaattgagaggaaacttggactgttcgtttaacccctaacacattgaaattgccctaatcttaaccagttggtatacctggttgtatacctaccagaggaacaggttggtcagtcttgtccaatctgcagcctgggacagctctgaatgccgcctaacgcaaatccctaaactttcttaaaacctgatatttcttttgcaattttttttaagcttaccagctactgctaatgttagtgtattttatgtgtggcccaacacagttcttccagtgtggcccagggaagccaaaagattgcacacctctgttttagatgttcctcagttaattgtttaggcctcgggcttctaaagatctcagccaaaatacacagtaaacgccgttggggccaaataatgttaactgcattgttctagttgcttctgaggaggaaagctctactgaggagctgtcatggagttaggaataggaagactttggggagtggacacttagctgcagtccctttccccaaatctgttctttggagggaacaaaacaatcacaagagtatgttctaaatccaaaaaaactttaaatttttgtatgttgaaagaaggaaaatatgaccatttgtatatggcattttctgggtgctggctactgttgcaggtttatttcatatagttgataagttatgttaatatttaacagttataaagttagctttagttaactaaagttagcttttccagaatattttcttgaacttttacgttggagtcaggttttagtttaagccactgtgtattatttcaaagtgtaactacagtggtatttttgagtgaagatctgtaattctagtatgagtcgtatcacttagccacgaaatatatttttaatataattggatttgagtgaccatgtttcattagttgtagtgatttaaaagttaactgtttatgttgggtgaactagatatctttgctaataaacatccttccttttttaagggtggagagattcaaccagttagcgtgaaagttggagataaagttcttctcccagaatatggaggcaccaaagtagttctagatgacaaggtgtgtaaacttaataattctaaaaagaagtcagatatttgcaattagttgtcttaactaatggtttttttcacttgcaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaaat

SEQ ID NO: 36714 - DNA, 16386 bp, Homo sapiens
gcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggtaggttcacactcctgctcctcctcctcctctctggtagcttcataaggggcgtttaggccggggagtcctttcctagtagaggcagcttgggactccttggggaggagtttgcgggacggggctggagagggaggaatggggagggacgtgaaagtcccgtatttgtatgagttaacgactttacattcccactcaggtttactttgcgcagctgggcacagatgccagcttctattgattagtaggcttggagggggaccacagaatcgccgaacctaagggaagccctaggaggcctgcacttgcccacaactaagaaagctttgctagttattcaggctaatcaccagctttttgaagcaggccttagttttttgcaagcgtaactaacatttggggatcggtgttttctgtttactctcctctgcctcctcacccttaacccaccctcagccagtgttgtgcaattcttagagacacttgccaacagcctcttctctaagccttcctactggaaggttgggatcctccgttttctcgctctgagacagcacgtcaaatgctaatagcagcacatgagtaaagcgcaacatctttattaaaacaatttcagcaccactcagggggctagggaaatctcagatgagccaagaccctccctcgtgacagtaaaaatcttataatcaagtcataatgtaatcagtagaaacccaagggacatcattatctgtggcacaggaccaccttcccagaagcagcctcaggtattcaagacttacttaaccacagagccactaacaagttttgcaagaggataggtttattacatacgcttcaattcaagcaattcttttactgatgacaagcagagtaaaataatttttgaatttatggtaatagtcaatgtaggtttccttcgaacagcaactttcagtggcccctttaaagttagctctgattgtctagaaagtactagtatggaatataaaagttgtgtgggcccggcacggtggctcatgcctgtaatcccagcactttgggaggccgaggtgggtgcatcacaagatcaggagttcgagaccagcctggccaagatggtgaaacctcgtctctactaaaaatacaaaaattagccgggcacggtggtgagcacctgtaaccccagctactcgggaggctgagacaggagactctcttgaacctgggaggcggaggttacagtgaacagagattgcgtcactgcactctagcctgggtgacagagcaagactccgtcttaaaaaaaaaaaaaaaaaaaattgtgtggtgcattggaaagcttccaggccggcgaatgcaatgagttccttgggcaatacatgtctctttctctgttcctcagttggctcttctttaatatgaggggtggacagagtctcagaggcccctcccactcttgttctatgactccatggagtggtacgatgttagtaacaggacatgaggcactctagtaatgtggagatgaactatcgtttggcagagaggatggaaaaaatcattccaggaaaagaggaatggctttagctattgttgaaaacagataatcaggttataagcaggcaagagtaagaggtttgtcaagttattgttggaagcattggtcactgtgactcaaattaaagtagctggataaaaaagtggaccaatgaaggtcagtgaaacctttctttaggagtttttattgaatctgtatttaagcagattctctgtaattctctgtaaacagttattcccggaagaatgccatgaaatacttgggaaagagggaatgggaacaaagagtgagtgggcacaaagcccagagttggttgaaaagcaaatgtttaatttttgtctttgtttggaaatacaggcatgtcagcaggactttgtccccactgtccttcaatcagtagtgttgcctcttcctggagacgtggttcttcttgccacgtgtgcttttccttctttacctgttacttccgttattgaataagttcatgcttatagacctaaagtgttagaataataaagaaatatagaaattatttagtccattcttcccatcatctaattttataattagtcctaagacagaatgatacatatatactctgtatgaaggaggaaagtgctctaacactagggtccttggaaacaggacccgtgcatcccgtgtctgtgtgcagggacattattggcttgagggagagagagaaaaaaatctccaggaaaggggaatgactttcaagttaaagctgtctgaacatttaaaaaatatatgaggttttttgcaattggcgattccttcatttgtattaaaattactgacaaagatgtgatgttccttaatcatagaatataattccttgttgtattttaaacacaaatgactaagtgcttagatgcattctaatgaaatagtaatttttcccccaaaccctacttttcatttcaacaaaacttccttgtgccaagtttaaaagaaaaacataaaactgtctttttgcattgtgggcagattgtgtatcctccaaaggttgtccagtgaaggcccagaggcagagaagggacctaactatattcagaggctgctggttgccccacctcagcactactgcagaactctaaaatcagaggctgctctgtttgtgtgagtcggtgcttgaattggtgcttcaggccatggggctgtgtgtgtgcaggcgcatatgggttgtatgctgtggcagggtaccgcttttcgggactcagaggtggtgttgcttgagctaagcctggaaagacaggtcagttttctccttgcttatgaagggttcaaagtctgactccaccattcatctgctgtttgttcttggagtttcctcatgagcagagcatatttacataatgcctacctcacacagtcctggtgttggttgaatgtagtcatgtatgtgagagcttcacaaaatgaaagattgcactgaatattataattattgtgatttcaagtgcatttgttttactagcaggcagcctgtcttttcttgacaccttctcaagtgcagccagactgaatacttggcagctaggtgggtgacaacagaggattgaggatttttaaaaagataacactgtcctagatccaacaccactgtgggcaaatgctgggggtctgtgaaacagttggtaccctgctgctgtctgatattggaaactatgagatctataaggtgatcctggtgacctttggcccactgtttttacgcaagcaatggatctacagccctgctttgatgatggagataagcaattttgcaactacattacaaggatcagaagattgaatgttcagggttagtctcttgtggacaggtaaagatggaagaaggagaaacccaggaaacatggcaagcctgcttctgggggttagaagctgagaagttgagtgtagggggaggggcagtgtactaatagctgtcacacaaccttctctggaagtgctttcctggctgtatgaaatcgatggaataacgtgcttagcatccgttcatgaaaccaaatgatgtgatacgataaataggatgtgatatgataaatgataaatagtacagtggaaaagcatcctactggaagaccatatcttactctgtgacatcttccaaggcagttcttggagttggcccagggagatcagagatgctatcttatggatccagactattatgtgtgaatagggaaacctcagtcctgccatgaacaagagtaagcaccacagacagcagaaaagggcaacttttggacagaaggccatgtttctcaaactttgtcttccagaacaaatctctaatccattcaggtgggttaatatctaacccaatcatgcccagcgaaaaggtgaatgaccctcctcgtttgttcaagagcagtgtccttggttttcatgtccctgccaggactgggacactatatattaggaacactatataatcagaacctggagaggcctccaggttcacacaactggaacccatctccaggaacaaacagctggaacccatctcccgttgaagggaaactgccagatttttgtaagattcttcctcctgggtaaactattgttcaatttgttttatatattatttctagccatccatccattttaatgaaaccattttcctccctttaaagcctccaggctcaagctcatgaattaaaaagaaaatggatcagattctaaagtttaaaatgaaaacaggtttcttttgggatggcctatgtgtggataaagagaaattagtgagactgggaggaagtggaagtttaggagggatttctaaattgtgataaaatccccaaaggcctgggggagccatttgctgaaggccatcgggagtcctcccccgtcgtccacccctgttacaggcattacacgtggcttaacaaggaaagaaacagtatgtttttagcattgtttccttctaaccttccctgctaatttctcttcttagaaaagttttggatgctctttcaaacaaagtggaacacatcccaagatcaaaagaaggctcactggcaggttgaagggaagaaggaaggaaaagcaataaagggatgaatatgccttgggtgttaggctcttactttgggggattttgccctaggatgtataaaagtgtgaagccacattgatgaaaatgataactatagttactcatcataaactgtcaagttaactccctggtgtgtaaaatttgatgaatcttttgaatactgaacattgcctgtggggagagggagagaataattcttgtgaatactaacagattcatttgatacagaagataaagttactctaaagaacagttggggccaggtgtggtggctcacacctgtaatccccgcactttgggaagccgaggtagccggatcaactgaggtcaggagttcgagaccagcctggccgacatggcgaaaccccgtctctaccaaatacacaaaattagccaagcgtggtggtggccgcctgtaatcccagctacttgggaggctgaggcaggagaattgcctgaacctgggaggtggaggttgcagtgagccaagatagcaccactgcgatctagcctgggcgatagaacaagactctgtctcaaaaaaaaaaaaaaaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaaaaagaaaagaaaagaaaaaaaggacagagaacagctgggactaattccactgacaaaaagctgacagacagttacgtgtttgggtacagaaggatatatctataggacttttgccaccagatgtgaggctttgcacccttggcttaggcagattcacttttacaccacaaacgatctgtctcttactggttttctcccaattccattttaccttgctttttgaggaatttagagttgaatatattgagaaagttttgagtgagggagcagatgttagatattggtggttttggtgtacgcttgctgagatttggttcctggatgtcttagggaatcaagattacaggcccccaactaaacttatacaaaatttgtctctgtaactgagggtcactggacctttgctattgaaactagcaaagcctctattatgtttaatgagaaccatgaaacttcagatttttagagctagcaactcttttattttcttgatgaacaaacctaggcctggagagaaaaatgaagtcaattacttaaaaaatattaagggttataataaggcaagcatgttgattcaaggtgaataatatgagttctgtggaatatacaccagtaagaaacactaacaagtaaatacttcattgttcatccacgatcacgtgggtaatggcatgtttggaaatggcacccgtgaaacctgacaacaggtcggtctttattttgtgatatccttatgggtagattctgaactttgtggcttttactttggcacttatatctaatgaggtgtccttggtcttaatatctaatgcagagcgagtttggacagagattctaaacaggttcaccagctcatactcccttctgtgaacagcaatatccccacaagttatacagcattggcacctcctgcaagtacggtatttcctagagaagacattagtaacattcctatccaccactgccacctaacgactcttttaggtactagcagctctggttccgtttcctgatttctgatttctgggattctggcaccaggcagaagaatgttgactgtgtaaggcagacctttgacattagaagtcagtatttgttcattacagagcaagagacttaattgattacaaatcaataaaactttaataagatcttccaaaaaactagaaacaggaaacacacccaggagactgaaaagcatgatgtaaatgtgaagaacgtggcaagtgggtggcttggcagcccagcagctatactggagcagctgcatgagtgaatacttgttactcctttagggctggctctccattctacaatcatgtacctctttcttgataaactcccaagaacacactttcagcatggaatttcagacttttagagatagcaactctctcaagtatggacaaatgtcggtgcggacaaatttgatgcactgctgaagaataccaaataatatgctaaggaattttttcattccacaataatggagtaaatagcagctggaaatgtttgcattaagttcatagattataatttgtaatggaatcaacaccaaatgcaaattagaaagagagcccactttgctcacccagtcacgtcttcccatgtaaccatagaacattggggtcctgtgtctttctagatccacagtcttgctctcagaacaggctagccacaccacaggcctagtgccaggacccatggcctttttttaagctcagactcccttctgtgaacagcaatatccccacaacttgtacaacattggtgcttcctgcaagggctacagaactatttgatacgaaaatgttcattgacttacacacaagagaagcacaaaataaaaaattaataattaatttaatgtctttgaaaatgtaccatttatttttacatttggggtcataagaattgtattacacttaagaatgcaatacaatttgaagatcagatttttctccctttgtgagaatttctcagtatgtgtgatgactaccaagaaatcatagccagtcataaattcagtgagttactcataaacgaacaagaaccacctacttcttggggaggtaggtctgcttcccttcaactcaggatacaactgctttcaactgctttcttcacattagctgactaattagctagaagcctgtcgtaaacaattttatggttgactccttccctgggctcagggttccctagaacagaggtccccaaatcccggtctgtggcctgtccgcctaagctctgcctcctgccagatcagcaggcagcattagattctcataggagctggacgcctattgtgaactgcgcatgtgcgggatccagattgtgcactctttatgagaatctaactaatgcttgatgatctatctgaaccagaacaatttcatcctgaaaccatcccccaccaatccatagaaatactgtcttccacaaaaatgatccctggtgccaaaaatgttagagaccactcccctaaaactctcttcttagctctcacctcctgtattactatctcatctcagtacattgaagcccccatcttttccccatggatgcctcatttcctattagggaggcatttttttattttttgtttttatttttttccgagacggagtctcgctctgtcgccaaggctggagtgcagtggcgcgatctcggctcactgcaagctccgcctcccgggttcacgccattctcctgcctcagcctcccgagtagctgggactacaggcgcccgccactacgcccggctaattttttgtatttttagtagagacggggtttcaccgtggtagccaggatggtctcgatctcctgacctcgtgatccgcccgccttggcctcccaaagtgctgggattacaggcgtgagccaccgcgcccggccgtcatttggtatgtcttaatgtgcctcaggacctagcacagtccctggtacccagtagagacctatgtaatgttcattattcaattaataaatacatgaattaaagagtgagagtggattttgtaatgttacgactgatagagaaatactcagtgattctaagggatggggaagaacggttggagctagaggttgtgctcaggaaactattaaatagacgttccgcaggaagggattgacgaagtgtgaggttaatgaggaagggaaaatagaatataaaatttggtggtggaaaagatctgattcatgatgccgtgtcagagagcaaagctcctgtccttttggcctaatttggtgatgctgttcttgggtctaccacacctccttttgccctccgcaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaagaatcagagtcttctcactgattctgggcatattgatctttcccccattttctctacttggctgctccctgagaggactgcataggatagaaatgcctttttcttttcttttcgttttttttttttttttttttgagatggagtctcactctgtcgcccaggcttaagtgcaatggcacaatctcggctcactgcaacctctctctcctgggttcaagtgattctcctgcctcagcctcccaaatagctgagattacaggcatgcaccaccacacctggctaatttttgtgtttttagtagagacagggtttcaccgttttggccaggttggtcttgaactcctgacctcgggagatccgcccaccttggcctctcaaagtgctgggattacaggcatgagccactgagccgggccactttttccttatcagtcagtttttacaagtcattagggaggtagactttacctctctgtgaaggaaagtatggtatgttgatctacagagagagatggaaaaattccagggctcgtagctactaagcagaatttccaagataggcaaattgttttttctgtcaaataataagctaatattacttctacaaatatgagaccttggagagaagtttccaaggaccaagtaccaacataccaacagattattatagtttctctcactcttacacacacacacacacatatacacatatgtaatccagcatgaataccaaaattcattcagggtagccaccttttgtcttaagcgagagataattttgatgtttgaatggaatgctcccaggatattctcttgtcatggttattttatataaaattcaaaaaccaattacattatttcctctgtaatcttttactttatcaactaatgtctggcaagtgtgatgttttggggaagttatagaagattccggccaggcgctgtggctcacgcctgtaatccagcactttgggaagctgaggcggacagatcacgaggtcaagagatcaagaccatcctggacaacatggtgaaaccttgtctctactaaaaatgtgaaaattagctgggcgtggtggcacacacctatagtcccagctactcgggaggctgaggcaggagaatcgcttgaacctaggaggcggaggttgcactgagccgagatcacgccactgcactccagcctgggcgacagagcgagactccatctcaaaaaaaaaaaaaaaagaaagatcccagtttatcccagtttatcccttattcttcctcaattctcaagatttgtttttaagttaacataacttaggttaacacactctttgtaaaatacactgttcaatctacagactcagtggttagcttcctgttaactaatttctgttgacaggtacttggatattttatttagaaagtggttgccaataaattagttataagtcgccagtttcactgccttgtgaacacataattattgtggtctcagtattccctatggtggcttctcctgctcctggtattgccctgaaatgggccaaaagccgtggctccccaatactcaggttatagaacattgtccaggtaccacctaggagagcccagcctcactgaaagtattcaaatttaggaatgggtttgagaagtaggtagctggtatgtgcttagcacaagaatctctcttccttgggttagtctgtttcaaaactgaaaacactgtcattccttaagaaaataggaaaaagtattccaaacctctgtcactagaaaatttgccatattaccaaatctcaaaaacctctcaggaaatgagaaagtcccagtttctggtaaactatttgggcccttttctcaagttctccaaccagtgctatttccttgaggtgaggcaaagttactcaagatcatcgctgccactcaaggccttgatagggcaagtgaaaggcatggaccattattatattgatcacagcataagctgtgaaaacccacatcttctccaaacatctgcttggagcattatcatcgcatagtttgctctggtgttcagggaaatcgctgtttcataggaaatcacatggcagtgggatgggagtgtttcctgacctgccgatggtactggcacctgagcaagcattcctagtcctttttggtctgggcctcttgttctatcacaaccacaagctgtttaaaataaaacgtcaagtcacaggcaggtcattttatcctgcgtgaatcaattgaagaattgaagtcctggtcagctgtgattgttggctttgcaaggaaaaagaaggaacactccaaaatgctaaatgctttgaagaatagtgacatgcaaggaagaaaattccatgcaatttggagaagaaacatttttctaggaatctagtagctgagatattttatagtttaaaaacagacttccaatatcttgagaatacagttagctctacgaaataaagaggagtcaataatatatgcaactctgtagtcattcattattttatccagattgacagaagcagaggaaaccaagaaaaatggaagtggtaaaaaaaaaaaaatgcagtaattgccaatatttactgagcatttaccctgtgctaggccttgttataggcgcttagattgattttcttttcataacatccctaagaggtaggtattacatgctcattttgcttatgaggaaatctgctgagagagattaagtaattttctcatggtcacagcctcagtcttttagaccacggtgtcaaaagaagttcttactgtgagtcagggtggtgcagtggagaaagcgtttggggaaaatcctgacccaaaagtgtgcgttgggatgatgtggagatcattcaattttctcttgtagctacagctttgagatgcacccattggtatccacactggcctgctgtcctcaaatatttctctatgtcttgtttacttgagtagtgcagaaaagctgacgtcctgggtctgctctcgcatgcataggtgaggttttctctgtagctagtcatcttgctaaaccatatttttggtcacaaagaatcaggatgagagaaagtagataaaaccatggaaactcgaggtgccaccggaagagcaaaccaaagtatattgatctgctgaagctataatccaagtactaagtataccttcagaagttgtatgcattgttcttggggcaaaaaggaaatcaaacatctgcccttcctcccacaacctctttacttccctctcttcctaacactgtatctcacatctacagctgcaggcacacagatatgacatacagcttgatatctttatgtgcaaaggcaaaagatggctatggatataggaggtggcatttaaaagaacaatatccatgtttgatactgctttcattatcaataatgaaaaggtagcctttcagcagaacaaagtaaggtacaggtcgtttggaagccatttcagtcattcacacagtgtgatccaccattacgaagcagaatttgaaatcaaaagacaatagtacccatatacatcaaactaggagttcaactggggtcagtccttggactgcacatacagagttgggctgcctgactctcaaaacattgcccttgctaatttgcgttgctcacttcctattgaatcagggatgatttttctttgctgtagtgaatcagccctgctacactgcaagaatcaagccgattcacaattcacatcaattccaggagtgacggccagatggcagcatctggctagtcagttggtgagtgagtccacctccagtcttgattaaactctgctgctgggaagtagcaattctgagcataaatgtctttgatatcctgaatattttgggtgtgggatgagagaggcagtagatagtggaaagagcacagggtgtagactaagataggcctggattcctttctttaatctgtcaatgaaagcaatgaatgttctgaaactacatggcaatgctttttttgttgccactctggcttttttttttaatgctataaaatatatgcctatttttcactgccaagaggtgacaacacaatgatgctgcaaccagagaagacagacagctaccaacaactattgacaagacagaaggaacatcaagaatagatgcaagacaaagcaatgtatctccatggcctagattttttaggttatgcatagaaacagcaaggagaagaagacacaatccaagttttcttttgagaatattgtgctgtttaaatttattttttaaacatttcttagcttttcttattagtcaatttcataagcctgggaaacatctttactctatccatttaattgcatttgttcattagcttactcatttcacttattagttcattcaaacagtagctattatcaactgtcttctaagaactgtaactgggtattctggttttgcttttttttaaaaaatagaattaaaaggatttccaaaaggacctgattttacattagaattagaataatacattttaaattaatgtataacatatattattctagaattagaatagattttaaatcacattagaataatagccacatgacaaaaaagaaaagaaaaataataaaattaatgacaaagaaaaacaatagtcatgtgagaggaaaggcaaagcctaaatattcctctgtcctcttcctccacctagattcccagatgtaaggtattaaaagtagtttgtaaactttctgtgacgtatgctgagtctatccaaactgtcgggaattggagcctcccgggaaccaaacactccccaaagatcatacacctacggagttcccccaagagacacacaactgcagtttcatgtaggttcaccttttctctctttttatactctgtccacacaaacctggcagccacgcagtcagtccctgccctgtgtcattgtactggccacagcaacttctctctgtaaatgagaaaggtcttgctttcagaaaagatcatgtttgcaaactactcactcttgaggaagaagggtgggaaaagtagcagagatgagtggggagatggtgcatataagaaggaggaaagaggagactatggagtcaggatgccggcttgctattctcaacacctttttccagtgcccagttcttaccttatttctcctgccccttgctttcttttctaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacctg

SEQ ID NO: 36715 - DNA, 36148 bp, Homo sapiens
ccactgagcagccaaccgcagcctctggccacaaggagagcggagcacaggtagggcaagaagacagaaggccccggtggtgagtggagggcttggtggtccctggacacccctcactggccacattctccttgcaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcaggtgaggtcagaggagggtcgaggtggggggatgctggaggaggctttgtcagctcgtcatgaagagccctttaactttatgggaagactgacttttctttctaagtgggagacccagagcactctatcaattccctggtccccacatccagcctcaagaataggctccaggccattcagaactttccccagctcttccccccaagcatagagacgcttcactggcccctggactggctgagctgactaaaacagcttccctctctggcctcagcccccgggtcatgtcccttcatccttcggcactctcgctcttgccactcctttctccgcctacctctcccttacctgtcatgcccttgttgtgtcttctttgatttccactgtcatttcccacacctgttcccagtctattattcccctctgctccctctccacctgttccttccacctgccacctgttactcccattatctcatctgcctgttccctgaagcaggttccctccacccgctgctgctggtttctgcagccgcccattctccctggtgtgctctctgcctgccttggctcctactcttccctgcagcccagggcctgggctctccgctctgagcggaaactcgtccaacggcctccctgtcttccgggggaggagttgtcatggcaacaagagtgcggctgccacctgacaccaccagtggctggcatggggctgactcacccacacaccccaaggccacctaccccgtctggcttcctcctccatcccactcttgtcattgccattgacctgctggctgcccagcccagcccaacccaacccagtctgaggggtcccagctactctcaccgagaggtggtgctccgagtgggggtgggggttggccactagaagaagagagactccaagggggaggttcccaaacctggccacatgttttacaggatcacccagggatgttttttacaaatacaggtttccaagcccctccctagacacaataagttagaatcttggtccagaactcaggatttttcaaaagctccccaagtgattcttttgagccagctcagcaccagtctgaggacccccttgtggcagccatagcttcccaggaccccttctcattttctcctgggcctctctgtccttctggttgggtcttcaggccggctgtgaaacactcctaccagtgtgtctatacatcagagaagacagaaggtgtgggttatggagaatgtcatgtttggggaaaatgttcctggcactctggttttggattcatgtagcctctagaactgtcatgatgtctatgtgtgtacaacatgtgccacccaccatgtttgcacacatgacaaatgccatccaggactgtcaccatgcctgtgtacataggacacatgcctcccaggactctcaccatgcctgtgtacataggacacatgccacccaggactgtcaccatgtctggctgcacataacttgggccacccagcactgtcaccatgtctgtgcacacatctgtgtgacctcgtgctctcattgggtgtttatctccaccactgaactgggctctcctgaagaggcagctctgcatgggatttgcctagcactgtgtctccagccagtaggtgtcaaataaacactgaatgaatgaagatgaggaagggcaagtgtaggctgcacatgacaaacgctgaagcccagaggaagggcgcctggtatatgtgcccagcagcggggcgtctgggggcagggatggcctggtggaggatggccctggtgggccagagggcagggaaggggctggcactggaggtggtgataagcaagtggaaaggatggtaacagccctcgtttcacagatgagggagtgaaggaaaatgcctcgcacagtgcctggcttttcctctttgaggatttcctcgtttccagatttctctttgtctgtttctgagctggggctcaaagcccacacatcctggagaaggacctcccagagtcacccagagaggggtcgccctcgctgttcctgcaaacctctgggaaacaggagtttgcattgggggcccctctcgtgggtcctgtgcattgttaggtaacttggggcctgatgggcgggtcttgaaggcgctggcagtgccctcctccgccgccccgcagggcctggccctgcccccgccggccacactccgcctctctcccctccccaacactgtccaacctgtttgtctggagccgcctgtctcctctcaccgcagccaggcgtgcccccactctctgtctcaggagttcgggacaccccgtaactctttttgccactccttgaaattcccaccattcttgaatcccctgacgctggactccagcctgaggttccactggggaacagaaactggccccctgccagcggggagcatggactctgggccctgggctctgtaactagcagctggcagcatgaatgggaacggagtgagcagggtgcacgggaacggcctgcatgaggccagcgagttttactatgaggctgtggaaggggcccacaaccccgggggcctcctgctttcaccagctgctttcatcaaccctgctcagtatgccagcgtgctggaaggacgcttcaaacagctgcaaggtgaggcccgggggccccctgtggggacgactgtgcctgggcgagagggacctgggtgtggggagagtggccggagctgaggacctggcacaggacacagtgtgactccagtgtttgtgttgggagacaacgtgatgcagcttagaggggataattacaagaggccggaaaatacacagatgtcaacggaatggggaaaggcttggacctgctggcagggaccgtgtatgatggcatgggtgggtgtgactgccgggccttggggtgctgcatggagcaaaggcaactagccatggagggcgtgggggtgccagcacctggggaggcgccagcagtgcctctgaggtggatccggatctggcggtggagcgctggccaggacagttaggggaggcggaggggtgagccaggcccagggacctggagattgtgttttccaggcctctgagcgtgtgtctgaatgtgtacacgggggcagtgtgtgtggaagcaaagggagtgtctcgaaggagaggatctgtgcaaacaggcccaggtagatgtctgcgcaggtgtgtgttcactctggcacaagtgcttaggtgtgtttttgggaatcactgttgtgtgtgtgtgtgtaaggatctagggatgctgtgggcgtcttgtgacgtgacacttggtttctggtgcttggctttgcccattttcctcctagttgccactaattctgtgtcttctgactgtgtgccaaaatggcctcaccccagggtgcccagcagtagggcagtgcccctggatccagcaatggcctgtgacccacgctcctcctggctcagatggggcctgtagacctgccgggaggccccaaggcaccttggtttcatgggtgctggggagcatggggccgtcccatgttattaggaccccaggtttggtgccagtatagtggctggaggtgaaagacacggagcgacgtgggtgtgttgctgtgtcttatgggtgaggtgcttaggaatgtgagattaagggatgagtctttccggtttctgagatgctggtgctgagacggaagcaaaagtgactcttcagaccccagccacttgggttgggtccttgcacagggctctctgtgggaaagtggcagaaatcctcatcaccagagcagtttctgatgctttcactttgtcacttagaacgttcttaatttttattttcctacggaacctagtatttacttcccctcttcagtagctcccctcccctgtgggctgggcagcagggcattgcctaacttttttttgagattggtacctaactctgcctggctttttttcccccatgtttcctggcctcactgttttcccagttcccaactctcaacatcttgttcttctaagcaatggggtgtttatgtcctggaactggatccccttgcagccagctgaatgtactgtccccaacccccagaagcagaggagcctgccttttctttaagttatccaaggacagtaagctgactcaggaggcctgcagcctctataccatcaagtcctaatgaccgcttggaagagccgctgcaataattttagcccacaccttctcctttgtctgcaaccaaaagagaacagccatacctcccaccggcctgggcagctcttgctctccttcgggccagatcacaccactttataacagcagctcaccaaggagccattttgtgccaggcaccaactagttgttttatataccttatctcatttaatcaacacaatgacctgttgaagtagaaagtgatgttcccattttacagatgagacattggggctctgatgaatgaagtcacttgaccagcattccactgcttccacgactgccccatcccagcccctccctgcatgtcccatggtttctgaggatgaaaggtcttcatcctttcttctcaaagcctattttcttttcttttcttttcttttttttttttgagacggagtcttgctctgtcgcccaggctggagtgcagtggcacaatctcggctccctgcaagctccccctcccaggttcacgtcagtctgcctcagcctcccgagtagctgggactacaggcgcccgccactatgcccggctaattttttgtaattttagtagagacggggtttcaccgtgttagccaggatggtctcgatctcctgaccttgtgatccgcccgccttggcttcccaaagtgctgggattacaggcatgagccaccacacccaaccttcgcctattttctgtctttcatctttcttctttaccttgcttatgagctcattgcaagttacgggctttcctcccggtcatcttccttcccttcctcctccttagaggaccccgcttcccatctctcaggcttctccatcccccacccctgccaactggtgtttagaagcaggcatactgaactcgagggacagaaataaacccatgttgccaccacagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactggtgagctgtggtcatgaagggaagtgggggggccttagaaaagtgtccaaggggaccagctggaagaacagccctcagagagagtgacggcacagggcgggaagcagtggctccctctgctcagaggatgggttcatttcaagtgcctttgccacttagattacataggagcattgcttcatggagacaggaacagtggccccattgaaaacatttcttttcccacctactctgggtgcaattaattcccttgggaatcttaatctgcccaagcctcatctgtaagctcagctttggctccagccctggggctgtgcctgtctgtgttcctgaggtaggtcatggggaaggtgtgcaaagctgggccctgtgaaggctggggaagaaggtggaagcccacagtcccgtgccattttgcccccgtccctccacagccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccaggtaccccagcacactgtcacacagggtgtggttcctgccctggctctgcaccgcaagccgttcctgctggcccatgacacaacaaacacaaagatggaggatctagaaccttatgtagcagctgccatggcggcgctatccaagcaccagatcagtggactcccctctttcagcagggtagaaaccagcttgggtgaatgtcacacccctgtggcaaattccctgtgttctggtctgtgtgttggtcgtgtgcaatgggaccaggaccacaggttggtccacaggagactggaagttttaccaactggtccttcaccacagggatttgggaacttctagagggtctggtcactggcaccaattccctgccataaactctgcctgcctcccccaatggaacagtcaccctcctcctcctcatgccccagtgtcctcatgccatcacagcgttcctgatcacccccttccttcccgggttctgtcggcttcaccttggagagccagcttttagagaccttggagagccagctctcagaaaatgttcactcttctgcctgcagttccccacctggagggaccagcaccctccactcagacacacccattcttcagcatcctaccctaatctgctgcctcaaatcccttgcacccagtgttttgtggtccctggcctaggttgaaaggacctcaggctatgcctgtccaccccattaccacagtctaaagagcagtttcctgccatttatctgagcatctctgataacaccaggagttcctgtccagggactgagggccctgcttgcttccttcctagatccaagacatcagtgtggagacagaagacaacaaggagaagaagtcagccaaggatgccctgcttctgtggtgccagatgaagactgcagggtgaggacaccctgggcgtgtggcactggagggtcagtgacccccaggctgtgctgggctccaggaaccatgagctggtgactgccctggagtcatagaacagagctcagccctactcaccattttctgaatctctgtttatagttatcccaacgtcaatgtacacaacttcaccaccagctggagagatggactagctttcaacgccatcgtgcataaacaccggtgagaagatggggttagcaaacgcagcagagctgctgggtcggctaatgacctggggtgcacatgtggagacagagatgagatgagctgcacagcagtcagacggaaggaatagcactcggagcagaaccagaacatgggggtgcagggctgcgcagagcacttgtgatgggaagcaggggaggtggtgtggggaggggctgtgagcagcagtgtgggtttgggatgcctacttctggacaaaattgggtcggtgacttagggataaagattggtgtgggtttcctcttcctcttcgagatctcacatgtttctgatcccttctgtcttgcctccccacccaggccagacctgctggattttgagtctctgaagaagtgtaatgcacactataatctgcagaatgcattcaatctggctgaaaaggaactgggacttaccaagctgctggatcccgaaggtggggccagagctatgtgaaaaagaggtggtagggtagagacaggaggtggaccagtggttgccaggggctgcggagggggaagacatggagtaaccaccaactgatacaggggcttctttggtgggggaagagaatgttctggaattagaaagtggtgatggttacacaaccttgtaaatatactgaaaaacacgtggttgctcacacccagcactttgggaggccaaggcaggaggatcacttgagcctaggagtttggtaccagcctgggcaacatagtgagaccccatgactacccctcccccccaaaaaaaatatatatctttacactgaaaaccactgaattatatacattgaaaggttgaattttatggtgtgacaatcatttctcaggttttttttttttttaacaaaagactgtaggtaggaagaaaggcagcccagtgacagaaagagccctggactgtgggttgtgtcccaggcagagcacagaggagctctgtgacatacagccagtggctagcctctctgtggctcagtttcctcatgtcttaaaagagagaattggtctctaagggctcttctgaaattctaggattctaaattaagctacatgttgctggccacggtggtacctgcctatagtcctagctgctagtgaggctgaggcgagaggatcacttgagcccaggagttctaggctgcagtgggttatgctgattggatatctacactaaattcagcactggtgacctcctgggagcaggggaccagcaggttacctaaggaggactgaaccagtccaggtcagaatggagcaggtcaaaactcccacactgatcagtagtgggatcacacctgtcaatagccacagtactccagcttgggcaacagcgagacccatctctatttttttaaaacaaatttttaagaaaaaaaattaagctgcatgaccttccactctcacccagaactggcctgtagtcagctgaccttgctgattggttcctgtggttctggtcataatgccgatgagatcgatgagatcagtaacagccactgggctcttttttttttttttgagacggagtctcactctgttgcccagactggagtgcaatggcgcgatctcggctcactgcaacctccgcctcctgggttcaagcaattctcctgcctcagcctcttgagtagctgagattacaggcgcatcccaccacgcccggctaatttttgtatttttagtagagacagggtttcaccatgttggtcaggctggtctctaactcctgacctcgtggtccgcccacctcggcctcccaatgcgctgtgataacaggtgtgagcccccgcgcctgactgcgattaggctcttatttgatacctggttctgcacttgatgtgttttaatcttcacaacacccctttgaaatcagtactgttgttatcctcagtttatggaagagaagatgggggcctataatgggtaagcaacttgcccaggtcctccggcagatggagctgagattggcgttcaggcagcctggctccagagcctgtttcctccgctgcctctgggaaagtggagaccaatcttggtgcaaccagaacagggaggagagaaaggctcgcctgctggaggtgctccttaagttcactgggtggatgttcactggtcttggccattttctccctgttttccattctacctgtagccctatcacctgggcctttttactgcagaatgacaagtgtcagcgagctagcaacagacataggcttcatgcagtgctccttggagagcctctgggtagcatggctgtaattcagaacctggaaataaagctaagcattctgtaactttccgagatgacttcagtggctcctgcctgcccatgtatttccagaaataggcaagaggcttctggtctcatagtcttacctttaggataaaatctggcctatttaaaagaacccacagatttcaagttatggtcagcctcagttgtgcgctggaagccaattcggcttgaaagacactcccctccttgggcccacagctgagctttaggattgaggttagaaacggcgtgatcacacctggagatggtgctgagagctggcctctgtccccactgagctgcagggatcacagggcccatcgatctgagcatcctaggttcaggaggcttagttcataccttccgtcccactgcccctcaatccattgacttcttaaacattattctagcctaaaagtccatgatccatccccacatagcaatgctgtttcttttcttgcttttcttccccaaacaactgattttggtctccacggggaactctgggtaaaagcttccttgtgcttctggggtttgtgctctgcttggagggcccttcttgtttccaggagaaggggaaaaaaagatgagctttttggtgcccttttcatttgaatgggtaagttgtcattttgctctaaaaggagatggagagatgtcagccttggaggactgggcaggcccagggtttggggtaagtgatgcaagttatggatgaacttctgggaggcctgacccaaatggtcctctcttgcagacgtgaatgtggaccagccagatgagaagtcaatcattacctatgtggctacttactaccattacttctccaagatgaaggccctggccgtggaaggcaagagaattggcaaggtactgtccatgggcagtaggcataaaggccagaggaggcccggctgaggggtcttactgccctagtgcaagggcagggtggagctgcaggactgggccagggaccctgtggctgggactgtcacgtccctgtcttctgcctcccaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtaggtgtccctggggccccacccttccctgagctgtgctcccacgagaggaagcctaaattagcacagccttcagggagggaaatttggcagtacataaatgcagtggagatttcccacaccagaagcatccaaacaacatagttgatacaaaataaaattttttaatgattagtcgtttttaaaaatcatgctgtgggccgggcatggtggctcacgcctgtaatcccagcactttgggaggccaaggcgggcgcatcaccgagaccagtctggccaacatggtgaaaccccatctctactgaggtcgggagtttgagaccagcctggccaacatggtgaaaccccgtctccactaaaattacaaaaaaattagctgggcatggtggcacacgcctgtcatcccagctactcgggaggctgaggcaggagaaccacctgaacccgggagacagaggttgcagtgagccaagatcacgccactgcactccaacctgggtgacagagcaagactccgtctcaaaaaacaaacaaacatgctgtggaaatgattgctatgatgtgttgagtcagtgcgatccatcagataagattactgatcaggtgtcatggcaacccaatcctagcataggatagaggggactggacctgacaggcaggtcacaaccggcaacatgggtgtggctggtaacgtgagaattgcagaggttcttatcatttcagtattttagcaattaactgttccaagtatgtgattgctgttaggcaattctgttcagtacctgccaaaacgtctgtgtttatgctgtcatggagttcttttggagttaatatatatcagctctgaaactaatattagtccagaaaacaattgtttctatacattccagggaatgatttaaggtgtaccctttaacctaggaagttgtcttctggacattaaacaaagatgtagcttcaaggatgtttatcaacacaaccactagaaaagaaaaataagtcatgggcagccactgaaaataatattaaagaaatgcatttattgacatggaaaggtgttcatgaaaaataagtgggggaaataggttataaaagaattattttggctgggcaccgtggctcatgcctgtaatcccagcactttgggagactgaggcgggtggatcacttgaggtcaggagtttgagaccagcctggccagcatggtgaaaccccatctctactaaaaatacataaattagccaggtgtggtggtgcatgcctgtaatcccagctactcgggaggctgaggcaagagattggcttgaacccgggaggcagaggttgcagcgaacccagatcgcaccactgcactccagcctgggtgacaaagcaagactctgtctcaaaataaaataaaatgatgttcttttggttagcccatattttctggcttccacataaaaagtttatattgcttttgtaagaagaaaagcaacacaggacacccatttggaagagtaaagagtccttgtgaccctcgtgggctttaattctgaccccaacccggcctcctgcctcaggtttaccgagaaagggaacttggaagtgctgctcttcaccatccagagcaagcttcgggccaacaaccagaaggtctacacgccccgcgagggccggctcatctcggacatcaacaaggtccgtggctgcccacaggccacccaccctcagggcaggccctggcccagatgccttgcacacatccccaaacccggggccatgtcgaccttcaccaagttctactatctgctgccccaacttgaaactcgagcactctgcccagctgcccacactgtgccagatgtgattctcccatcctctcaggcacacggctccctgtccctttgtctgactctccatacgaggtcacataaggaaattatgccccaagttcctcagcttgttaaacctgtccccaactcactatcccttcttttatttttttcacaatattgtaagattactaaaagtaaaaataaggttcgcacacagtcctgccaacacaaaggaatcagatggtttccactgttcgtgctccctccagtccttttccagaagcttctacatggcttcacagactcccagcgctgccctgtttcctgtttccacgcccaggcgtctcacccactgcattccacggatccaccagaccgagcttccatgggacttaccatgtgcctccagccccactgagccctccccaccctgtcccttccactaaccctgtccccaccccataggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggtaggacttgaggctcctaggatgcttaggctggtcagaactgggagagagacagggtggataagaagccccgcggggtggagagacaatgaaacacaaaatccgtcacctgggtaaaaaggcctagaggtccgggagccaggggccagagggtgggacaggagagagggttggtgagacaggatgggggtgggatagagagggaacttagagccaccgcatggagctgggatcttgcaggccaagtgccctgcaggacagaggagcaggcagaggcactgtcccttggtccccacacctcctctccctgcccccgacacaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaaggtaccagtgaggcgtgctgggtggggtaagagtgatcaagagtcgagggggccccacagtgggtgcgtccgcccgtctgctcggccgatctctgtggagtgtgaaccagcacagggccctgtccccagttgcagggaacaaagtaaacagggccctgtccacatggggttcgtgtccacatggaggaggctgatgacaaaacccacggacctttccgtaaacaaaagagcaggggccataaaaccactgatgaaactggaacagggtggtgtgaggggctggtcagacaaggcctctgagaaaataccatttaagccgagaccagaatagtgccaggagccagcacagagagctctcaggagagaatgttccgggcagaaggaacagccggcacaggccctcggcctggatcagcatggtgtgttcaggatcagaaggaaggccggtgggctgtgagcatgaggagtgggggccatggactgagatttgggagggcacggccagcccactagggccttacaggcctggtcagggagtttggattttattcaaagtaacatggatcctttaaagtgatttgaaggggccaggcgcagtggctcatgcctgtaatcccagctctttgggaggccaaggcaggcagatcacttgaggtcaggagttcaagaccagcctggccaacatggtgaaaccccgtgtctataaaaatacagaaattaaccaggtgcggtggtagcgcatgcctgtagtcccagctactcaggaggctgagacagcagaatcgcttgaacccaggaggcggaggttgcagtgagccaagattgcaccactgcactccagcctaggtgatagagcaagactcagtcaaaaaaaaaaaaaaaaagcagctaggcaaggtggctcacgcctataatcctaagactttgggaggccgaggcgggcggatcacctgaggtcaggagtccaagaccagcctggccaacatggtgaaaccccatctctgctaaaaatacaaaaattagctgagtgtggtggcacacgcctgtaatcccagctagtcaggaggctgaggaaggagaattgcttggacctgggaggtggaggttgcagtgaactgagattgtgctactgcactccagcctgcactacaggagcgagactccatctcaaaataaataaataaataaagtgattagaaggttttgagagggggagagatttgattgtaccttatgtttgtaaaaaagtcactttggctactctgaagaaggcctgtgggcaggcagcatgacagcgagaccgttagaggttgctgccatcttccaggcgggcagcggctaggagggtggattggggagagatgtggaaggaaggctgctgggtgctggggcggagcggtggcggcaggagggtgtcgatgattctgaggctgagaagattagtcacagcaaagcttccaagagcaggagttagttagaacattgttccacagcaggggagttcaggataaggaggtcggggtgccagggcagaactggggtatctcaagtatgtgtgagcaagcaggtttctcacctgggtgcaacacctggggccgtggagaagttggaagaaaaacgcagccaggttagcgcgtctgtgctcaggcgggcatgtgcacttcatgtgtgcctggcagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaaggtgagaagtcagcgaaggcactggagagggaggggctgggaaggagcacatcaagagccgaggtggaagggttgggaaacctggggacgggaaagatggtggccaaacgatggtgactgagctaaagccagggagggaagtccaagagagtgtggtggcagggagcagccggagggctgggttaaggctctgaccctctcctgtgactttctcagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagagccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggtaggcccctcaggctcctagtgggaccagccttgggaggtgggggtgggggggccaggatgtgggtggtgagtccctccataaacttcctgcctcacccctttgagtcttaatggttgtccatttctagttttaacaaaaaatgttaaccatactcacaagtagagacatttcaccacaaacccctctacacccgtcacccagattcagtcattgccaacatcttgctctatttggttctctgcccttttaaaaagcaaatccccaagattagcacatccctcctaccttcttcagggtgtgccctttaagaaatacaaggaagcggccgggcacggtggctcacacctgtaatcccagcactttgggaggccgaggcaggcggatcacgaggtcaggaggtcgagaccatcctggctaacatggtgaaacgctgtctcaactaaaaatacaaaaaattagccgggcacagtggggggcgcctgtagtcccagctactcgggaggctgaggcaggagactggcatgaacctgggaggcggagcttgcagtgagccgagatcgtgccactgctctccagccttggcgacagagcgagactgtctcaaaaaaaaaaaaaaaaaaaagaaaagaaatacgaggaagcattcttacctacaatatattattttcaaattgtctgtgtggacttaaaatagctgaggctttgaagttataaaccttttagacagagacactaaaatagttttatttacagaataaatcttcaaatcatttattcaataataaatcttaaaaatttttttatagaaccacaataccattatcacatagaacaaaattaggaatttcttttttttttgagatggagtctcactctgtcacccaggctggagcgcagtggtgcgatctcggctcactgcatgctctgcctcccgggttccagcgattctcctgcctcagcctcccaagtagctgggactacaggcacccaccaccatgcccagctaattttttgtatttttttattagtagagacagggtttcaccatgttagcgaggatggtctcgatctcctgacctcgtgatccacccggcttggcctcccaaagtactgggattacaggcatgagccactgcgccgggtcaggaatttcttgatatgatctatgatcaatgtgtaatcaaatttcctggtgtttaaaaaaatataattaggtcaggcctggtggctcacacctgtaatcccagcactttgggaggccaaggcaggagtatcacttgattccaagagttcataaccagcctgggcaacatagtgagactccacctctacaaaattttttttttaattagccaggcatggtggcaggcgcctgtagtcccagctactggggaggctgaggcaggaggattgcttgagcccagaggtcgaggctgcagtgagctgagatcgtgccactgcactccaacctgggtgacagagtaagaccctgtctcaaaaaaataaataaaaataaaaatgtaattaaagattttttttagttttcaaggtatcctaatgtagaggttaacaaactgcaacccttgggccaaatccagcctgctgcctgtttctgtaaataaagttttttttggtttttttttttttttttttttttgagacggagtcttgctctgtcccccaggctggagtgcagtggcacaatcttggctcactgcaagctccgccgcccgggttcacgccattctcctgcctcagcctcccaagtagctgggactacaggcacccgccaccacacctggctaattttttgtatttttagtagagacgaggtttcaccgtgttagccaggatggtctcgatctcctgaccttgtgatccacccatctcagcctcccaaagtgctgggattacaggcgtgagccaccatgcccggtctgtaaataaagttttactggaacagagctacactcgcccttttgcgtattgcccgtggctgctttcaggctacagcagcagggctgaatagttgccgcagcagctgcatggctcacgaagcctataatatttaccatcaagcccttcacagaaaacatttgcagaccctgccctattagaacatcaaatgtcggccaggcgaggtggctcacgcctgtaatcccagcactttgggaggccaaggcgggtggagcatgaggtcaggagttcaagaccagcctggccaagatagtgaaacacccgtctccaccaaaaatacaaaaattagctaggcttggtggcgggcacctgtaatcccagctattcgggaagcggaggcagaaaattgcttgaacccgggaggcggaggttgcagtgagtcgagattgcaccactacactccagcctgggtgacagagcgagactccatctcaaaaacaaaacataaaatgtccctggaagaagttatccttcacattttcatcactcagacaaatatttttggttattacttcattttctaacacatattagtgggatgagacccagataggcagctaagggggaagtcccaggaggctgagcagctctgataaagggttggccccatgccagggtctagtttgacttgtgtgtctgttcctgacctttacctttcaccatcttttgagcatttctagcgatgacagttattctgcttgttttgggggagttgtgggttccttccttgatgcacagatactatgaacctcataggctgagaggcagagagactcctgcagataagcctcctggtgaaggagacaccctcctgggtgtttaagagaggtggacttaggtggactgggcacatcgctgcctcccacaattcacgcctggctcttccaccctctcaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtgggtttgggagggcaggaccaggaaactgacagaaaaatgaagcaatggggatggcagtgagaggcaggttttgtagggcctggaagggtggctacaaaggaggaagcaaaccagtctggaatatgttggggaaggaaaaaggatgaaagagatgagagagggggtcaaggtggtctgaagcggctgctggccagaaagggaggagtgaaggggagctaccaagagagagagaagcagggaagaagcttccaaacaggcctggccagggcaggaagctgaaccttccccctgctctcaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggtgaaagtccagggcaaagtcccaagcaggaggaagagcaaagtagggacccggggaaatgtgaaggagcaggatgggcaggaaggacatgctagcaaaatggggcagcgcagtggttcacacctgaaattccagcactttgggaggccaaagtaggaggatcacttgaggctgagaatatccagaccaacctgggcaacatggcaagaccttgtctctacaaaaaaatttttttaagaaaatagaagaattttttaaaaagaaaaatgggagccagacaggatggctcacacttgtactcccagtattttgggaggccgaggcaggagaataacttgagctcaggagtttgagaccagcctgggcaacatagtgagacccccatctctatgaaaaaaaaaaattaactggacatggtggtgcatgcctgtagctccagctactggggaggctgaggctggtggatcactggagccaggagtttgaggctgcagtgagctatgatatgccactgcactccaacctgggccacagaatgaaaccctctctcaaaaaaaagaaaaagaaaaaagaaggaaaaatgagaatgaaaaagacgtgaatataatttactaaaactgactttagaagaaatagaaagcccagtttgtcatgtaactgttaaatggaatcaggagctagaagtgagatagaacaggatttgggctggggaatggaaggtccttcccacccagcttccctgtgactttctgaggctcccatgctggctggcagcctccctgtcttcagagctctctgggctaccctccctgtctgcttgttggtccctacctctcagatttgcccctgggtgggtccctcctaggggggtgaattgtgctggggaaaatgagctgaatgtcatccctcccacacaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggtctgatgaggacagtccatgaattagggttcccaggggggaatcggagaaacagggtgacctcaaagataaacgtggcacaggaaacccacagatggggcaggagctgacagagaagtagaggggaagaactaagtggttggagagggctgggagattccacccccaaccagggctaaaaggaagtcaggattcctgggtagcctcattgtgctcccggaaggcgttattcccctagaagaaatggaggcccctaggttagccaaagggtcacaatcctttcacagcaaattccagagtttcacaagagggtgtcgttccaggcacaagaagaatcaagacgcagcgcagcaatttctgggccgtcttcgggacaaccgggagcagcagcatttcctgcaagattgtcacgaggtgaggctccctggggccccgggatattccctagccatccctttctcaccttgagcctagaataagtccagcacaaggtaccggagactgtgagccccttcatggcttcttcccaaggcgcccacttctcctggctcactgtggccctgcttttatgcccccctctcccctcccttggaaatgtccctgttttatgtttggtccagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggtgagcagtgctgtgggggctgcctctgggcagagtcccccatggtacgggggagggcctggctccaggacgtggtttttgtcatggttagagattgtggggttctggtgccacagctccatggtggaaagttatggcctctgggaaacaaacgtctttgttggagacaaagagtgggacagtgagtccagaaccttgataaagtacaaattagcaggtagcgaaactgcagcctggatttaacgccataactgttcctgagttcaaagcaggatggtgctcttcagcaggctctgcaaaccttgtctggaaagggcttgggctggatggtcaatatctgaggctttgcagtccaaacagtttctactacaactactcatctctgtcgttgtagtgcaaaagcagcctcagagaataagtgaatgaatgaacatggctgtttcccaataaaactttatttgtaaaaacaggcagtgggccagattaccccgtgggctgtatgtagtctgccaatccttattttcgagtcttgccgtccctggttcttggtctcccacccagctgttcctcaagagtcaaggacagataaagctttatatctgctcagcaagtatccctacagaacatggtacgtgctcaacagtctgcgaggcactgcagggtctacgaaaagacactttccttttctcaagggcatgatggttgggacaaaaggagaccagtgtgctttcaagtgtttccattcgttcagcaaatatttacttggtgctactatatccaaagcattgtattaggccctgcgtggggtccgaaagggatcccatggtaggctccaccctgaaggaacaacactgtagccaggatatgaggcatatatgcaggtagctaaatcgaatccagagcagaatctgatgagtgctgtgagagtggccccgttgaagcctggggaataaggagagaggagatatggaaattctagaagcagcaacatccagggcagtccatggaggatgagtagaatttggacaagtggagatatggaggaaaagatgtttccaggtagagaaaaccaaacagaaaaccagtggtaggcagtgcctgtttgggagcaagggggtgagtgagtccagcagcagcacagaatgtgtgcagggccccatggaagaagaggtgggagagaagccccgggaagtcctgaccaccacatgcgtgtgcttccaagtgttgattgtgctcagggttgtgaagctacccaggcagtgctagcctttgatgctctccatcctgacagccacagccacctgcaaaatggcctgaaggcagtgtctgggtttgtgttcccctagaagcagaccctgaaacagtgattctagggaggtgtccccgggaatgatcagtaggggggtggagccatgagaagggacagaagtcatgccagttacccccatgggcatcaggagcccaaccctcatggggcattctgcgggggtgtagatggaacacagaacacagcactctcacagccacggcacaaggatgctgtgtgtttatccatcagctccctgtctgtcactggttgagggctgcttctgggcttgttaactctgtggctcttccaatttgccttccacacagttcaagagagcacacttccctcaccaccccagacacagaaatcctcaagcagaaaagctggaagtggggaaaccaggtgggactcaacttgctatcactgaagtgaagagtaatgagttgagaaatacaaaatgatggcaaataactcaagtcaatgtgcagtgtggtgccagaaaccacaggcaccaaggaacccaaactaaagagagtgcaagggcttcctcgttgaaatgctgtttgagctgggtcttgaaggaggagtggggttcatcagcagtgagggaacagcagtttagaagggattttaaacctccgtgaagagtgtgtcgataagaacacacaaggacttggaattattgcccacacttcaggtctctactgcccgtaaggcccctggtctgctctcagcctctaaagttcaggctaatttgggcactttgacattttctgtcctgccttccaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcaggtgtgctgtgggcctttgatggggatggtgaacagcagaagaaaggggctgcagctttcaagatttgggaggccagctgaggcctggcagataacaccttcactagcatttcccagagtcatttctttgggcagccagtatcagaatctctagggatatgtcgcagtcagggttagagttaggagacagaccccctaataatttgacgatgagaacttcagtaaaaagaaatattaattaggccaggcacagtggctcatgcctgtaatctcagcactttgggaggccaaggcaggcaggtcgcttgaggtcaggagttcaagaccagcctggccaacatggtgaaaccccgtctctactaaaaatacaaaaattagccaggcgtggtggcgcacgcctgttatcccagctacttgggaggctgagggctgagggaggaggatagcttgaacccaggagacagaggttgcagtgagccgtgatcatgccatcgcactccagcctgggcaagcctctgtctcaaaaaaaaaaacagaagtataaattagtaaaaggtggtaaagagaactctatagcaggggtcagaaaacttttttcagtaaagcaccagatagtaaatttttggggcttcatgggtcgtaaggtctatgtcacagcccttcaactctgcccttgtaaggaaaagcagctgcggattatatgtaaaataaggggtatggccaggtgtggtggctcacacatgtaatcccaacactttgggaggccgaggtggccggatcacttgagtccaggagttttgagactagcctgggcaacatggcaaaaccccatctctacaaaaactacaaaaattagctgggcgtggtggtggtgtgtgcctgtagtcccagctactcaggaggctgaggtgagaagattgtttgagcctggagagtcgaggctgcagtgggctgtgatcgtgccactgcactgcagcctgggtggcagagcgagacttgtctcaaaaaattttttaaaaaggggtgcagctgtggtccaataaaaactttataaggctaggcagtgggctggacttgctggtccctgctctgaagaatgcagaatgggaagtgtagggagcagctgacacctctggggttgaggagtcccccaggaaggagcaagatggctgagtctcagacctccttggagagggcggaggcccactgaatggcctggaaatttgctggggtatcacaggccagagcatgtctgaagccagcaagccaaggctggccagcaggaagtggccactagagtgcagcaaaacttgccagagagtaagagccaccggatctcttgcgcactgtggacagttttgctgtaggaggaagaaaagcaccttggaaccgtggaatgccccacatctgctaggcattgtggtgtccctccagcgccctctgctgacaaggcctagattgtgcctgctggcaaaggaggaatgtttccaggggccagttccagtgtctcaaagcagggccacgatggattggggatggagagacaatgaattgataatgggcacagttatcacactaccctggattttttaatttcaatcttttagattcgcgggtgtgggtgcaggtttgttataagttatattgtgtgatgctgaagtttggggtgtaattgaacccatcacccatgtagtgagcacagtacccaatagggattttttcaacccctgcccttggattcttgtgcatataaagttcgagatccactgatccagcccatgaggggatgctctccctgggtgagctgcagtgatgagcagccacagtgggctggatagagactggttggtgtctctgctgggcatgaaggcggaaatgcagagctaacatgtccttcctcctggcggtttgcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattgtgagtcactggggccaaggacggcaagctgcccccagccatgtggttctccagcctccctcctggatgccagggagatgccagcagggctctattccctcttctctttggcattgaccatctcccctatagggagacttggagatgcctcccagaaccagagatgactgttccccacacacagggcggtagccccaggtgtccccactcccactaatcagtccctgctgcttgccttgccctctgggcctccactgaccccctcttcctcttccagttgtgggtgacagagcggctgcccatggccagctccatggagcatggcaaggacctgcccagcgtccagcttctcatgaagaaaaaccaggtgaggcagaggctgaaggcaaaagagaagttcccaggagcctgcccagacttggacgtgttttttcttaagaccaggcccccctcgatgctgagtgtaaccctggacttcagtggctgtctttcctcaccttgggagggtgggtcctctcagtaggagatagtgggggctgggcggctgacgggtgttaccatcgcacccccaggctaggagagggagcagaggacccaggaaggagagaggcacaggggtgaagggtggtctccgggagcacgtggggctggggcaggactttcagcattttctcttctgtggccatgggcagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggtgagggccaggacagagcccagtgtatgtgaccagttctgccctcccctgacctgatgctggatgccactgtcccttcccccaggatgagctgagtgcccaggcagaggtgaagaagcaccaggtgctggagcaagccctggccgactacgcgcagaccatccaccagctggcggccagcagccaggacatgattgaccacgagcacccagagaggtgggtgcagcggcagcccggcccagcctgggggtggagccggctgcaggaacaggaaggtgcagggaatgtggagccttcagtgctgtgtgcacggagccttctagaaagctggaacacagggtgggcgagctgttgggagactcagagggacagggctccacagaacagaccggaggtcagagctacacccctaagtcccacagtgcctccctcactcttcttgcagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactgtgagtgtagggagggcacccagctcagatcaaccgtgggaagagtggaggacccacagggagactaggacctagtcccaggcagagcactgaggggctaaggggcaagaccaggctgagcaggcactgtcctcctggttttgaggtatatgatttgaagaggccgggcataggctcacacctgtaatcctagcaccttgggaggctgagatgggaggattgcttgagtccaggagttcaagaccagcctgggcaacatagtgagaccccccatctctacaaaaaaaatttttttttattagccaggcacagccgtgcatgcctgtaggcccaactacttaggaggctgaggtgggaggatctcttgagcctgggaggtcgacactgcagtgattgcgctagtgcactccagagcaagaccctatcatctctaaatacatacacacacacacaatttgaagaattgtacagaaaggggacatgaagctgagctgagacaagggcaaacaggaaattatcactcacacttttcaacagaattcaacaaaacggagtatgatccacccccccgacagtttgggggcttggaccctcagtcgtacagaaatatggaccatagttagggtatccttgtctgaagcctaagggtcccaagcaccttgaaacgcctttgctgggggtggagggagtctgtcaaatacagggtcagtgggaagcagctgcacctactccttaaccacagggaagaaacctgtcccggcccccatgcagcggggagaggtgggttctgagtttggagtggaggactcgctccatcaggcagggaccacatcccctaacatcacggcatggtctgtccatctgcttcctctaccagatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtctgacccaagcatgaggaggtgggggaggcttagaggaggccatgggggaaatgccggggagagttcccaggagctagggtagagctcagaaatgctgggaggacggcactctttcgagggccatttcgagatgaggaaattgctccaagaaaacatctctgtttggccaggcgcggtggctctcgcctgtaatcccagcactttgggaggccgaggagggcggatcatctgagattgggagttcgagaccagcctgaccaacatggagaaaccccttctctactaaaaatacaaaattagccaggcatggtggcgcatgcctgtaatcctagctactcaggaggctgaggcaggagaatcacttgaacccaggaggcggaggttgcagtgagctgagatccctccactgcactccagcctgggcaacaagagcgaaactccgtctcaaaaagaaagaaaacatctctggcaggggacatctagccactgcattcacacttttgatgacaagcccccttgagagcccatgatgtcttcaggggttcccagtggccaggagactcttcatgctgcgctaaatcagcctgttagtgcttcccaggcttgagctctaggctcacactcagtaagcatggatccttccttcaaccactagaacccatcagcccctgcctgaatccccttttcaggctaagtagcacgttctagcaatctccaaggtctatcacatcctagacaggcctctgaaagttcaactggccaatggctcttttccagatcctcccccagttaagcccaggtgtctagatgagacccaacagggcagagtgtggccagcccctgccttcatctttcccagcacccccactccctggctcctccccctgcttctttggctgtgagacaggcaggaggtgagagtggcagccaggactgaggcaggctgcggctccttggagtcccccgctctgcctgactctgacccggggctccgcaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccggtgagaatcccagggctcagggcctccacgggttgtgtggctgggctgtgatggggctgtgggcagcaggtgatgctgtttctgcctccccccagggatgtgtcctccgcggatctagtcatcaagaaccagcaaggcatcaaggcagagatagaggcccgggcagaccgcttctcctcctgcatcgacatggggaaggagctgctggccaggagccactatgcggccgaggaggtgggtgaggcctgggtggccgggccattctcactgtgcagtgctgaacgctgacttcttggtggctttctgcttcctctcattctctctttgcaagaaacctttcattctctcccctcagtgccattcacgggtttctcgcattctggaaatctctccccagaaccgtctgcctcttgacatcagaaatcactggtcctgggccaggcatggtggctcacgcctgtaatcccagcactttgggaggcccaggcgggcagatcacctgaggtcacgagttcgagaccagcctggcctccatgggttgtgtggctgggctgtgatgaaacatggtgaaaccccgtttccactaaaaacacaaaaattagccgggcgtggtggcgggcacctgtaatcccagctactcggaggctgaggcaggagaattgcttgaacctgggaggtggaggttgcagtgagctgagattgcgccactgcattccagccttggtgataagagcgaaactccgtctcaaaaaaaagaaagaaagaaagaaatcacctgtccccctggatgactccccaggggccgtggaaagatctcacatcctggtgctaactcatatctctgccccccgcccccagatctcagagaagctgtctcagctgcaggcacggcgccaggagacagctgagaagtggcaggagaagatggactggcttcagctgggtgagctgccaagggggccccaggccctgtggggagtggggggcatcctgcaccctgtgggttccagagtaggtgagactaggaaccctgggtgtgaaactcacgatgcccaatcttcgtgctgcctggcacagctctggggcagtggctttctctgtgtccctgttcttgaggttgccatggccactgtgccctgccagtggccactctgacccaccatcttcctgcaacccccgatcctgccagttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcggtgagggacacaggaccccggatgcccactccaacctgctcccctgacctgtgctggcttctgcttggagaagacatgtcttctctcttcccactgcaccagtggcccccagatgtgagctgagagtgccattgtcaccacacctttaggaggtgtcagttcccctgggtgatgccgagacaccttctcccgctttgtttcttgtccccaccatcttctcaaattctgttctcctcttatcatatttcatcaaattagagttgagacatttcagctctccctgtttccctggccctcttacacgcaaccttctacacgctgaatgcagcattttttgacagctagaggagcgggagaaggagcgaaagagaaagagggaggaggaggagcggcggaaacagccgcctgctcccgaacccacagccagtgtgcctccaggggacctggtgggcggccagacagcttctgacaccacctgggacgggtgagagccaggatgcctgggtaggaggaggcggctgagcccaggccacccagggactaatgattctgtgttgcctttggtcatcccagaacccagccacggccaccaccatccacacaagcacccagtgttaatggagtctgcacagatggagagccctcacaggtgaccccactgtccctctgtgcccccatcggagtcgtagcccctccacccccgcacatccttttacagattcttgtccttgcagcccctgctgggacaacagagacttgagcacagcagcttccccgaagggccggtgagttcccctgcaagtgtggtgttgataactgtgaggcgaagggtccagagggggtggtgagtgcgggtgggggagtactggggatgggatgggagagggcagaggctcacaggcagcttgggggcaggaagaccaactcctggacacggagcttcctggcacccaggttagggatctcccgtctcaacctttgacactgacactgattcccccccagggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtacagcctctctggagcctgctctcagagggcacttccccagagcctctgcccagatagagggagggatgccctttagagtacatcttctgggcaaagggtaggacttgggaccagagcggggcctcaggggaggaccagagggtgtgaagaccgtggcctaaagatgggagcagaactggaagtcctaggacacccaagagggctccaggttgcgggcgccactgaggccggccagtcagcaccgcgtccctcgcaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctggggtaggaacagggaacagtgctctcgggatgggaggagagttgggagtgacacaggtgagccatgagtcaggtccagagggaggggagttcctgtaaggagcctgagtggagtaaccaggccagccacttggggatagtgtagatgagggaggcggagattctggttgtctccacaccaaggggagcaggagaaccaagacccaggcctgacggctgccaatgtcaaggtgaaaaattacccagggtgggaaatccaaaggtagggatctgggaagacctccaggggcctgtccctgcctgccagcaagcagccggagcaggaggcccgggctggggtggaagtgagctccccctgcctctggggccagtcagaaaggatgtgcttctgcacagtctggggaagctgaagaatgtgcagagcgtgtctggtccggctctgagggctgcagccagatgtcccagcctggtgttgggtcatgattacgctctcaccagcagctacctggcagatccggattctcagctctgccctgtggcctctctctcccaacagcttacaggatggaaaagaatatttattccaggccaaggatgaggtgagctgtccttcgtgttcctctctgtccgtgccattccagaagcttccagctgcagactccccttctttccctgtcctccctctttttcctggtcttgtcctttgtggtaagactggatgtgtgcgacggccgcaccaggccgcactccctgtctaagccggccacattctcctaatagcatgaaacagtcagctcactttctgcctcctcctcttacacttccctgctgtccactgcggccaactcagcacagtgtccttgaagctgattgagggtctttccatccacaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctc

SEQ ID NO: 36716 - DNA, 5138 bp, Homo sapiens
ctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaaggtagggcctgctggtgggaggggtctccggggggcatgacttcttccccccaactcctgccttggccaaaggcctggagtccagccatagggtctcagggagccaagggtggtttggctgtggcttagcttctgggaacctgccttggggcccctgtgtggctcacatcccccttttctggggacagcaagctgagtcaggaacaaagaggccttgtggagccccttggagcctcagtttctccctcgtggagctccgccacctggagaggttgtaggatgaggcaggaggatgcagatggagggctgggcccgtgggctgctggatgtgtggtgtcttgctcctttggagcaggggtcaacaggagggggttttgggtgatgtggagtgggggtgtctgagtgagctcctgatagcacctgctgcaggaggaggcagaaaggagggggcgggacctcagtgtggggaaggcctctgatgtgccttatttggggatttttctggcttctcctttcctcctgctgtcccttaagacgggctcagcaaaccccagggggcggggctgctggctggcgcccagggttagggattaggaggggtcctgacttttgatttggaaccactctttaatgagggctcctttagcctccttttgggggagcctgtcaggggcaccctctagctgactgtaaaacgagggggttgcccacatcccctcccttgttctagaattctgggacagcttctgccctggggacattttcccattcttttctggttgcctcatactcccagccagctgtctcttctcctttaaggccgagcctgccatgggggtctggtggggtactgagtatcgggggaagaagaggcacctttcagcccttcagactcctgtttgcccctcctctgccaataatacagcacggggcaagggaggggctgggcgagaagagaggccctgaggcaggaagatctgctcagaaccctggtgtgggctcagccacccccatccaatgacctgactactctcccttctcctcagatcctcacagccaccgtggacaatgccaacatcctgctacagattgacaatgcccgtctggctgctgatgacttccgcaccaagtgagtcctagctgtggccttgggcagcctgggccagctggcggaggatctcagggtacccctcctgaccccaggattccttggttgcttgtggcaaggcccaggagctcagggtggggcagtcctaggagccccactccttagtccaggatgcagtgaaggcagccagttctgaaggttgctgagcttaggcagggaatagaagagaaggaggggaggcgggaggcgggaggcagagagaagtaaggaagctggtgggcgtgggatctggccctgtgatggtcccggggtcccggggctggaattcgtttccactcgaccctctcatcagcccttccaactccttagagtcctggcaaaatgaaggcaggtgagcagccaggacctggatctgcaggtccaagcagcctgggctgaagtctctgattcccacggcaggtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggtgaggtggctggggcagaaggtcaaagatgctgaggagtgggtggcagagccctggggctgggcaatggctgaggccgtgggagagagcagagcaggtgcaccgggattagtcaccttagagggcttccctgtctgcagagccctgatccttggggtccagtgtgcagggcagactcctctttgtaccacactgcttctctgtacacaaggaacctcccaggggcctgcagaggctccctctacctaccctgcctccctcatgagggtgggggataagtaaggaaatcttgtcccatttcaaactctcaaagctgaacatctacatagaagcttggaaattagaggggaacttttgggggcataggcctaataattagattttattttggagagtccttggtctaatgggggagatagagtctgatggtggaggcaatactgagcagatgaataaaaatcatttagagggtcagatagagcagagggagaacaaaggaggggtccttgtgggaagtggggtccccttgtgggggaaggcttgggagtgagaggtcaggatgggtccagatgcgcacatccacatcccctttttccataggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaaggtggggggtgctgcaggccagagggctctcttaggggctggggctcaggggccttagcactgacagtaagcccacggccagatgtcttggaggtgcccctcctcagtaagctgcatggaccacagggtcacccactgcatcaacagacatggagctgagctcaagctgggatctggcgggtgggtggggaggtagggagctccctcagaataaaggcagagggtaaagaccttgggagtccccacgtctccctcaagaagtcaggaactagcatcaagagccaggctacatgttctggcttgttctcaagtttccggtctgtgcctcccacacgctgggattaaccataaaaagttaacatttcaaatggcatgtttctgggctttgggatgtgggaagctggtgagaaggcacactctctccacagttagatttgggaggaggcctgacttgggagagggatccaggctcacaccgccctgtcctgtgtcctgtctgcagacagaggaactgaaccgcgaggtggccaccaacagtgagctggtgcagagtggcaagagtgagatctcggagctccggcgcaccatgcaggccttggagatagagctgcagtcccagctcagcatggtaggaacagtcctgtgcatgggggagggcccagaagagggcattgaccatcctcactgacccctggtcttcctgccctcctgcagaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccagtgagtgggggcgcctggggtcagggctgggggtctcttggcaggggtggggctctcagacccacatctaatttcctctctgtttttttttttctttcagcctgactcagtacaagaaagaacgtaagtatctgcgtggcttcggccctgggggttgggtgcatgggacaggcagcccacctgcacgttgctggggcagggtccccaggagctccaggagttgatggctgtccctcagcagggagaagtgactcattagcactgaggattgatactcaggaaaagatcaaatgagagagacactgtctggtctgatgggggtggggcagggaactggtccttaccttggagatcctagtctgatggaggagacaggtcccagctctggagattgtcatctgatgggaagataggaacatggtctcatgatctttgctcttgacagcttttggatgagcaaaaacagtcctgtctctggggtctgtagcctgatgggagatagggacatggtccttgtcctccaaattccaatctgatggagaatatatgatcctagccttagggttcctagtctaatggaggagataggggcctggtttttgtcttggcgatcccagtctgatgggggagatggtagaaaatctatgtcctagagactgcagagaaatggagacggatttcatggagtctacatggctcctccctggcaggacacactggatcagaatcaaataacccatctggggaggcaagactcacacagggccaccggcagagggatgggatggaagggaggtggtggcagggacaggagggatgtgtgtgcagtgtgatgtcgaggtgccagtggaggcactcacagcacctgggggaggatgagggagagagccggctcctgtccatgagggctagggggcaagcgagggcctcctggcccctacccactttaaattgcctgcttctcctgcagcggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctatg

SEQ ID NO: 36717 - DNA, 16386 bp, Homo sapiens; identical to SEQ ID NO: 36714

SEQ ID NO: 36718 - DNA, 7720 bp, Homo sapiens
gtgtgcccgccccctctggggcggagagactcagcccctccccctcagcggataacctgggactgaccgttccctggggatccgacgggccccagaggacccacgcctgagccccgtgcgactcgtggcctttgggctagaagccatggacgccttcacccgcttcaccaaccagacccagggccgggaccgactcttcaggtgagtcaggtgccagcggcctccgcccctttctcgccctaactcggctcccgtgcctattcccctgcacccgggaaaaaggaggtgatagcctagtagatggaagcaggaaggacgttgccagctcctacggagggagtttagtatccgagcccctccttaccctaaattcaacgtgagtgggcccaacgcacccgcgtcccgtcctagccccgtgcacgaaagccccagtgcctggcaccctagccgcctcgagaccgccgacgacgggacaccggctgacagatcctcctcccctcctaactttgctctccgggcacagaaagattggttctctccactcaacattcttccgagggatctcctttaaagagaaactttggattagtatttgtggctagggaagcaaaccacttggtgtgacttcaaatatctctcttttttttttcttttgagacggagtctcgctctgtcgcccaggcagtggcgcggtctcggcccactgcaacctctgcctcccgggttcaagcgattctcctgcctcagcctcctgagtagctgggattacaggcgtgcactaccacgcccggctactttttgtatttttagtagagacgggggtttcgccatgttggccaggctggtctcgaactcctgacctcaggtgatctgtccacctcggcttcccaaagtgctgggattacaggtgcgagccaccgcgcccggtctcaaatacctcttgaaatgtttgaggagagacagaagttctcttccattattacccaggctgtatcattgagatactgcatgtggaatagttttgtaaattgtaaaacaaaatatagcggggatgagaccacaccaactggattggggggaaatacagtggggagaagctcagaaagaactaactgcacctctaaggttcatgctgtgctactgaaaatattaaacagagattgtgtctctttttcttttggttccataagaaacgaaaagaactgagagattgtatctttaatacgaatacagtactagttcatgatgttttagagatttggttgattcttgcttaatgaaaaaatatttacagttgcagttttatttaacagctctgcattctcttctgggtgtgcaagtgctgatacaaacagatcaattagaatggccccaataatgaggcttttggaagccatctttatgacagctattgttcccagtgttttgcaactatgaacttatataaccctcatcacaaccctatgaggtagatactctaaatattttacccacttcagatggagaaactgaagcagaaagaggttaataggtactacaatggcagaactgagggattcacatccacgcaaatgactccagtgcccacttaactaccaagctatactggctttctcattagtttgataggttttttaaatggttactttatatacaagcttcattaaatagaaatttcattaaatagaaacctgtaattccagtgtacctagaatgtaccctgcagggtttatcaaggaagttggttaaaaaaataatcatttaggccgggtgcagtggcttacacctgtaatcccagcactttgggaggctgaggtgggcggatcacaaagtcaggagatcgagaccatcctggctaacatggtgaaaccctgtctctactaaaaatacaaaaattagctgggcgttgtggtgggcgcctgcagtcccagctactcaggaggctgaggcaggagaatggcatgagcccaggaggcaaagcttgcagtgagccaagatcacgccactgcactccagcctgggcaacagagcgagactccttctaaaaaaaaaataaaaacattaaaaataataatcatcatcatttaggccgggttcagtgactcacacctgtagtcccagcactttgggaggctgaggtgggcagatcatgaggtcaggagttcgggaccagcctggccaacatggtgaaaccccatctctactaaatatgcaaaaattagctgggcgtgatggcacatgcctgtaatcccagctactcaggaggctgaggcaggagaatcgcttgaatccgggaggcggagtttgcagagagccaagaacgcaccactaccctccagcctgggcaacagagcgagactctgtctcgaaaaataataataataataatttaagatatgtttattccaaaagatctgagatctctagcattcatttcccaacctccttgatgatctgtataacctttatgaccacactggcattcataaaataataccttgctttctgtgccaataatgctcatgcaaacacggtgaacattcctaaaacctgtcagactgtaagaagtgtggcaagcaccaaccccacaaagtgacatagtacaagaagagcaaggattctctgtatgcccagggaaagcagcattatgacaggaagcagagtggctgtggtgggcagactaagccgattttccagaaaaagtctaaaactaccaagaagtttgtgctaaagcttgagtgtgttgagcccagtgaagatctaagagaatcctggctattaaaagatgccagcattttgaactgggaggagataagaagagaaagggccaagtgatccagttctaagtatcatcttttgttttattatgaagacaataaaatcgagtttatgttcacttcaaaaataaataaataaaagtaatgtcttactgttggcctgatccttattattagaccaaagctcagaaaggcagaatcattgacatgaccagtcctgtaaccaggaaggacacttaaaaaagagaaagcgattgtttatgattccagtcttctctttttatttcattcctagtaacaagttcactattttagaaaatgaaaatgtaccgcatttttattgagaataatatttatagcataaagggattcaaatgcacttacaagacagtaggaaccaggcacctactttattagtagattgccaaatggatttggatgtgtgactatgtgatgtaaaatttctcctacatttatattagtaagtcattgttatttgtaagcatgacaataatcactttattaaatatatagtattattaagcaggattctgcctgtattttatgtaaaatacgaataagttttgaaagacaactatgaaaacatatttatactaatttatgtactgatgtgtatttggtcctttcgtttataaaaaattaaacaatctttaaactgtggacttttcatttggttctggtttgagtttgtgtcctgtcacatagatggtaggttaagtacatggtagaaaagttcattttagaaatctgaaaatcaggccaggcacagtagcttatgcctgcaatcccagcactttgggaggttgagtagggcagatcacgaggtcaggagatcgagaccagccatgaccaaaatggcacaaccccgtgtctattaaaaatacaaaaattagctgggcgtggtggcacacacctgtaatcccagctactcgggaggctgagacaggagaatcgcttgaaccagggaggcagaggttgcagtggagccaagatcacaccacagcactccagcctggcgaaagagcgagactcgatcaaaaacaaacaaaaaaaaaacaaagaaagaaatctacactggggaagagaaggaatatggatctttgtagacttaacatgagggagattttgtacagtttctcactttgactatatccatttctctgtgccagcaaaaggccttttggaggcacattggctgcattattgcagaatttgttttcattacctttgtgttaaatttccatgacatgttctaccctttggctctcctgtagaatgactgttgcagaattttgcttttgtaagagttgctacatgagaaatggtcttggaaatgttgtctggaggcatgtgtttctctttcccttacttcctgaattaagttttatttggtttgtaaatcattcttctcaatttttttttttccatttcagagccactcagtacacatgcatgttgcttagatatttgttagagcccaaagctggcaaagagaaggtggtaatgaagctcaagaaactggagtccagtgtgagcactggtcgtaaatgtaagtaccctgtttcttgagggacagtgactcctggtttagaatcctcagcctcagaccctgtaattcacggagtaatttctaggtcattaatttctagtcaatcaagtttattggtgaaattgaccagtaaggctgtcctcatggcacaacaggtttgaatgtgttgctgcagaccattcataaacaccctcttatgttcacatctggtgctacaccttatctttctgctgaatcataaccagtgagacagacaacgtgttagttcacctttagttcttagaatcatagtatgttttagcagtctctgacatgagcttctgctcctgtgagcccctttattctaaacaagagtggaatagttatatcctagaccacctgcctttttcctttattgaggagtgctagaggatatataggtggatacatttttgtagaccatgtttgaggtaggtttcatgccaaaggtaaaaagtgaaatcaatattttgtgtttattaaatttactttaataatatgtcatactgggaaatccagtacttttcatagcaattgcctttctgagtctttgttgtttgatgaaaaccagatgttgctatagtaggttagcagaggcattagaatggaatgtagagcatcacatattgatcagttggttttgagcacctatgttatataggtacattcctgagccttatgggagaagtaaggtgctttaaataatgatatataagatttagtgccaaacttgttggctgaggtagaggaaaagaaaggtgttttagaggaggtggaacttgaggtgaggctagagagaaggaagaagagagtttcgaagggcagttttctctaataaaggctcagaactgagtaaaccattgtatgggaggatcattgtcaaactacaaaactagtttgacagatttaaattgtcaagcagagggatgggaagggtagggcgagcttttctggatggcactgaaggccaagattagaaattctatttagattatttagaatgttggagctgaaaggtcctttagaggtcactagtctgtaagtccagaaggggcttatccagggtcattcagccagttagtgcaagggccagaactggaacccagaatctatatactaaaatagtcattacatatactattttactattttatgttatttttgataacataatacaaaacattcttttttttttttttttttttttttgagatggagtctcactctgttgcccaggctggagtgcagtggcatgatcttggctcactgcaacctccgcttcccaggttcaagcaattctcccacttcagtctccctagtagctgggactacaggcatgcgccaatatgcctggctaatgtttgtttttattttttattttttttagtagagacggggtttcaccacgttggccaggctggtctcaaactcctaacctcaggtgatccgtgcaccttggcctcccaaagtgctgggattacaggcgtaagccaccgcgcccagccccttctgagattataagttttctgagagtagctacttctgagcacctcctgagtctaaggtatgatccttcaaggaaaagtacttcttttgtatcctccgtgacatttagtactataactctttctcagaaggtgttcagtaagtacctattgattgatgcatccctgattaattgaattacgtgctcacataaggacgtgccattgcaatggttgatttaattcaactaggagctctgtgacaatattattaattgttctatccattaaattctaccatttctactttatcttcttgacaataggtagccaaaaggggtttggaccagagaaatggcaaaatgataatagtgttttttaaaaagacagtcttttgtctggaaaataaataaaatgcaaggcatcagactctccaagagagtattgcatctggagttcatgttatcatagtaccttccttctaaagaagtgtagctggtaaataatcaaatgtaacagtccacactcatgattgaccttgcctggagtatgccgtcagtcaacattaaggtgttcattacaatggaggaggtaaatttaaagagtcactgtattttttgccttccaagatcactttaggtgtccttaatgtactgtaaaatctttctctttttctgaacaaaggctgagcctttaatgaccatcagttgttaaaaagaccagtgctaagctgggcacactggctcgtgcctataatcccagctactcgggaggctgaggtgggaggattgcttgagcccaggagactgaggctgctgtgagctgtgatggtgccgctgcactccagccggtgtgacagagcaagaccctgtctcaacaaaaaacaacaaaaagctggctcctcaccctgatacagggattctatcttcctgttgtgtactaatgaaataactgttcactattgtgggttctacttgcagggttcagactaggcaatgtggtacatgctatacaggcaactgagcagagcattcatgccactgacctggtacctcgcttatgcttaacattagccaacctgaaccgtgtgatttatttcatctgtgacaccatcctctgggtgaggagcgtaggtctcacctctggcatcaacaaagagaaatggcgaacgagggctgctcaccactactactattctcttctgctgagcctggtcagggatctgtatgaaatctccctgcagatgaaacgagttacatgtgacagggcaaagaaagagaaatcagcatcccaggatcctctttggttcagcgtggctgaggaggaaacagaatggctccaatcctttctacttcttttattccgatctctgaagcagcatcctcccttgctcctggacacagtgaagaacctttgtgatatcctgaaccctttggaccagctggggatctataaatccaatcctggcatcattggacttggaggtcttgtgtcctctatagcaggcatgatcactgtggcatatcctcagatgaagctgaagacccgttagggtgtttttaggcttggaactagtacctactttaaaagatggcctcttggtgggacagacatttgtataagtcacaggccatgtcatactgtgcttaagttcttgttcatgtgagcatttaacaacctgtgatgtgggcagagatgaggccaagaacggagaagggaggagcatgaagagttgtatgtttttggagtgctggagtgacttgtgaatttctgaatattttcccttcatctaacattgattgaacatctcttatgtgcatagtgggagcttagtatttgctgaatgaataaaaattgaaaggaaaaaattt

SEQ ID NO: 36719 - DNA, 9239 bp, Homo sapiens
aggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatccgcggagctggcacttggaagagtgagcgggtcatcacgtcccgtcaggggccgcacatccgcgtggacggcgtctccggaggtaacgctccgttccgggagtcgttccaagacctttcccgagcttgcgctggaatggaggtcctggaggtgggggtgggcggctcctacactcttagctactgttccccttcgcatctctcagggcgactttatggcttcctaatattgactcttgcctggttaaacccttttgacggagggaggcgatttgcccagcaagaaaacccgcatttcttgagcggctcctttgtgaaggtctctaccaattgttgctgcacgtgaactcctgctaacttctagacgcaggaatgactaattccactttacaaacgaagaggctgaaatccacagatgtgaaatggcttgcccaaaagcccccagctagctgcaggcagcgctggaatattggagctggaacattgcctgactggccagagaggacagcttgctgggtaaactcatagcaagcaaggggtcccagggctgccacagaaatcacatgatgagttggccctgccaggtctccctcatttctttctttccttttttttttctgagatggagtctcgtcttgctctgtcgcccaggctggagtgcagtggcgagatctcggttcactgcaacctctgcctcccgggttcaagcgattttcatgcctcagcctcccaagtagctgggactacaggcacgtgccagcacacccggctaatttttgtatttttagtggagactgggtttcaccatgttggccaggctggtctcgaactcctgacctcaagtgatcctcccgcctcagcctcccaaagtgttgggattacaggcgtgagccaccactcccagccctccctcatttcactctaaccagtggttacacctgacttattcgtgtcaggcctcaggtgagtggtaatcatcaacaagctcccaaagctgccttctgcccaggaaataggcatagaacccttggtgctgttgcactcatttgtaaaacagaggtcccaggtaatcccttctctccctcaggggaagcttagagccggtcaaaagatgggaaattaggagacccaagttctcatcctgtttttgcctttcccaggctgtgtgaactttcccctctggctgtttgctcctaaggtcagctgtgttcactctgggctttagaattcggggactggtatctcaggcacctacctttgggggtgtgattctggcagcaaagtaaactgtggagttccaggactgcagcaggcgtctgatccagccctcttctttaaccctcaaggaaaccaaggggtcagataaggagtcagtggtggtcttcaggcacaggagaagcctgtgaggaagggctgagttcctccttgggtagaatgtgattcaaagccagagtttaggctgggcacagtggcttgtgcctgaaatcgtagcactttgggaggccaaggcaggaggattgcttgaggctaggagttcgagaccagcacggacaacataatgagaccccatctctacaaaaaataaaaaaatttaatcgggcatggtggcacgcacctgtagtcccagctactcaggaggttaagtgggaggattgcttgagcctgggaggttggggctacagtgaaccatgattgcaccactgtactccaacctgggcgacagagctagaccctgtctcaaaaaaaaaaaagtttaaacttcttgctcttcaagatgtgtagcactgacgctccttctgtagctgttgaatttggtgcctcctcaatggtgactccaggtctgtttcctttctggaccatttccccagggcctggcactgtcatctttccaggcctgcccttgccccacctgagctgctgtatccatctcctctccttcacctcaggaatccttaacttctgtgccaacaactacctgggcctgagcagccaccctgaggtgatccaggcaggtctgcaggctctggaggagtttggagctggcctcagctctgtccgctttatctgtggaacccaggtacacagtgagtggtggggggttgtggggactgaccccagctgcctgcttcccacagtcagcaaggctggtttagccagctcagctcagccacagccctgggcctactgttggcctcagagctgtgcagcagaaaggctgagtgcaggcctctgttttgctgaaaagctttggccaaggaactttatatatatattttttctttttgagacagagtcttgctctgtcacccaggctggagtgcagtggcacaatcttggctccctgtaaccttcgcctaccagactcaagggattctccatgcctcagcctcctgagtagctgcgattacaggcatgctaccacacccagctaattttttttttttttttttttttgagatggagtctcgctctgtcgctgaggctggagtgcggtggcatgatcttggctactgcaagctgcgcctcccaggttcacgccattctcctgcctcaacctcccgagtagctgggactacaggcgcctaccaccactcccggctaattttttgtatttttagtagagacggggtttcactgtgttagccaggatggtctcgatctcctgacctcgtgatccacccaccttggcctcccaaagtgctgggattacaggcgtgagccaccgcactcggcctaatttttatatgtttagtagagatggggtttcaccatgttggccaggctggtcttgaactcctggcctcaagtgatctcctccaccttggccttccaaagtggaaactgcctttttgagcattcattttcccacctgcaaaacagagtccctcacacctgaccttctataagaaaagaggagtaggcggcaggaactgagactaagggctctggggctgttctgacgggagcacagttgccagtgctgccctttagtgtccctgttcctgtgggcaagtatcttaacttttctctgtctcaattacttcatagggaaaatgaagataatagcacttaataggatcattacaaattaaagacttaatacatgtaatgcttagaataggccgggcgcagtggctcatgcctgtaatcccagcactttgggaggctgatgcaggcggatcacctgaggtcaggagttcaagaccagcctggccaacatggcgaaaccctttctctacaaaaatataaaaattagctggcatgatggtgggtgcctgtaatcgcagccacttgggaggctgaggcaggagaatcgcttgaacctaggaggtggaggttgcagtgagctgagatcacgccactgcactccagcctgagcaacagagtgagactctgtctcaaaaaaaaaaaaaaaaaaaaaaagcatagaacagcctggcacatagtactgctcaatgaatgttggctattatttattttccaaatgttacaaaataaatttatataagtatgaaacttaaatagtacttattatgtgccaggaattcttttaagaaaattacaactattggccaggcgtggtggcttatgcctgtaatccaggcactttgggaggccgaggtgggtggattactgagttcaagaccagcctggccaacatggtgaaaccctgtctgtgctaaaaatacaaaaattagctggccgggctcgcttgaacccatgaggcaggggttgcagtgagccacgacggtgcgaccacactccagcctgggtgacagagggaaactctgtctcaaaaaaaaaaaaaaaagaacattacaagtattaactcattaatcctaagtgatagttgctattcttattcccgctattgagatgaggacactgagatccagagaggttaagtgacttgcccagaggcacacagcctgttgtgggatttgaaccctggctcaagagtccatgctggctgggcatggtagttcacacctgtaatcccaatacttttggagcccaaagcagaaggatcacttgatgcctggagtttgagaccagcctgggcaacatagcaagaccctctctctaaaaaaaaaaaaatgtttttaattagctgggtgtggtggtgcgcacctgtagtcccagctactagggaggggaggctgagttgggaggatcacttgagcccaggagttcaaggctacagtaagctatggtctcactactgcactccagcctgagtgacagagaatccctgtctcatttgccaaaaaaaagaaagagtctgtgctcctgactacttgtgattatcattaactgccctctcagaaaggtgagagtgaaatgaatgtcagaggcagaactcctgactcgcatccagtcacttcccagcaaagccctcacccagacccaacagttttcaaatttacaaattagaggcccaggtgaacccagaattacctctgtgatctttttcttcaccattaggcgaccaaaaaagacactcagtatggtgttaggaagacacatctttcttctccacgagtgcccgtaattccaccattagactgccactgtaaaaccaaagtctgcccagggagggaacctaacaggtccccagttcctcagtgggaactgtctgtcagattcctggcagctctgggatagcccatgtgtggcagaaagtaaggagactgaggctgcaggctttctgggttgggtctctgtggtcctccaagcctctgtcccctcgaacttgtcccacatgaccccacaggcatcaacacgtgtctcactcattttcttcagagcatccacaagaatctagaagcaaaaatagcccgcttccaccagcgggaggatgccatcctctatcccagctgttatgacgccaacgccggcctctttgaggtgtgtggaagctgtcctgcgggtgagggttggtggggcctgttaggctgaggaaggcttgggtgtgggcagtcgggagaacctagcaggattcagtgccatgcctagaggctccagagcccgcttctggaggtcaaggttgggccaggtaggtgctccaggaggaatcctggggcttgcagggagcctgagttccagagcctttgggggataagctacatcagctggaaggctgggggaggcgggggcctggtactcaccaaatatattctcacctcctcttactagagcagggcgctggtccagcccggcactgagacacgggggccccagagagaagcacagaacaccttgcctctctacccagaggagcgccctggctggcagtacagttttttgatttgctggagtcccggtcaagggagaagcccagggtggttaaatgatggctctacgctcactgcctccctccaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccaggtggggcgacgcctgggtccaccctcagcctccgcctggggaaggaagtgaggcttagagaggccaactcctcactcacagagatagcctgaaagtttgaaacagcagagatttgtccaagatgtgaacccagatccctcacacccagagcattattcttttttttttttccctgagacagagtttcactctgtcgccaaggctggagtatagtggtgtgatctcggctcactgcaacctccacctcctgggttcaagtgattctcctgcctcagcctcccaagtagctgggattacaggcatccgccaccccacctggctaatttttgtatttttagtaaagacggggtttcatcatgttgtccaggctggtctcgaactcctgacctcagttgatttcacccacctaggcctcccaaagtgctgggattatagacgtgagccactgtgcctggcaccagagcattattccattgtgccatggtgccttgaggtttttccctgtgtatgtgtgacagtctcactctgttgcccaggctgtattgcaatggtgcagtcatagctcactgcagcctcaatcttctggactcgagcgatcctcccacctcagtctcctgagtagctgggactaccggtgcccaccacacccagttttttatttatttgttttttagatggaatttcactctttttgcccaggctggagtgcaatggcgtgatctcagctcactgaaacctctgcctcccaggttcaattgattctcctgcctcagcctctggagtagctgggattacaggcacacaccaccgtgctcagctaattttctatttttagtagagatggggtttagccatgttggccaggctggtttcgaactcctgacctcaggtgatctacctgtctcagcctcccaaagtgttgggattacaggcatgagccaccgcacccagcctgtttgtttgtttttgagacagggtctcactataatgctcaggctagtcttgaactcctgggctcccaaagttacaggcatgagccaccatacccagccagtttttaaaatttttagtagagacagggtctcactatgttgcccaggtgggtctcgaacccgtaagctcccaaagtcctgggattacaggtgtgagccactgtgcccggcctgccttgagtattagcaagcaccttctgtgtggcaggcccttgctaggcataaggatagaatgtacatgttggtgagacctggtcccagcctagcctgccctctgggaccttacacaggagactgagatgtgagcccattctcactgtccagagctcagggtggagatgggtgacgctgagaggcacagatgagggagaggatgttccagcccccaagatggtggtacctctgtgcccacctctgtgctgggcactgggcaggatgagctctcagagctccaagcagcacaagagacgggtggtttggcccaacttgacaccacccaccatctgctcatgtctttcctgcagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggtgggaccatgtggcacctgaggcctggggtggggcttctgagggtggctgggaaacgaggaggccagtccccagcatgatccataatccctgggctctcaggaggccagtgacagcagcggtggcttcccttgcaggggcacagatgagctgctgggtgtgatggaccaggtcaccatcatcaactccaccctggggaaggccctgggtggagcatcaggtacctgcaaggttgtgtccctggggtccccttgtccttttgaagggccctggaggggctcagggaagtggggagggcagcatggactgtactttcaggagggggttgggtaggctctggcccctgaccaacccctccccccacctcttcccttcttctcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggtgcgactcccagcagggcaggctcgggggcggagagacgtggtgagagccagcctcatgtgtctgcccaggcccacagacagctctgtgcccaccgggtctgcttctgcctgttcccctcccttctctctgtccctgcctctcccctctagcttctgtgtctccttcttatccctcctgtctttccacctcccttgttgttctccctgccccctgcctggctcccctctgcctcttagagcttgtaactgtctttgttgatccttcttgcagacttgggcatagacctcgggcctggtccctgcaaggagcgggtgtgaatgctccacggccccttagctacctgtgacaccttgtgcccacaggttccgtagtaagatggaagctgctggcttcactatctcgggagccagtcaccccatctgccctgtgatgctgggtgatgcccggctggcctctcgcatggcggatgacatgctgaagagaggtaagggtgctgagacaagggaactggtggtgggtcctgagagaagagaaagggaaacccctagactgtgacccagccccgtacccagccacgctgcggcctcttaggccagctgtctgtctaagcttgaacaccccaagccatgaggcagtcccgaatctgagacctggggcagttcccttgccctctgtgttctgcccccaagcctgttggttctggcacgcccttgctttctaccctcccaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctactgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtgacactctggtctgctttattgtctctgggcaggcccagtcctgtggccggttgaagaatcaggcaggagccagggctctgaggggaggcgcctgaggactgcagatctccactgacctctttccctagattaagatgggacccagtggccgggcacggtggctcaggcctgtaatcccagcactttgggaggccaaggtaggcggatcacctgaggtcgggagtttgagaccagcctgaccaacatggagaaaccccgtctctactaaaaatacgaaatt

SEQ ID NO: 36720 - DNA, 147981 bp, Homo sapiens
aaaggcatcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaagtaagttatgtgggtcttttttctttattattttttcttttttgaaaatgaaagctccgcatatacttcttttggtgtttcaggaaaagttttaaaaaggaaacagaagggcgttttaagtcagacaaggaagggaacgtaatgaggcaccacagactcgagaaatcagatcccatgtttttgggggtctggatttatgctatgaagggaagaataaagagcagtaataaccaaagaagcctgaagcaaaataaatgaatctatagcagctgcaagatacaataaacagtgttagcagagttgaaattgttggcaggcaagacaggccgattgcagagttagtttcaggatgaagaaggcagagcaggagagctaagtttttagacatttagtagtggtgttagaaggtcctgagttttggagatagtgtagaccaagcactttttgtttttcaggggagttgctgatttacttgtgagaagggtaactttggatgaggggtggcttccccctgagatttggggtggctagggggaggctgggtgcatggaagatttttcagttgtgacagtgaaatacagcttcccagactcatctcctcgctggctctgggtgcctttccctttgttatggaatgactggggctgttttcatttgggacctctgagtcctggcctaggttcaagagtcccatccaaagggaaagagaactgttcccagtggctgaaactctcagaccagccatttgaggcaagagttcgtactgttcaagccagtagggggttcagcaccattttgccgatcattggcttcctacaacacagagttaagagtcctgaaaagggccttaggcctctcatctaaccccttcgctccacagatgtaaaaaatgataggaaggggaccgacctgttcaagtcccacagcacatctgtagtggagctgaaaatgaaattgagattctctctactgctagtccagtgttctttccactccatacctctgctttcatttcctttttaaggcttattctggctgagacaatagaggcagtatgatgagcaagtcaccacaaggacgttaattatcagtaatagagaggacgccaatggcggctcatcagctaatgatgtctatggttatatttgtgtgtgtgtgtaaaataaaaagaagctaaattctgagtattttctatgcagcaggctcaaaataatacataattcatgctcagagctcttcatacataatttgattgactctcacagctatgtaaggcattatttctatcgtacatgtaaggacattaacgcttagagaagcgaaatgagttgctcaaggaaaggtagctaatacatttgaaactcatgtatatctgactctaaaacctatgcttggaatcactattcaatgatactcccctcatctcccttgcatttggttacttttggggtcaaattccatatttcactggctgatcaggaggtgaaggtgtcaggctatgggagcagtatggattctctctcagaggccacttctgcacttggctgaacatttgtctggatatcagatgtggggttgatttctgggtctttggtatatacttacctttgttatgcaaagagcctgggacttagagtcagaagattcaggataagttctggctctaccttttactacttagcaaagttgctttgcctttctgcaccttgacttctgtatttattatatgggaacaattgcagtacctttcagtgtgattgctgcaagaggtattggacatgcatgcatgctgaaggctatcaagggcttacccatatcagctctttcgattaggatcggtaaacacagaacgtcatatgaggcagcccctgtggtgctgggtctggcagttggtgctgatgctggcaggagggcagatggatttggatgtgtgtgaaactctgaaatgggtggcctcagtcttagtgcccatctcctttgaatggaagcaggccttcctccctcccgggggaatattcctgagggctctgtcttaaattctgtctcttaaattctcctccactggcctggtttgatatgattccttgcccaaagcagtgcaggctgaaggacactgtgcttggtgaagcatcccctgtctctgaaaaggaagtgtttagtcaggaccagtcccctgattgctcctcagacaagactgacatttgaggagcttcgtatctagctgagggcagatccttgacccaggaccttcttgtcactggcaggcacatctcccttcatcctttccctggcattccctattctgtgcctgcagtcagaagggaggctgctgctcctggggtgggggtggagagccagcctgcagtggggaggcctcagcctctgtttctgggtaagatccatttgctttagaaaccttaaatgtaagggaagtgggtaaggtgtttccggaatgcctttcacttagattcctcaacagagtctccatgtccaagcacaggaccttatcacctgcttattctcccctagccactctgtgaactcgcacttttctttccttcttgtataattgctccccagtcttgaagtcatctgaattctctatcacacacagtgaatttacttcaaacctttccatgtatttgcatttttaatagacacatgaaaaaattggagcggccaccccccatacattcatgtcacaccattttcaattcgcatgagctctcagatatccttcccaagctcccttacaagatctgctttcaggcacttcacatcaccctcacctcaaacacacaatccaaacacatgtctcgcaggcatccaaaaagcaaacacacgtctaaaagtggacctccacagacatgctaacattcttgtgccagctcacataaatggtgacctgtccgcaacacagacacactggactctttatacctcttgccctgtttgaagctgtgcaacatatgaattgatcgactctgtcccaacaatgactagtcagtccagaaatgtgtccagcatccccaggcatcccagggcttctctgaatgcagcaaccatccataatgaggactgttcaccaggaaattagaaaccccaggtagaccttaaaagattttcagaccaatcaaatcagaatatctgaggttggagattgggaatcagtactttgaactgctccccaggtgattctgatgtgaaacagaattaagtacctctgctgataaatctccaactgtgttgtctttggcaattcaattttattccatttgatttagttctattcatcaaagatttagtaacactgtgctaataacatagtttagtaaagaagctgagatgtccagatacctgtcaaggatatttattggaacatcaatcacctcgtgtctaaagtgatgatctctgtaaatttttctctcttttaattatatttgtatatgtttaaatgtgctattattaagcctgcattattcatgtacgatttggctaaaaatggttctcttattttctaattgttttgcatagatatatttgatgtttcctaattttataaaccccagcatttggcaaattgtgtacttattagctggaatcttactttggctttgaaatgctgaagaaggtcagttttgagccagcccaagagttgctaaggcctggaagggcaatgcaaaggtagaggaattctaaacatgggtttggactcactacacagctcctgagtttagctgggcttctcctggaaattggatattgtctgtaatggatccactcattaagtcgtctgtggcttgtgatttgtgcctaaaagaaccccacaaaaatctgtgaggggccctttggatctatagctccgaggttagtgctggctggtgctctgtagtgtgagtgagagggagagggcatgtgataaatagaacttcagatgcgtgatgtagtgaaaagaacatgtagtgaggctctagtcccaccaccatcattttctagggtttcgacctcagaggagttttttaacttcattggtcctcaatttccccttgagtttttatccccttcatttgagtttagataagataatgtataggaaactggaaagcactgtacctgtgaagatggtaggtaatgcaagataatccttagggccttaatagcttaggtagccaaaataattgagatgggagatggattaaaaatgagggcaaataatctagcatttttgcattttttccttttaaaatttgaatgctcttatgaatccaaaaaaacatgaaacaatacaaatctcagtgaactctcatgtctaagatagttttccactgattttatttttctcttgaatagtggtgatttaaaaaaaaatcgcaggtatattttttatctattaaaaatatcatagcatcctggtaaactctgtcataattttgttttgctgtatttatttatttactcctcagtaagtagttattggatgcctagtctctgctggacactgttctatgttttatgatgaacaaaccccatgaagttacaagcatttataagcattcattgctttaggttctagggagtataatatgaatttgactgtgtgaaacttgatttagaaaattggtatccacattgggttaataaaatttagtttttaaagtttactgaactgtaatttaaaaataatacagaaatagttattaaatggtgattttcagtggagcaggtgttatgccataaataggaccccaaattttatattttttataatttttaaaaattatagagcaactttagctttacagaaaaactgagaacaaaatgcagagttctcatgaattccttctaccctttgcacaatttctctattattacaaccttgtattagtattatgttttatttgctatcagttactcaatgtgtatttattaaacataacaaaataataaataaatttattatttatgccctatttgttattatgaaaagaatacatcatattgctgcctctcaagctgtttataatgttatgtagctacagtttgaggtttctcatttattagaaaaattttttttctgtgcacttagtgcatgccttattcagtgctagggcttaacacattatctggacatagtagacatttaataaaatatctgctgagtatacagacaaatgaaatgaaggatccagaagtaaaagacgcaattcttgtccttaggaacttaggaaacaacagacacacatagcagtgactggagaaaatttcagaaatacataaaatatgattaaatctctgataaaggagacattggtataggcaaatgaggcataaagccattaacaagagccccatcctctttttcctcctttttgggactgtacttttttttaattttttttatttgtttgagacggagtctcactctgtcacccaggctggagtgcaatggtgcgatcttggctcactgcaccctctgcctcctgggttcaagtgattctcctgcctcagcctcctgagtagctgggattacagacacccgccaccaagcccagcaaatttttgtatttttagtagagttggggtttcaccaggttggccaggctggtctcaaactcctgacctcaggtgatccacctgcctcggcctcccaaagtgttgggattacaggcatgagccactgcgcccggcctgggactgtacttcttatcatcaccattgtctttgttgccatggtcttcattattatcatcataattatggctatcgttctatgtctaaatccaagcattaaagaacaaactcccatatccccatggtaaggttggagaagtgcgtgcaagtgtgtctatgtgtgtttttggcaattttaaagtacagtcacaccaatatatgccacttccatttcttgctggaagtaaaatgagtgactacttgggctttgtaaaagaaaatcgcactttggaagtccttgtgggagccataccaaaatgccttgcagtactgtaacttctcagaggcatgtaaaagttagaggattggtgaagttttcaaaagctactggcacttgtccttcaggatgaaccctcttgagatgcaggggagcaaattgacctcaataagagagtagtgggagctaaattcactcaagaatagcaatctgttcctcagacagatgcagttgtaattttagaatgtgtacataacagacagtttaaaatggacataataacgctaaaatagtatcaatggaaattaaaaataagtcctaatcccaaccaaaattctagcaagttgttttgtggatatcaacgaactgattctttttttttttcttttttctttttctatctttgagacggagtcttgctctgttgcccagactggagtgcagtggcgcaatctcggctcagtgcaacctccacctcccaggtccaagtgattctcctgtctcagcctcctgagtagctgggattacagacatgcaccaccatgactggcctcaaccagctgattctaaagtttatatagacagttaaaagaccagattagctactgcaatattgaatgagaacaaagtcaaaggactgacagtacctgacttcaaggcttactgtaaagctctggtaatcaatacattgtggtactggtgaaaaaataaacaaatagatcaagaaaacagaatagagagcccagatagacccatataatgtagccaactgttctttgacaaaggagcaaaggcaatctgatggagaaaaggtagtattttcaacaaatggtgctggaacaattggacatccacatgcaaaaataatgaatcttaggtataaaccttacatccttcacaaaagcaactcaaagtggatcatagaccaaaatgtaaatgcaaaacaatgaaactcatagaaaataacataggaaaaaatctcagtaatcttggatattgtgatgactttttagttacagcaccaaaggcactatctgtgaaagaaatccctgattagctggacttcattaaaattgtaaacttccactctgtgaaagacaatgtcaagagaatgagaatacaaaccacaggttgagaaaaatacagatggtgctgacttaaaacggttcaacttacgatttttcaactttacgacagtgcaaaagtgatactcattcagtagaaatagtacttcgaattctgaatttcattggacaaaactatggaaacagtaaaaactattcgtagttgccaggaattaggggtgagggagggataaattgaacacagaggatttttagggtagtgaaactgttctgtggttactacaatggtggatgtatgtcattatacctttgtcaaaacccatagaatgtacaacactgagagtgaaccctaagacaaacaatgtactttgggtgaaatgatttttttttttttttgagatgaagtcttgctctgtcgcccaggctggagtgcagtggtgtgatctcggctcactgcaacctctgcctcctgggttcaagcgattttcctgcctcagcctcctgagtagctgggattacaggcgtgtgctatcacgcccaactaatttttgtatttttagtacagacagggtttcaccatgttggccaggctggtttcgaactcctgacctcatgatctgcccccctcagcctcccaacgtgctgggattgcaagtgtgagccaccgcgcccagctgaaaatgatgtgttgatatcacagaccattaggtttattgataggcttattgattgtaataaatgtgccaatgtcgtgagggatgtcaatagtgagggaggttttgtagcagaggacaagggtgtatatgggaacaatctgtactttctgcttaattttgctgtgaacctacaactgctttaaaaagaattaaagtttaatttaaaaaatctgcccaatctccaaattctaatactttgattccatcttggctacttctttcttatttgaaggcagtcattgtaatatagttataatcatgagcatctgtattttaaaatgcttaattttgtttttcagataagtaccctaaacttaaatgatattattttatttattaaagctacctgaggcagaaatgtttcaaaatcttgaaaaagactaattcaataggttaatagcagataagtaggtatttttgtgtcatactcttcaaattataataactatcacttaaagaatagtcatttttgttcgtttgtgatccttccacctcagcccctcgactagctgggactatatgtgcgtactaccacacctggctaactgttgttttttgtagagatgaggtttcactatgttcttcaggcaggtctcaaactcctgggctcaagcaatcctcccaccttggcttctcaaaatgctagtattacaaacatgagccactggacccaccctcattgagctgttttaactacaacttggtatggtagaaagagtgatgggccaagggttaatagggtgagattctaattttaactttgccacctacaagcagtgggactttgtgcaacaatgttttaaatctttctgcatttaaatttttctcatctgtaaagggcaatatacaatttctgtattctccagttcagttatgctaatcgctgtcctgtcagcacccacatccccatattcactttcacagataagacttgagtcgctatgatcttcaccctagttgtcaccctgtccccatactctctgaatatgctcctctctcctctcattttagccaaataccactcttctttgaaggccagcttaagtttcagatcctccatccatcccagatcttcttggaatccctagttcttttggtcagtatcacttagtttagcaaagaccatgtcttaggtgattgctctaactcaccttatagcattaacccataagtgagtacttactgaactctcactgtatattagattaagggcttattttatatgcctggcacagttcttatttgttgttggaaaaatttttagagggcagtaattgaaatgtcatatactatagtctttgaggatggaaaagagctcagtaagtttctattaattggttatgccgttaagatcagcatctaaagagagctaggtcatggaaaaaatggcctaagtactggacttactatcagaagtactggacttaaattttaattcttatgatttgtgaacattgtagaaatatactaatgtctttgtgagtacagataaggaggaacagataagcttatgtgaaaactcggtttgtattgggtctatattatatacagggctattttattttatttatatttatttatttatttttgagacagagtctctccctgtcgcccaggctagagtgcagtggcgggatctcggatcactgcaacctctgcctcctgggttcaagccattctccatcctcctgcctcagcctccgaagtagctgggattacaggcacccacaccacgcccagctaatttttgtatttttagtagagacagggtttcaccatgttggccaggctggtcttgaactcctgacctcaggtgatccacccgccatggcttcccaaagtgttgggattacaggcgtaagccaccatgcctggcctattttatttatttatctatctatctattttttgaggtggaatttcgctcttgtttcccaggctggagtgcaatggcgccatcctggctcaccacaacctccacctcccaggttcaagcgattgtcctgcctcagcctcccgagtagctgggattacaggcatgcgtcaccatgcccggctaattttctgtgttttttttttttttttctttcagtagagatggggttttttcatgttgattaggctggtcttgaattctcgacctcaggtgatctacccgcctcagcctcccaaaatgctgggattacaggcgtgagccaccgtgcctggcctgttttattttattttaacaacaaatagaaggtggttattccaggagggtttcagaatactaccccagatttggtttctcctggtttgactacaggcagtgctggtgtctttctcttgatcatactcctttcctcatgggtgtgttcagtcctctgatgatagaagtgcttacctttatttaacctttccctctctcactgagtgttctctctttcctgaaatacttttcatttgttaaagcttttaagaaattcttatttgaacattcagtgttatgtaaaaaacaaattaactgctgcttaatatcatgtttggaggtgaaaaattttctaagccttttgcttagccatttattaccaaaggggtatcaagcttggatgtcaagctaggatgtaaattctagacctatacaattccttcaagggcggctgaaaagttgctttctaatccttttgctatattttggtggcaagctttgttttcacagtttaaagaggattgatggttttcctattgtctttccttcacaactttctgaagttcacttgcctgtttcattttcatgacttaaggtaccagcttcttctgcccctctcctagatccaccagcgccccccatgctccagaaaaattgagctacactgtgcctttccctgagctgtagaaagttccacctctaggtttccaggtgcttctgatcatcatttttcaatggattgagttgccaacatctacaaaatatattctaacaaagatgctcagaatgtctggtgttgacctatctatacaggtaaacttcaatgactctgcatttccctttcactgctgacctcatgccttttgcagaagtaatataggaaagaagagcattgaaatagggcagaagatctaattttctttttctttcttgagatggagtctcgctctgtcacccaggctggagtgcagaggctcggtcttggctcactgtaactccgcctccccggctcaggtgattctcctgcctcagccttccgagtagctgggattacaggcacccaccaccatgcccagctaatttttgtatttttagtagagacgaagctttgccctgttggccagtctggtctcgaactcctgacctcaggtgatccacctgcctcggcctcccaaagtgctgggattacaggtgtgagccactgcacccggccagaagatctaattttctaacttacaatgtactcgaatattgaaaggaatttcatatttttagaactaagccctcattggggttgggtacggttagggcaaggagaagcctgggaaggagttcttgggtagttaaattggaaaaagagagtctggcacattcagaatggctccatatttgttacccgcagactgtacataagaaatgagacctggctattaagagatatgatgcctgtgaaaaccctggatacacttgcaacttgctttttcccaagtgtttaggactctagtagggacacctccagttccttttggaaataagctaatatttggtttccaaaaatgtattgaagtagtcttaatgagacaaatagaaaatagaaatttgattgaatgttcttacattcttaaaaatgctactttttagcatttttaaaaataatgaagtacatgttggggtgggagtggagaagagactgtaatatttctgtatctgaagcctccataaggtcttaatccagccctccataggaacataagccataattgtcatctacaacttgttcctaaatttactcagctacagtttctcagagctattgagggaagtactacgatgctatttaaaaatactttcaaatccatccttatgatgatgaagttattatagttacaaatgcatgattcagcaataggcattaggaaaacatatccaccagacagcctgatgatcatggtgtatgacactttcttctgaatacatgagggttagatgaaagtggtgacaaacgattgagatatctagatccacattatttaccttttttttttttttgagacagagtctcgctctgttgcccaggctggattgcaatgacacacttggcttattgcaacctctgcctcctgggttcaagtgattctcctgcctcagcctcctgaatagctgggattacaggcatgcactaccacacctggctaattttgtatttttagcagacagggggtttcactctgttggccaggctggtctcgaactcctgacctcaggttatctgcccacctcagcctcccaaagtgctgggattacaggcatgagtcaccacgcccagccaaccacacttcttaaggctagataaatacatagctttaagtgtagagtaaatggtgtctcacttgcaaagaagaggatctcttggtcctctcctttccccaaccccaaataatggctttgctattggcaatgtaaggtgggtcggaaagtttgtgaagcaatggccaagggccttatggaacaggcatactgcaggggtggcgtggtcataagttgctgatgaagcagattctctgtcactcatgcctggtgaacaggcggggactcccttcttcaagagagacaggtgatgatagaagagtagacagccctgaacaaacctttcctcaggattgtcccttttggtattactcagacctgaataatacatggacatgttttatagggaattttttttcagctttttgggtgatctattattaggatcttattaaaatatgtataattttaaaactaggtatacacttcttatgcttatagttcttatgcaactatagagccaaaacaaattaataaatgaaatcaactatatctgagcagacctcaggatttgagagagagagagaaaaagaaatcaaatataactatgaaacccaataaaatttaaattattttaatgtgatagataatgtggttttgttgaaactaatcactagtgtggaacttaaagatagacacagtagaaccatgtatcctcagggtctggtctatgtttaaatctgttatttaaatgtattaatttcatgcaaagcatgcctgttagtgtaagtatgttgaacaaattgttattaatagctttgagggttcataagttcaggaaaataagatcttaacccaaactctgtagtaagcaatcatcgaatgtcagtttctatgaggtgtcatttgataattttttaaattgtttactcacttgaagatagggttagcattgtgttgatattaaaattggtactaaatggatatctaatccatttactaacagaatcagggacagaaccattcttctttgtgtgtttatgcctcaagtttctgcttataagctggtatgtgttagtatgtaaaaagccaaagtccccatagcacatctgctcacagcgtgaagatggcatcgaatcctatggctgagtagattgaactgcctcatgccatgcaacgactcagttttcccaacatttcctctatgtccagattgatccttgacttcatctggctttcactgggcatttgtgcaattgtaaacaccaatgaaaagccaggcagtgaaattgcatgatggttactgcttgtattaaaatgttaaattataatcgaagacagaaaattttttaaatcctagaactcttgtggactgcaagatatttatcctttgagacaaactgctttaaaattaaatttgggctccacggttctcaggaaaacttttctcatttgtggtctttcctttaagttccattaataattaaaaatgacaattgtgaggacttctgagtaatgagtgtttattatgctctaaaatttaagataagcactttacatatgtaatctcatgaaaaccttgtaattggtgtgaggtgagtgctttggctattttacatgtgaggacacatgacaccaagaaaaggtcaatcacatgacaagtaagtggcagcagcggaatttgaacctatatctttctcattgcaacgcccaagccttacacactaaagcctcttcttatgtctccatttcacattgtgaaaacctgtttaactgcaactaggaaccagtgctctacaattatcctcttacattcctgtcttttccattgggccagtgggtctcaatctttaatatgcatcagaatcacctggagtgctttttgaaaaatgcaggtcccagatgccactccgaatttactgaataagaaattgtctgtgcaaatgtccagggggcctgaatcttttaaaacaacctccctcaggtgattctgttgcaggtgtctgtctgatcacattttgtgtaaaactgcattagactgtggatgcctcaagaaccatgacttttgaaaaaatccatccttgtacctcaaggactcactcactaaatgcttgtcaaataagtaaaagaatgaatgaaggggcaattgtcaagaaagatgtgttcttgggaagaatacgcttttggccagacccttggaaaatttagagatgcatgtttaaatatcacttaatatactcggtctagactctccttcctggaggccaagcatggcaaagagccgatgagagggtggtagaaagtacaaatctatctataaaaaaaagaatgaaaatgctcctgaccatccaggatgagatagaataaatcttcccctgcgtttctaaaactaaagtcaattgaactagaaatatttaaatgcacttgaggcccagaaagagattcatttccttaatgttttgtggacttgacgttttctacttaaatcatagctctaaggtcaatatggatttgttaccggcaaggggtcccaatctacaccccaagagagggttcttagacctcacgtgagaaagagttctgggcaagtctataaagtgaaagcaagtttattagagaaggaaagaaacaaaagaatggctactccataggcagagcagtggcatgagctgctcaattgggtatacttgtagttatttcttgattatatgctaaataaggagtggataattcgtgagttttctggaaaaggggcagggatttcctttggaactgaggatccctaccctttttagactatatgaggtaacttccagatgttgccatggcatttgtaaactgttatagcgctggtgggaatgtcttttagcatgttaatgcattataattagcgtctaatgagcagtgaggatgaccacaggtcactttcatcaccatcttggttttggtgggatttggtaggtttctttactgcatcctgctttatcagcagggtctttgtgacctgtatgtgtcttgtgccaacgtcctgtctcatcctgggactaagaatgccttaacctcctgggaatgccacccagcaggtctcagtctcattttacccagtccctattcaagatggagttgctctggttcaaatgcctctgacagattcattcctgtatttagcaagaggttttttccttttttttttttttgagtacttactaagagtcttgtatttaataagacatagtcctttccctttctgagtttattttcagttagaaaattccgggagcagtaaaagagcaatgcaagtaaatggggggctagttgctcagaatctgcaaatgtaagagtgcatggaagggtttgtatagccaggggactggtgctggatgctgcaaattgaataagaattggaataaattggatagccaggtagcaaagagcagtggaacagacacttggcagtcagattgcttatggctggctggttcagttaacagtgaggacaggagcctagggtggtgggatatttgccttggggagcatggggaaataacattgcatagatgggttttctgacattaaatagagctttggatgttgtggaattttgaacatttcctttatctgaaagccggtgaagtgttgtcttaagatgtgacagcagtatgtaagcaaattgcaggggataagaaatcaagtcagggagacccattagagggctgcattctcagaacaaggagcactgaggaaaaaattaaaaaacaaacaaacaaaaacaaaaaaagaaggttgctttcggtagtccagatgtgaagggacagggtttagaccagggtggtggagtgcagaaagaaaagccagagggatgtggaaggacaagatggcatgaccacgaatggtggcaaaggcagcgtggaacaagcacatcagctgatgtggaatgtatgagaacaaaaacactcattttcccaccagaacccttagtaggagaaagtgccttaagcttacagtgaggattccaaattgaaattgctcagtagctgtttcaccctttgttactggcagagcagatggctctggaagagactaggactacttgttgcttctctttcccatctctcaccactccccaaccttatcccatagtgaggaccactcactagtgacatttctgcttgagacctacaaagcaagtcttgctaatgagacttaggcactttttcccaaagtgcaattcttggaaatctgtgggttttaagtagattacagggccacagttccgtggtcaaattagttcaaaaaatattgttagagaattaagcaagtttctttactgcaggatgtcccacagtctttaatatggtaatcaacattttgactatccaagagagggcgagcttagagcactccacaaactttttggatcatggagctctttttaaaagaagcaccttgagagaagaggatggcacagcatatatttaaagaaattagggactagaaagtttgtctcttgcactagaggttggtagtgtcatgcaaagaaacaagagttgggatttgggtccaggctttgccactaactggtgatcttgggtaagtcattgaatgtctctgagcctcagtttccccaggggttatgttcattctaaatgaactcttcagctcctttcaaaagtctgtcttcatattcaaaaaggaaaataatctgcaatttctctactctgcaataactctggtggtggaggcagtggtaggaaaagagagagtagagcggacagtgacaagaagatgaataagatacggtctgaacccctgcactgattagactgttgggcacaattacagtgctgggctgatgtaacaaagataaatgaagtttgtagtgtgttctcaagcttctctgactccaaccacatcatgtgatatacagcaactagttcagttgctaagcaacactaattcccaatggtcacttaatccatctagtctcagttctgctactaagaagctgtgaggccttggataaatcagttaaccctttgggtttgggttttcttcatccgtaaaataaggaagttgggttaggtctggaaccatttttaagttgacctgagtcttacctggaagaaggtaaaggaaacacagctattctcctctcacccaccccatgcagatgagccccaacattctgtcttcgcttttcttctcttccttcctcctggatcacttaatctgtctcagactttaattattgcatttatgtagttgaagttcaaatgtggatctctaagaccaacccttctcttgaatgccaaaatcaagatgtgtctacctgttttcattctaaggaaaccaaattacttatgtttcaaaccaaactcacaatctccccttacaaaccaattcctcctccacgttaaaaaaaaaataataataataacaggccaggtgtggtggctcacgcctgtaatcccaacattttgggaggccaaggaaggcagatcacttgaggtcaggagttcgagaacagcctggccaacatggtgaaagcccatctctactaaaagtacaaaaattagcagggtagggtggtgcgcacctgtaatctcagctactcaggaggctgaggcaggagaatcgcttgaacctgggaggcagaggttgcagtgaactaagactgcaccactgccctccagcctgggcaacagagtgagactccatctcaaaaataaatacataaataaataaataactatgtgctcctggtcacatgcagcccagactcccaggcttttcgactccctccttcttccctcctgtgctagtcattggtcaattctcaatcctctccacattattattattattttttgagacagagtcttgctctgttaccctggctgtagtgcagtggctcgatctcagctcactgcagcctaagccttccaggttcaagtaattctcatgtctcagcctcccaagtagctgagattacagtggatgtgtgccaccatgcccagctaatttttgtatttttagtagagacatgttttcatcatgttggccaaggtggtcttgaactcctggcctcaagtgatccacctgccttggcctcccaaagtgctgggattacaggcatgaaccaccgcacccagcccctctccacattattatatgtccacattatttatttccctttcctgatgtcattattgtacatcaggctttcattggtcatcctgccccaggtctctcctccaaagcaacccacatgccaggttcagcctcacagagcttctctgagcctgccatcccactctccaaagcctttcccggctctcttgtgctcactccttgctggcatttggagccctgcgttttcccacctcaatcatcttccagcttccagctttgtcttcgattacctgtgtgttcctgtcctcccaccaactatttattaatcttcttatcccataacttgcccattcaaattgttcccttttcttagacttttgtctgcattctttctatctgacaaaatcctagtgatatttcaagagtcagctcaaataatggctcctcactccaacaaatctttagggaacactcaactggcttgatttctccttcttttagcaccttgttctttcctttcttactaccttaccaacccagacatatatatctactatatcttgtaatatccattatatcttttttgaggccaaggaacatgtttccttcatctttctatcaactatagtacatattacatactaggaactcagaaacgtggttgaacaaattactattaaattattaagctattaaaacaataatctattgaaataatgtaataatcttaatctcctaacaaaatactaataaaatttaagtaaaataaataatctacaataatccaaaaatgagtcgaatcttggtttactctttggtgttttgtcattctactttcgtgtcaagcttagaaataattttctgaagaattttgattttgattttagttataactttgcgttagtaagaccatcagcctacggttaaggatatttgtctcacctgtgaaatctcactatctccatgaaaccgactggcttcgctacatcatgggaagggtgttatctttcctagttggagcatcatatgatgatgtggttgaaaacatgcactttggcataagacagacttggtttggaattctgactctgcccttgttggggctgcttggggaatttagttagcatctctaaatattagtttgctcatttgtaaatggaggatgtaattgcaggtgctggttctactcttggaaggattcaaaaattgtcatgcttacccgaggggctcctccaaacctgggcggggttttctgtatgccttatggacctacaaatgcaaaccacactgaccatgtaattttgggggcagattggaaagctgaaacagaagtgcagggactgttggtgcccatcttcctggcctggtggggaggaatgtaggaaagcagactcgtgcttctcatcttgaatcagacagacgacagacactccaggaaattccttttgtttggaaaagaaaaatgctctgccatcttctcttaccccagttttctacattcccagacttcctaaaagagtagaccactggggttccctgaaaagccagctaagtccagcacatacgatcagccccacagctcattttggttcacagacaataaggagagaggacttaacaattactgagtgctgagtacccactatgtggtaggaacattttgtacataattacaattatgcatcctcataactttatcacataagtatcatctctattttacaagtagacactaagcaacctcccaagattgtacagctagtaaatctgagtgaggaagtgaactcagatggtctacaaaacttttagcatttgtggccaggcatggtggcttacacctctaatcccagcactttgggaggctgaggtgggaggattgcttgaactcaggagttagagatcagcctgggctacaatggcaaaaccttgtctgtacaaaaaatacaaaagttagctgggcgtggtggcacacacctgcagtcccagctacttgggaggctgaggtaggaggatcacttgaaccaagaggtggaggttgcagtgagccatgatcacgccactgcactccagcctgtgtgacagaacaaggccctgtcttaaaaaacaaacaagcaaacaaacaaacaaagaaacttttagcatttgagaccttcagtgtgatcaaagcaaattagctttgtgaggtggggtttcctttagcttctacgtcagcaaaattgtgaaccaacaggattaaccttttgccgtcttagtactgcagggaactagctttcagaaaattgtttgggggccgggcatggtggcttgtgcctgtaatcccagcactttgggaggccaaggtgagtggattgcctgaggtcaggagtttgagaccagcctgggcaacatgtcgaaaccctgtctctactaaaaatataaaaactagccaggcatggtggcgagtgcctgtaatcccaggtacttaggaagctgaggcatgagaatcgcttgaacccgagaggcggaggttgcagtggctgagatcatggatcgtgccactgcactccagcctggatgatagaatgagactctgtctcaaaaaaaaaaaaatactgtttggggacatttgggtcctattttcttccctgatgctgatgtgatgctgatgatagtgagtgtttcaagaaccaggagaggctggttgttgtaaacattcctataaacgttggctcagagattgttaatgtaagtttttctggagcagtgaggtaagccccaagtagaaaagggcagaagtatagtaaaatttggttgttttgtcaactttgtaagacttcagctgcataccttgttaggaaactagaagccggaggaaagttgtgctgagatgtgtagcatttgttcttgctttgtgtggccattttattcccattaagtactgtatccttcactaaagaaatgggccattcagcagcccgcctgaacactgtggcactgtatattgttatagagagttatatccattcagagggacacaacagatcagaggaaaggaaagaggtaaccatgtatgcagacgtggaactgtccccaacatgtataatagacaagccaaggtgaaatgtatagcatactaatattcaactttttaaatttaaaaaactatgcatctcaaggcatggtggctcacatctataatcccagcactttgtgaggccgaggtgggaggatcgcttgattgcctgaagccaggagttggagaccagcttgggcaacatagcaagacctggtctctacaaaaaatacaaaaattagctgggcatggtggtgtgtgcctgtagtcctagctacttaaaaggccgaggcaaaaggatcacttgagcctgggggttcaaggctgtagtgagctatgatcactccactgcactccagcctgggcaacaaagcaacaccctgtctaaagaatacaacagcaaacaaacaaacaaaaaaccaaaaaccctcaaacactataaatccatagtttttatatatgtgtaaactatttctagaaaattactcaagtaactgataattagttatatctgaaggagggtgatggtgcggtggaaatgagactcacttttcatcgtgtggagcagtgattcccagtgtgttctgggattctggggagtccttgagaccctttcaggagatccatagatcaaaattattttaataataatactaagttgtttttattctcattctctcacgagtgtacggtggagttttccagaggctcagtgacatgtgccattgcagcacattgaatccagaagcagatacgataatccaactgtgtctggtcaagccaaatatttaagagattttaaaaaatgtaaaatgatgtcattcttctcatgttgaagataaagttatttttataacaattttgaagataaagttatttttataacaattattattcaacaaaattactattatttaatgagttaatacacaataaatttcaaattctcagttttaatttcttaactgggcaagtatcagtttaggtataaacaacatccctccgagatcctctgggatacatccaattcctttagtgcctggtgtgcttggaaggtttctgttgcacggcgctggacaggagtgccaaagaggaaagaaatgtgaatggaaccaaagtctataataaaatattgctttctctttttcccagcctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatgtaagtaggtccagtcactgaggctctgttaccacatgagattgggagtggtgtggctcacattgaatccccccacttatcctgcctggtgtcacagggaaagttgaacacttggtttctgtgcctagagctgctatcagatgagaagacaatgtatttgactatataggaaatctgttgtggactgtcaattaactcattttcacttccgttgatttggttgtgaccagccctagattagagggcagttttagagtgtcctggcctagaatgtcttcctcagttttgagtaagccagggtacctggcctctttctgggacttctctgcccttacaggacccactggaatctgtagggttccagcgtcaatctgtgttttctaatattacaatttgtttttattttttatttttaacaattattttataagttgttttcttctgggaataatttgaggtgatttagagtaaaacaatacttaatagaagcactacaaccaggataatagtacaagagtcctgtaattatattttgggggaattaaatgtaagaaaacctagcccagggatactgattgcagattcatacagcgcttagctgggactcaaggcaaaaagagaagcatgctatattgcagaacttttattaggaaaccatttccacatatcaaggtggtctgctgcaggtgaattttggtctgaatgggacttctcagttcatcctttggcaggctaaaatcccactgaggatctagaactgtagcaatttctagattgtgtctgagaccttcccagcctggagctccatatctccttcatgcctgtgcctctagcatctagcacagggtctgacacatggaggatgctcagcgagagccctcagattcaacttaggctttactgtattctgcacagcttctggaatgagtgctgaatgaatgaatgagtgagtaaataatgtgaatgattattgggataagggtggggctaaagtggtattttcttacattccccagaagatttcttctccctgtcaagatgctttttggattatctcttcctttctgtttattatctagggaatgcctcgctgctctttagcttcctggtggtaataattcacttcatagtttaatgtcttaggtttccttcttcccacagattgccttcaaatttgccttttcttcctccctccctttcttccttcctccctcctttccttcctcttttccttccttatgatagactcttggtatgggggagttaagaggtcttaacttgagccttcacagtgtatattttagaatgaataattcattgctatgcttcaccaccaaccagaaattattacagggtttctctattacatgagatttttcaaacattatttatctatgatttgttccgctttacctttcagaaactatcactgtggtcttttcttcccctgccactggagttttttttttttttttattttttttgttaacagggttttgctctgtcacccaggctggagagtagcagtgtaatcttgtgcaatcttggctcactgcaacctctgcctccaggctcaaattatcctcccacctcagcctcccaagtagctggaaatacaggcacacgccaccactttgtattttttgtggagatgagggtctcactatgttgtccaggctggtcttgaactcctgagctcaagcaatcctaccaccgtgccctcctaaagtgctgggattacaggcgtgagccaccatgcctgggcaccaatcttaaacaatgatttccataaattactattagaatattcaaggcatatgctatatatagccttgtcctgtgaagcctgattttggtgcactcctccacccccactgtcatattatccctggaactatctcaaacaccttggctcctccaggaagagtccttctggtcaccaattcaggctcattctctttctgggaacgatcagactgagtttttcaatctgtttagagatttactaagttttagtttcttgtgtttcttattaatagggagaccaaataattcagcatccaatctggagaactaatgaggacaggagaagttattaataggtaatctggaacataaggcatactctggatgggtagccacctgcttttcaaagatcttgcctctttaatgggtactgagagcagaagggtaacaacagcctttggagattgaactcctgaattctgttcagttgtctggggctagggaactctgacacagatattgtagcactgagtatttctaacaagctgtggggggcctgtcccctagtggatgttagagttcccagagggagaagtcaagaccactgcagcaccgacggccccgtgcttatgagatccagtggtggtacccctagtcagtcttcctccaccctctccttcctcttttcccttctcctccccttcttcccttcccctccccactccccagtctgctcccttctctttttgatccttattctctccctctcccttccaacgcccccacctcggctccctcttgttttgttttctctttccatcgccttctctttctccattttcttctctccctttgccattcacagtgtcttcctttccttttctcttctaaaatggctcttccaaaatcactggagggcagctcaaaagagcaactctgccaatattaatttctccttgaaagggaaaagcctgcatttccaattatgacttagtcttcattagttagaaactgtcttttttccacagcaagtggcctaggaatggtgtgtttctcgcaagtctctggtcggaggtcctggttttatgtattctgctgtgcacgctttctagggcatgaagacagggcaggctgggccattggaggtgggggtggcagtgaggatggcggtctggctgtgacaggaacacacctggaaatgtctgcttgtcacagaatggattgcagctgaagtaaacaaaactctgtgatcatgttgctgcataaacctcgatgtctgaaatttgggacgatggctgtgccaggattattttagaaaggcaagctcaggatcagtgttcaactaaccagagaatctacagctgctgtggatgtccctccaccagagagagagagagcctagcagaaactgaggagagaagctcttcaggccgctcaatggctcacgtctgtagtcccagcactttgggaggccgaggaggaaggatcacttgagccaggttggagagcagcttgggcaacgtggcaagaccttgtctgtacaaaaaaaaaaaaaaaaaatgccaggtatgatggggcctgcctgtcgttccagctactggggaggctgaggctgaagaatggtttgagcctgggaggttgaggcatggtaagccctgttcacatcattgcactccagcctgggtgacagaatgagaccctgtctcaaaaaataaataaataaataaataaaagttcttcaaagaggaatggaggggaggaaccaagggctgacatggacaattctaggtaaacagggctccagaaacattctgaaaagcataagctgagagcagacttcagtaacatgaagaaagaactggggaggaggggagcggtctagagaataacatgctcttatttgttcatgggattcataaactgtggacaatatttttatttaccaaaaaggtaacaaagtttattgagcacctgtgatgtgtaagggactctggaagtattttgaagggatacaaatataaataagagataactccagccttggtttctcatgggctaataggaaaggaaaggaatgaaaaagagaattacactcaagggaggtaagcatgagtcaggacctgacaaatggttgaaggaaggaaaggacacttgtagctgggatgttcaaggaacacatgctttgaatatggagggtgtggagcttgacctaagccttgggggctaggaaggaatttgatatgcagaaggaaagatgtgggtcattatccttggagctgacctaggcagtgaggacccagagtgatctggcgaacacagactgtgctgggcatgtggagtggaggggaggtaggaaacggctgtctacttggggcagaggattgggttgaggagtggtggaagataatactggaaaagaggacacttgccagaatgtggaaagccctgactgttggctgggctaagacatctggacagtctggacaccattttagggattcagcacgtgcgttttacgtgctctagcagggaaggatgactttactgttagagatgctcatttctgatgtccctctcgctgagtgtgagtgcagtcctgaataagattaaaggtgtcataactataaaccatttggaaaatgtaaaaatatatatgcatgagacacttggagcaaggattttctaaggtctcaatttcttgtttttgctttgattgttatagcttataagagtagatttaagggttagccacaaactctattactgtcagagcagatttgggctgctaggtagaatcttattttcactgtttcaattctcatttctttgtaattttttgtattatactacatattttagccccaaattgtgggctgcaggaacaacgttaagtatttcttgctggctgtgttcactgaattgcttcctgagcctgaacttgctcaaacttcctgttttttgggcacagaactcctggtttctccatttatgatggatgagaggggtttggagtctctcttctagactttcatagcatgtttcaggatttctcactgatatctaattgtcttataagagacattaaatttttttcacactcaaaaatccatgatcccctctaggtaaggtctgagtctctgtcaaacattttcgcttttgtgtaacatttagcacagtatttatcaggcattattttgtttgggggtagaggaggtaggcggcggtgggcagttgggaccccccgtacttatgttctgctccaatattgtcttgtagaaaatggtctaaaatagatctttactatctgaaatatcatctagtgagagcattggcatcatcaaagagcttgttaaaaatgcaggatctaggacctcagactaaatcagaatctgtaatttgattggcctttgagacttgctggtctccagatgtaatgtatacacatcacctagggatcatgttaaatgcaggttctgacactcaattacttaggtaatgatcaaacaaccagatcttgaagttttctaacatcaaagcagcaacttcctttctagagttgtcaccggacaccttccctcctgagagtgacacttctgcacagaacagatggtttatgacaggagttggaaaactgtggcctgctggtggcatccagcctgccacctctttttgcaaagaaagttttattagatcacagtgacgctcatgtatttacatattgtctgtggcttcttttgtgctgtactgactgagttgaatagttgtaaaggagactgcatgacacacaaagccaaaagtatttactatctgggactttatagaaaacagtttgctgaccctggcttatgtgagtgactctaaatatttccttaaagaatcaaatagctatactctcttgccccagtggcaaacttcgcaagcccatctgaatccatggctattcatagagaagctgaaccataaaccgtcattcccaggcaacccacaaagggtcttgagcctaaaattggtctggataatggtaccacagagcctgtgactttccaaaatccatttaatatgtccctcctcaaagaaatggttataattttatataattttattgagctgactccctcctccacaaattgatttcattaattgttcaacataagtctgactttccccaagaattggaatcaaaaggaaattctgagtaaaaatatatctgggaccaaggaaataaaaagacttgtacaagttggttataatacacattttactcctaaaaaggtagcgttggttttggccccactctggcctattcactgggcagactgtatgggcttggagtccttcttttaattcccttggagaatcccaccacctgtctcttatttgggtttttgaattgtgaaatgatggcacacacaagctccaagaatagctgcgtgtgtacaccaagcatacagagacagaaggcagagacttaggccaaggatcaggaaatacagaagagaagctggcatggaggcatctgctccacaaacacagtgaagccggaggttgtaggaggagggaggtgggacccgtgtaatcactggaggatgtgggcactctgctctgctctgcaagtcttggagatcttggttttctttccagaaccaaatttcagaggaggtgggtgtaggagaattgagattctttttcctcatccagagttatctggggccaaagaggtttagggtgagattctgtgggaatctttgctgtagctccagaagctttattcttacttagttccttttccctttgtctgcatagtccaggacactaaaagggtttgtgaagagtccgggtagacataagtggagagtcttctccttaattctagagtctatcttgacttcaaccaattaaagattgtaggagtgaattagagccccttatgttaaaccttgtttcttggaagccctcctggaattccctaagatgcagagctgattagcttagctggtcagaatgtgaaggttttaaagccaaagttattatttgggctgatattttagacattctcttcattggaagaagtacaatgtattcattcattcattcattcactcattcattcattcactcagtgaatatccattgaaaacctattgtgtaacaggatgcaggaaaaacctgaactggagagtcagacacatctgagttcaaattctagtttcttgatctgtgagctaactaacacctcattcagctttccatccaggtgacataaccaccccagcttccttccctgaatctgcaggttaggttggacatttacttctctgcttttgcagcaacttctacaccgtctgttctcataccacattatatggaaattatccatttgcagtctgtctctctctccagattgtaaagtcattgatagaaaagagcttcatttcacatacttttttacccttagtgcctgacatatattagaaattagacatatgtttattgcactgaaaagaacctaattgtgtggcttaatttccctaaagcatgtgtttctcatctgtaaaatgaaggtgataaaaacatgccttgtgagttttttgtgaagatcaaatcagataatgtttgaatgagtgttttataaatatgaagtgcttgcaaatactaatagttgttctaatatctggattgattgcgattcagtagaaaacaagcagaagagaatcaagaaagtatgtggaggtgtcctagtccactttttctaaactgaataactgaacgagggggatctggagacttcagcttctgaggcacagtttgggtgtgtggggttgacacgggacagaggaccctttccagcaagctcgatgtctctgccattagattatatactcataacagtggggatatgttttattaatttcattgcccctttattcaccctaagcataactaagaaagtgaatatgtaataattggatttcaatgggcattgcaaggccaaagtctcctgccccccaaatctcccagtatccctggcctgtatgtatcttttcttgagaacctgaataatggaaccattagattgaaaacatagattggggagaagagagtgagttgaatttgaaaaatgttgagtgtgacatctggcagtcaaatatgcagggctgactcatttcacttttcatgtgtctgttttagctcacaaactagacatagagctcattgtacagattccatagtgcttaatgcactggctaccccttaaaaaacctatagagcttgctggagggggtcccctatctcatgtcaactcaataaataaatatgtatggatttgttgcaaaatattggattttcttttccatgtaagtaacaaagaactgctgcagatatttgagcagagttgtaaaatgatatgaattttgctgtgagaaaacttgatcttgctgtaatgtatgaaaaagactagaagggaaagaagttgagggtggagagtcttgttaggagggccaggataagagcaggtgggcggtgaaggaggctgcggcagaaccatgccaagcagaatggagtggaggggacttgactacacaagaggctggtgactcagctttctgcctagtattagtcctagagaagtctccctgctctgggaagaccggtgtctagcctcatgtggcttcggaacaaaagccagtgattgcatccaagggaagataatgagaaacacacaggccgtgaaaatcaggaaagcaccactaatctttttgttgcaaaactttacttttcaaagtcctggggaagggtgcagaagcctcagcacgtggacttgagccctgtactcggaaatgcaaaatggaaaccccctaatagatcacagaactgaaaatatccaagagtctgagaggctgggggaggacaggagtgagaaaaggaagggggctggagtactgatcagaagataggagaaagcaacagtgcaaaatgcggggaagggctgagtagacattcaatttaatctggacttttattttgctacaaactaattttatgaagactttttttgcccaaatattaaatatttattaattaaagatattaaaacaggaaaaactgctttcattcaataaaaactctagtaattcttcctaactccagaattgtatgtatatgttttacctattaaataatcagaaatagaaacaaattagacaagatacgtgaataaccttaaaaattttccataatatttgacttaggaactttagttttatgaatgtactctaaggaataccctgaaaaggacaaaatctatacacaaagattatacacaaatttattatagaattatgtactaaaaaaccctaaatgaccagccttgagtatatggttaaatatataagttataagcctttgggttttgagagttttagataacacaagaaggtatttatgatattatattaaatcaagataaaagtcacaatgtaatataaagatatacaatcaatgatgtaaaagtacatagaagaaaactctaatgaaaatatgccaaattgttaactatgatgacttttaggttacggaattatgggaccatttttgtttccttatgcaattgaaaagtcataaatgagcatgcatcactttttcatcagaaaaataaatgagttacatatttttttaaagggaagatattgtaaaggaatatttgttgacagaatgcattaaaaaacctaggtaatttccttatttccctgggattctgagaatttttttactcttgggaatatctttccttgctcttagttattttcatatgttagtcttgttcctggggataaaaaatggtaagtttgctatttgagctctgctcgaacatatggagtagttctctcttacatatacagaattggtttgacattcaaggtctttcagagtcaaatcccaattgatcttcccaatttcacttcccttagtttcctacgtatattttctacacaaatcaaaaaccttttcagacttcctatttcttgtacatgtccataacctcccctttctgaaactctacttgttcctggggacagaatgttcacagagcatgcgttaaacatcataaagtggatcgggagcctcttttaacataaggctgtgtgattttgacaaggcagttagctcaccctctagatctcagatggaacacctgtaaaacaagggactatgttgtagatggttgccaacattccttgcagtgctacagctgagtgaaccttgttccctcatggccctaggtgtgctcattcatctgcctgcaccttgtctcaggttcccactgcatcttaagtggcccctgcccaccccactgtcaaatttgacccttcctagctcatgtaccatttcctttataatgccgtcctcagtgattctgattaacagggacttgcatgtatgattttttttttttttttgccactcatacaggctgccttttatcaaaactatggcacatgtcaatgatataacagataatatcatttgaataaaaagtcaactccatggggaggaaaaaaacctacttaagtgagctttagagataaaggtgaacacttctctaaatcctttgtttatggtctgttaatcaataaagtccaatctgtgatccccagatacataagaggagaaggatatgtagactatttatgatatttctgaaaatcctaagaaaaatcacacacaggcccacagtaagtctatgtttctttattttgagtcagaggatttcttttttccatttttaaccagtataaattggtttaaacttcatctcttgaataactcctaacatgaccagagcccttttcttccttcaaatttccacaaatgcattgctccccttttttcttttcaccacccatatgtccatgttggacaaaaaccatgaaggaaggaggttgagaaactgtgtaccaaaacgccaagagcatctttgccatgttccagcacaaagggcactgttagaaggaggtgatcagagtcatcttctgactcaacctcacaagaggagtcaggttagatgaacagttcccaactatttactctcctctctctctcattctctctctcgcattctttttccttctgttttttattagcagcacaaaagattttgaagtgcttaagggcagaaagcttgccttgttcatctatgcagctcttgctgggaccaagtatggtgctaaacacacggtagacattcagtaagtatttgtggaatgaatgaatgagcaaatgaaggacaggtgtggcttcgatggcaatgggtcagtgtgaactccggaaagagtatgcagagttatagtcaaagtggatgatggatcattgctctgacttactagttatgtaatcttgagtaaacccctttatcactgtgggattaatttccccagctgttgaaaaaatgtgtgtgggggaaagggggagggttagtgattaaaaatgtgttccataaggagcatgtatgtaaaatcatctggcacatggttgcagctgaatagctggcatttatgtagcactttattttttctgcattttttaaaaattaaaaacctgaaaattgttaagttgtactaacctcaaatctcaccacttaagaattatataaaataagaagtaaaatttctcttcccagccaacttttctaattccccagagataactacttttcttaacatttaagtttgatgtttatccttcttgacatttttctaaagtttcatatatatatattttttataattatttaatatatatgtaaactcatgaatatatatatgcaaactcataaatatatatatatatatctccatgcaactttggatggagatatatatacacacatatcattttcaaaatggaactattcatatatgtctatctatctatctatctatcaatcatctatctatctccaagtcaattatttttgaatgatggcagaatcatttgttgtttgaatataccatattttgctgccagtcacccagttccagtgttttgtgattacaaacaataatgcaagggtcttccttgtacatctatatctgtaagcttttgtacagtacttactttagtaataaggcacttgaacacttattattctctttactcataaccaccacaagaagaaaggacagaaattgttattctgtgttacagatgaagaaaaaggagagctaaagggggcaactggcttggccagagacccacacagatagactatggcagaccccgtgtttcccagtggcttgaatttttgtccagagctctttttgtcacactgcaataaagcacaagtcaacaggaaacctttacaaccaggcagagaagcttggatcagggagcaggcagtcacactaaattgtagaaaagaacaaacacacacacacaaacaagaagctcgaggccaaacacatttaaaggatattatttggaagaaatgcactggtggtgagtgagggaccagcataagaagagctgtcctttaactagttaccatgttttatgcaatgttctcaatatgatatccaaatgattaggatggcttagattgcataaatgaggcaggagaatgacaaaggacacccccacaaccccaacaatgacactacccctctccctcaagggaagtgtctagggaaggccagtcagcatctggttaggcttggccttaattgtcatcttcctcaattatctgcaggaaatattagctgttattaaaatttgcagatgcagtcaattgtcagagtcactggagaccaagaattattactcagagcattggagagaggctggaaagaaaaagaacaattcagcctggaaaaatgtaaactaatggataaagtgaggtagggggagtgggggaagaatttagagggataaggccagtagtagggtgaggcagtgaagcactcccctggagtacaaactttaaggggatgccaaaaactcagctatcaagataaataaaattttaattcaatattgaaaaaaatcaagttggcaaatgacagcctgtgggccagcagcctgtttgtaaatacaattttattggaaagccactggaagtaaaggtactgtggcaggggagatccaggctaattctttgatgtgaaaaccctggttaggcttgtgaatgttagacacattagaccttagcttgtgattgatgggaaaaatatttctgaagaaaaggaataatggatctgactgcttttatgggtttcctggggttactgtaacaagtgatcacaaactgggtggcttaggacaacagatattgattgtctcacagttctggaggctagaagtccaagatcaaggtgtcagcagggccatattccctctgaaggttctagagaagcatctttctttgacatctaatttttgatggctcttgcaatcactccaatctctgccttgatgtttacatactcttcattgtgtatgtctctctgtctttgtgtccgtctctctgtctttgtgtccacatctttttctcctttcccttagatcctagtcattgggtgacatcccaatccagataacctcattttaacttggtaacatctgcaaagaccctagtttcaaataagattacattcctaagattacctatgaatataaccttaactctttggttccttatttggaaatagggtctttcttggacacgattcaacccaccacactgttaaagatatctttctaggacacaattcaacccaccatgctattaaataggtagggatgtggagagatttgacttaggcgcagcagaaacattatccattcacagaaatctggcagcggagtcaggggcagactcctgacatgatttaaatacctaagaaaatatttaaggaaaagtactttagttcctttggggcgcaaatattataacctttgctcatgtcacatggtgacaaatacatgcaggatttttaagggtagttctgatttcaaacatgcaaacaatagtgactggaaatatttttactaaattttatattccttttgttactattttattcttctcaatgtaagcaacttattaaattattactataaccgaatataacaacttttagatatttttcacaaaaattcaccaaccggggaaaaacgttgtttgtaaaatgcagtattctgatttttaatttatgaaatatggctgttatgcttctgaagcctgttcaaaggctatgaaacaatggagatgatcgaataccattagaattttaagtaagttgaaatgtaaatgggaaacaaatctattttctcccattttccaaacacatcacagtcaagtccaaaaatttgaatgttacatggctttttagtgaacacttttgttataaacatgcgtgtgtaggtatacttaattgtatcagcaacaataacattagttattttaattattgtatcaccaatcctaatcactaatcaataaatgtatactcattaattaataattcaataataatggctaatatttatgaagtgcttatgtgctagacagaagaattgatccctttatgtgaattatttaatttatgaatacagtaattcttccttagaattggtattctgtttatttgggcttgaaatgttctacatattatttttcctgcttttggtcaggagtcaccagcccatttaaagagagacagctgtatctttctgtaactgggctattttctctatgagtgcattaatgttaacagagaagcatggccagcaagggctgctagcacaaagtgaagggccctgctgtgatgaacagagaaattgggaactttatcattgctgctatagacattatcaactaataacacgtttttaaaattcctgaaaagagtttgctttctaaaggttaaaaaggtttaagttctccctgtaattttgtttatatagatgatttgctttgtaaacatttgttttgtttgtttgtttgtttttgagacagagtcttgctctgtcgcccaggctggagtgcagtggcacgatctcagctcactgcgacctctgcctcctgggttcaagcaattctcctgtctcagcctccccagtagctgggattacaggcatgcgccaccatgcctggctaatttttgtatttttagtagagacgcttcaccatgttggccaggctggtctggaactcctgacctcgtgatctgcctgccttggcctcccaaggtactgggattacaggcgtgagccattgtgcctggcacagctctccattttaaggctttgcaattgattgaatcaggctcgttcaggttacctaggatgatcttcctcacgtaaagtcaacccatgatggattctaatcggtctacagaacttcttcacagcaacacctagatcagtgtttcagtaactggggtctacagcctagccaagctgacagatcagaagagccatgacaacaatgataaaagaaactgttgccctctagtttcctcctgggcattaataatttagctaatataaacccaatactttggatacgattgactgaattcagctttgctgatgcctctgatttcagttgctttaaccaaatgcaaacccctagtgcttctgttgtctgttgatacccagaggctcatgtgatctggaagggtaagtggcttctctctgatttgccagaagaaagtggttatgttagctgaggagccagaacactaatttcagtgatttgactctggtacaagtggtgggaggcccgagggtgggatgctgctttttcctttggccctggtaaacattttatgcttgttatggtggttgaaatgctgtatttaaccttttcttcatgtgccaggaggttcacagtaaatgaggggtgtggtctgtgaagggaaaagtggctgtggcttggcctctttgtaccctgtcagcacacatacacgcatggtctgtaacatgtgaacctatcacgtgggaactcattactgagctgtgagggctgcccctgaggagctgggggcagtggtcgggagaggagaaggtcgtggggcacagtagaaatggcaccggactgggaatgagttcctactgccaacttctcatcagctcagttcctacagtcctctacttactccttcgttgcccaggacatttatttaatgccaggctaagcacaaggcttccaggattcagcagtgaacaagacagatgctacccttgcccttttggagctgactgttgagcaattttaataaatagcaatgatcatatcattagcatttcccgagggttaccatgtcccaaatgtgtgagttatgatagaggaagatggggttattctaggtgaaggccgagaagcttctgggaggcagtgactaataactactgccttttttactttggagtcatgtcctttctgtgactcccctttccttctcctctgtgttctctcccttggccttgtcaggctgcccctggctttggttctctcttcctagtctcctttctaattagcctttctagcccaataaattaagctcttgtctggaatctctagctccctgatggacacctcctcgtgaaagccctcagtatctcaaagacacaacatctgtgaagaactcaactcttccattgtattcttccttccctttcctgtctctgataatgttatcacaattcgttttgtcatttaggtcaaaaacatagtcatctttgacctaccttccctatcatacctaccagtcactcagccctaccctgtctattcccatgatgtctctcatctctccctccatttgtttgtcactctcaatggtcagactgtcttggtcacttttctgggcaattgctatagtttaatgcttgcagttttccctcaactttagttcatcctctttagagctaccagagcacatactcttgatacatcttcttgcgtcactctgttgctcaaaagccttcagtggaccactgctgggctctgcagccaggtgcttgtgttctaaacctggctctgtcacttaccagcttggtaactggaaaattattaaccattctgtgcttctattatttcatctataaaacaattgtgtctgtctcatagagttgtgatggggattaaatgagtcaacatgtaagtagtgcttataaaaaaaagtctgacataattttagcattccgtccaggtagatgctctggctcctggtcctccacattttccctcttgtgccttgactttttgcgtttctaacttttccctgttatatttctgaatagttttttgcaaagtagtgcacaaattagtgcctggatctacacaaactacatcatacatgatgctcttgtctttcttcatattcttttaaagactatatgttatatatttaaacacatatgcatatttatactaaactaagtatatatatgtatacacatatatacatatagattcatgtatactttattgtttcttcattaattgaccaaatgttttgatggtgcctctaaataagtagtacttaggcaaatctccactcatagtattgtggtaaaagattaacttttgaaaactgcccagagaacagctttctatcacattaatcatgagatacagttttgttttttccaatgttctggcggccattctcatgaggatggactgtgctgactgatctcagtgaaagttaccagtgggcatgttctcggggcctctctgtccccatgaagcatccccactcagagacatggaaaacctgtgagatgagctcatacaaatgatttctgggatgaaaatagcaatgtgagatagtgccaggaacttcaggttcacagagtataattaagatttttcctgaatcattgcacactgtaatttcatcacatcattatgtacgttctttaattatgggctctaattgcccattttagttctgtaattagacataaagacattaattttgtaggtataacaatcagctcaaatgtacttccaaattctttcccctacctttcaagaaaaattaatacatcattaaaaagtttgtgcacagaagagcctcttagagggcagcttttgggagccagttggtgttctcaaaggtggggccccagttcagaaagggtatgggaacatcaccctcttatattccccataaactgtgttgcttcatgtcagatagaccctactgggtccagggcagggaagagctccattaattcacatagggccgatttctcttaatcgtaaaattttaaggtgacatcaatgcttaatgagtcatgggagaggaatgaactaatgttagggcaactctggctttttatttctcttgtgtcctattaaaagatgagaagatgaagcattttaggctcatggggtttgtatttttcatttgtgcatgggtagctgattatcatctgtcattatgtgcgtgtgtgtgtgtgtatgtgtgtgtgtgtgagagagagagagagagagagagagagagagagagagacagcaagagagagccagaatctgttttttaagaactctcaatgattcagatctccattttttcccttcacctacagcactttagttaaaacaaaacaaaacaaaacaaaacaaaaaaaccgacgagttccagcatttccccccatggaccatgctatgtccatttcagccgacacattttacatgtgtatctatttgcctccacttacaaatccaaggaaaaaaaggcagtgtggtagagtagaaagagccttagtaagggtcctggcccctttttcttccctttttacacatactctctctctaggtaatctctctattctcgtccttaaaggccgtttatatgcttttgtccctccaatttatatctctagctcaggcctcatctctgagctccagattagataacaatcagaatgcttatttctacttggatgatttacagataatttaagcttgctgtgttcaaagctgggtttactttcctccaaatgtattgcttttctattcttcccaaactcaataaatggcaaaaccatccattcaagtactcaagctgagtcatccttgattattctttcgacatatgagccatcagcaaggcttgtttcaccctccagaacctatcttcaatctgtctgtttccctctccctcaattcaggctgcaatcccaatgcagagtgttcagtaaagcaaaaggggtggtctgctctcaccaaaagcaatttgcatgctcttaattcacggatggattacctagcacttaacacagacccagatatatttggtactcagtaatatacactgaagaatgaatgagtgagttaatgaattaatgaatgaataacagaaactctacctcctaggacttaataatacagagcaggattaacctgctttcataagtaatcagtgaacctggtaaagtgtgacatttatcttttggtgaaagcagctcaccccttttgctttactgtttcaccagcaatctctgttttatttttacctgttcttttggacacacaatttagtcagaaatttgcacctgagtcttacttctgccacctgctagtataaagatcaactggtgcagagcactatacagagattatttattgtttgctacaatgttggatatagagtttcctctctaggacctctttaactgggagggataaaaatggcacaactaaattttcatgatttggataagaagagaaacattgggtgggcatggtggctcatgcctgtaatcccagcactttgaggggctgaggcgggtggatcacctgaggtcaggaatttgagaccagcctggccaacatagggaaaccctgtctctactaaaagtacaaaaaaaaactagccgggcatggtggtgggcacctgtaatttcaactactagggagcctgaggcaggagaatgcttggactcgggaggtggaggttgcagtgagtcaagatcatgctattgcgttccagcctggccaacaagagtgaaactccatctcaaaaaaaaaaagtagaggagaaacattgcttcattcagaaagtgcttcctaagagattcccatggtccagggatgatgctggatggtggagatgtagaataatgtagagattacagggtagcagggatggggatgcacttgtaagccaatgagtagaagaaaggggttctggcggtggcacagcagcaaccacaggacgaaagcaactgcagaggacatgtgctcaattctgtgaggggacgatggcgggacatggaagggtcctgatcatgtcgatgttgatggcaagtctaccagtcaaaaggaacaggtgagcaagggcctgtagcctggaggtggcttggggctttcaaggaaccactttgttagacctgctaaagcatgtgtttcaaagagaatgtacccagctcgaagacttgcacattgtaggcacttagctaatatctgtttaataaatggataagtgaatataagtggcagaaagacagctgagttgctgggacaggtgagatcatggaaggccttgtgtatcatgctaggatcagtaatgggaagtagagaagtggtcaatgaagttttatttaagcagaaaagagaccctattgggttgagttttagaaaaatccctgtggctgcagaaaagaggatggtttggtgggaatgagactgaagtcatgagcacagacaggaagggtaactgaacattttgagagagctgaaagtgtagacaggaagggtgttcaaagattgttggagttcagagagaagtcctcggcctggcctagcagtgtagacagccaaagacagacaagtagtggaatgtcacattctagtaactgattgaaatgtgtgtgtgtttataggcaagtgagttgaaaactgtgtgtgtgcttaagttggaatgtacatgtgcatatatgaaggtgatttgaagtgtgtgtgtgtgtgaatgcagtgtgtggtagtgcattggaacgtgtgtgtgtttacatgagtgcaagtggacagtcaagaatggtgtctaacacttacctatttggtctaaaggctcataaaacttctgccttactcctggtcacatgctccaagtcacaagcagaaatgggcagaacagctcggccttgtaattccagcctgactcacactaagctgtttccaaccaagtgaattaatttctccctccttatgcccacacagcactttcctctacaacaattgttacaccactgttgttattagtttatataatactttaccccctgctaggctgtgaaatcctgaaggaggagaaaatatgttatgtatcatttatctccagagtctagctcattcaggcacatgctaagttctcagctaatgtctgttgaacgaactaaaagaataggcacacttttatagcttattaagctcaaacatagactccaaagcaaaatctcatcattgcctcttgcacattttggaaacaacagcaataatagttaccatttcttgagaacctactgtgtgcaaggcacagtgccaaatactttgggggagccagtgattttatgtgcaatgtttttaaaagtccctggagttaaaaaattcctaggaggtaaatattatccaccccttccacagatgacggaagtgaggctcactaaggataagtaacctgccaagttgcacagctagaaagtagagagctgaaacaggaactcaaagcctgggctccgaacaagcacgccctgcagacttcccttccctgtgatgccccatgctcagttttctattttctttatagtggaaaagtcaatgcccttcctatgagaaataaaagggtttaaagtggtcaaaaggaaacagtgtttcctctgtgctcacggggttttggccaatcacagagggtgaaccaaaaacaatattatgcgagatgtggccagtttgggttgattccagctttggatgctgtgagctggatcccaggagcacacgaggaaaaacgataatagcatacttgagatccaagcccatgttggggtgaggatagaggttttgctttcctcaaactattgcatttttcttttcctccctaagggtccgggcaggatgcttcctaccccagggggccacttccaaatgctgctctgtcacttggtggaaaacttcaaatttactgagggtttactgtggaagacttagtcaagagggcaagtaccctatatctccagattgctttgcacatgttggcattcaattaatattttatttgtcaatggatttaatagctgattacagtttgcaatgctctactcatggataaatcagttgatcttctcaggcttcttatgccttttcccagtggatttttcattgtcgtggataaccccaggaaaaagaggaggcacagaggaacctctcttacatgaataggtggggggatgcaagggaggacttctagcttttcttctcctgacttttctacattccccaggttgagtgactcgtctccatcttttaatttagcatcttggaactgaacagcacctcccaagcaaccctcacctgggaaccaggcagaaacaagtgaaaatgtggaggaggtgtttatgaatttttgggcagtcagtgatttcagggatccaggaagttattctactttctaaaccacttccccacctgctggatatgaatgtaactccctcagctttcagctttcacatctactttatatacaattctatactgcctctcccattttatattatttatacctatgtgctgggacttgagcaaaggtttttttattttttatttttttttattttttaaactttgtacaagggaagccataaagaatttgggcaacttgtagggaagagggagagtgaatttggtgaaaccgaaagtcagtaaaggtcacatgggagatgctgagctctgcagacagatctttcaacgtgaagcagcagtgaagaacatggctctggagtcaaactggctgagctaaagagttgactttgttacctactagttacctattggtagttacctactagttatctactagttacctacctctgttacctactagtgtgaccttgggcaggttaagtaactttttgaacttagtttactgatacataaattagtgataataataattcctgtctcataaagttaccgtgaagattaagtgaggcaatgtatgtggagtgttaaaacagtgcatgacgcagagtaaacacgttaaaatgagctgttattaatatttggttgctaaaggtctgtcctacctgatgtgtctatctctttcaaatacatcctctgggatttagcactagaaacagtcttgcagaaagttagagcagggaggaaccctcaagatcatctaatccaaagtcctcttttgtaaatgaggaatcactggcccaaggtcacggagtaagtcactgagtaatccctctggtctgttgcccagaatgcattccttcccacaaatctggccatgcttgtcctggagggcagatagactagccttccccaggtaaccttgtatcttcccgtaaaaccgtctgtcctcacaaagtggcacaatttctaaggctccctcgggcaacaaagtaggttgtgttcagagaccagtgaggtggagaaactgcccagccactgaactccaggctggacttggtgagtggcactcagtggagtcagagtcctggagacctgcacatcagggagagggtcctgaagaggtcttgaaataatttgacatggaaagagaaaatacaaattttcagagacacagataagcatcatatttttaagccaagaactcagttatatttttgacagtgtggtgtctacagtactaaggcatgttcttacaagagtgacactcactagctcttttttttttttaactttcattttagtttcagtggtatctgtgcaggtttgtcatatagtaatggggatttggtgtacaggtaattttgtcacctgggtaataagcacagtacccaataggttttttttttctgattctctccctcctcccactgaccatcctcaagtaggccccagagtctgttgttccactcctagcatccgtgtgttttccttgtttagctcctacttgtaagtgagaacatgcgatatttggttttctgttcctgtgttaatttgcttaggataatgagatcatgttctctgacatggaaagagaaacacacaaattttcagagacacagatgaccatcatatttttaagtcaagaactcagttatatttttgacagtatggagcctccagctccatccatgttgctgcaaaggacatgatctcattcttttttatggctgcatagtattccatggtgtgtatgtactatgttttctttattcagtctaccattaatgggcatttagtttgattccatgtctttgctattgtggatagtgctgcaatgaacatgtgtctttatggtagaacaatttatagccctttgggtatatacccaataataagattgctgggtcaaacggtaattctccttttagttctttgaggaatcaccacactgccttccacaatcgctgaactaatttgcactcccaccagcagattatgtgtttttttttcaaccttgccaacatctgttttgttttgttttttaataatagctattctgatgagtatgagatggtatcttattatggttttgatttgcagtgctctaatgattagtgatgtcaagtatttttttcgtatgcctgttggccgcatgtacgtctttttttgaaaatgtctgttcatgttctttgcccactttttaatggggttgtttggtttttccttgtaaatttgttcaagttccttatagattctggacattaagtctttgtctgttgttcccctcctagtttgcaaatattttctcccattctgtaggttatttactgttaatagtatcttttgctgtgcaaaatctttttaattagttctcattggtaaatttctgtttttgttgcaattgcttttggtgtcttcatcacgaaatctttgccaagtcctatgtccagaatggtatttcctaggttatcttccaaagtttctatggttttaggttttacatttaagtctttaatccatcttgagttgattttcgtatgtggtatataagataggggtccagtttcaatcttctgcatatggctagccagctatctcaatatcatttattgaatggagagtccttttcctagtgcttggttttgttgattttgttgaagatcagatggttgtaagtatgcagcattatttctgggctctctattcaattacattggtctatatgtctgtttctgtatcagcaccatgctgttttggttactacagccctgcagtatactttgaagttaagtcgagtaacatgatacctcctggtttgttcagctcatttctttcttgttgaagacttcagttcaatggccttagtcatctttggaatggcatttaggattcagttcaatgaccttagtcatctttagaatggcatttaggaaaatggactcctttaccaaaaaggtgaaaaagaaaataatataacccaaccttaaagactatttttttaaggggagagggagaggactttattcataatcctatcagctgaacacattccagtcttcttctataaaaacacaattttttataaagttgaaattatggagctaagacatttctaagaagacttaatttcagttagggacttgctgattatctttgggtaagtcagtctggcttcttttctgggaggagtgttgtgtccatagagacgtgaacatcgacgtctgcttgtttttgtgaggaagcatggtagaatgaagagaacgctgtctggagccaaaagatccagattgaaaccagactttaagcctgggctctgcttccccttttgctggatgaccttgagacagtgtcttaaccttcctggatctgttttttagcttttataaaatagatcactggcatatcagcttgttaacgtgcactgtactcagccttgacacacgggagaaaggttttcagggacagggtgaagatttcatctatatgacctttgactgcagtttggttggttgggttacacaatctacaattgtagattgattgagagtcttttgaaatatgtttttctttatgctagttacccaggtcctctcctctctggtgacagtggtaatttaccagggcattgtgtcctcttttcattaattaggccactcaggcctacccgaatcccaagagaccatttatggatgatgaaggtggtaagatagggttgtagtatgttggacctgctgtcacaaactaccatatgcagggtgacttataattaagagaaatttatttttcacaattctggaggctgggaaatcctagatcaaagtgccagcagatttggtgtctggttaggcctgcttgctggttcagagataactgttttcttgctgtgttgtcacatggcagaagggggaagagaactctctggggtccttagtataagggtactagtcttatccacaagagctctgtcctcatgatctaatcaccccacaaaggcttcaactccaaatgccatgactttgggggtcagatttaaacataggaattttaaggggacacaaacattcagtttatagcagagagtgtatgttcacagcacaggaaggttcacagcagaagggagccattaattgtgtatagactttcatgtctctgctctgattcattgtataatctgcttcattcaaaggaagaaggtaaattttgggtccctcttggaacatttaggtgactcccaccaaatacaggatagctttgagttataacctcatgaagtccctggtcatgtctgtgtgtttgctttggaccagacccaagggcctgtcctgtgtcctgcccgggctcctcccacctctttcctggagaaacccacagtgagagtggagggtgggggtccatgtttatcttggtgggcctcactggagctggacactgctgctctgtttgcccaggcttaagtatgcatctccttttttaactggccagggactttcccccagtcacttggcctgccattgatttgggacttttctgcctaaaacttctaggatgataaggagagcactattacccactgcctgcccaaacctagtagcaacagcagctagtcatgaccagcattcatggctgcaagtactgtcaggccaggggcctgaccagtgaactggaactttacttctctcccaagtgggattagagttcactgagtaggtggccctattaaaatatgtatagcctgtgctaaagttaattctaggggtgagaatgaggcagctctgcttgctggctagcccaggctggcaaagaataatgggtgcaagcaagaataccagagccagattgggttcaaattccaattctattgcttcctaggtatactgacttaggcaagtacttctatttctctgtgtctcagtttcttcacttgtgaaattttcatattttaaggattttgaagatatcattttgaggcttaaaacaatgtatttacttatgtttaacacatgtaattactgatgtttaacttttttggacttataaaaatgacaatgtttagcagagtgctttaaaaacatgacccaactatgtgctttctataagaagcccctttgaatataatgatatagccatgttcaaagaaaaaggatgaagaaagctatattatataaacattaattgaatgaaagcaggagtagctatattaatacatgtgaaaatcctctacaagatattagcaaattgaatacaaccatgtacaaaaagaattacacatcatatcaaattagatttattctaagtatgcaagactggttcaatattttaaaatcatgtgattatattaattgatgcagaaaattatttgacaaaattcaatattcattcatgacttaaaaaaaactctcggcaagttaggaatagaataattacctcaattaaaaagtttacagctaacatcatactttgtgaagaaggacttaatgttttctccctaagacagggatcaaggcaagaatatctgctcctgccactcctattcaacatagcactggaaattctagccattatagaaaagaaattaaaggcatacagattggaaaggaggaaataaaactatatttgaagatgacatgattgcctacagaaaaaaataccaacacatttacaaaaaactctcctagaactaataaattctcctagaactaataagagaccacaggatacaggctcaacaagctcaccggatacaaaaatcaattgtacgtctacatacctataatgaacatgctgacaccagaataagaaatatagtgctaattttaatcactcaaaaataataagtgtaagtacatttaaatatattatatttgtaatgtatattatgtaagtttaaatataataaaacatacataggacttgtatgttgaaggctacaaagactgatgaaagaaataaaaagatctaaataaacagagagacatactatgttcatggaagtacttgacatagtaaagacacaatatactaaagatggcaattctccccaaatcaatatatacatttaatataattcctacccaaatctcagcaacgttgttttttttaaaatagatagaaagaggattattctaaaattttgactaaaggctgaggaaccataatagctagaacaatttttaaaacaaactaagtgggaggaatcagtctaccctatttgaagacttattatatagctgtagtaatcaaggctgtgtggtattgacagaagtacagacatagatcaaaggaatgcaataaagaattcagaaatagacccacacaaatacacctctgtgttgccttatttttcagaaaagctctagactcagagtcaggaagcccaggtttaggtccttggccttgcacaagtgagttcttccagttataaaactttgattttctgggtctaaatcacttaaacttttctatctcagttttcttttctgtttaagggaacatccttccttcttccttccaagcctctatttgacaaggatgataaaatatctttcttttttaagcataaggaattctacaaaccaaaagaattattacattggttgatgtgaataacacatctcaacaccatgaggccctgactccgcaaacctgaagtcaaatgccaagaactttcatgaaatttattaatttattttttcttcccaactaacaccactaattctttatttggactccttaaggagcatgaagaatgggactcattcttgcagaactgtttttagagtttgctactgctcaaagctcagagtttggccatgtgaacttctgagaagtctgtgaataagagattttacagcaatttaacagtggttcaaagatagatgctctgtctcccagtagaatacttgtgcttgtgtgggcagaaaattcttaaaatgattcaaaccaaccacccaaagaggattatatgtaaattcatattgtgtgggtcctgggagctttgaaaaccacatacacagagcacagaaacacacaaacacacccaccaacacacacacacacacacacacacacacacacacacacacacatacatgaatagcacccttagcaccattgctaccttatgtgattcctaccatgaaaatctgcactttaaaaagcaggaaaatttgaaatctacagatgtggataacactcaaacttgaattgggacacaagaacttttccctctcgggctagtgagatagtacggcctagtggctacaagggtgaattctggagataaattttctgggtttaaatcacaattttacctttcattaactgtgatttggggcatgttttttaactattgggtgccttggtttgctcttcagtatgattggaataattatatacaaaatatacaatatctatctcacagtattgctgtgaggatttgaagaaatcatttatactaagcttttatgcatgaaatatatttagaacagagtgaagcagaagtatctgtgttctttcatagaatgtatgaatgaaatgggacagtgggtggtcactgccttaaaatactataccatatattttgtcatggtgctattgcaacaatactcctaacattatgtatttctttatttgagtcactgaaatacaaatatgttctgagaagagtcagcagagtgatttacaaactagctttttagactgggaggcacactggagatccaggttgggggcctgggtctaatctcagggctctacttttttaacaaggtatataattgtggacaagtcaactggtgttcctgaacctcattcttacctgcacactgaggaggctgaactgggtgatctcggaggtcctttctggctgtaatatcctaagagactggatgctccctaggcaaggaaactgttttatcgacgtacatactgtggaagcttactaatgcaagtctttattaagtagtttttctgtagcagccgcttttctaagccctttgacctatttaacccttgcagcaatcctatgaagaaggatttatcattatccccattttacagataaggaaactgaagcagacagaggctaagtgatttgcccaaagaccatatggctattaagtggcagggctgagattcataatccagtaagttgaggtacgcacaccaggcattctattcagcatcagacagtgctaggcaaagaataaccgaagaagagggactgtgttctattcactttgttttccccacagatctgtaagagtgcctggagctttttataggttctgaatagatatttatcattcttgcagtggcttgatcttggctcactgcaacctccgcctcttgggttcaagcgattctcctactttatcctctggagtagctgggattacaggtgcccggcaccatgcccagctaatttttgtattttttttttaaattttattttaagttctgggatacatgtgcagaacgtgcaggtttgttgcataggcatgcatgtgccatagtggtttgctgcacttatcaacccaccatctaggttttaagccctgcatgcattaggtatttgtcctaatgctctccttccccttgccccccaccccgtgacaggccctggtgtgtgatatcccactccctgtgtccatgtgtcctcattgttcaactcccacttatgagtgagaatatgcggtgtttggttttgtgttcctgtgttagtttgctgagaatgatggcttccagcttcatccatgcccctgcaaaggatatgaactcattgttttttatggctgcgtagtattccatggtatatatgtgccacattttctttatccagtctatcattgatggacatttgggttgattccaagtttttgctattgtaaatagtgctgcagtaaacatacgtgtgcatgtgcctttatagtagaatgatttataatcctttcgatatatacccagtaatgggaattttttgtatttttagtagaaatggggttttgccatattggccaggctggtcttgaactcctaacctcaggttatctgcccgccttggcctcccaaagtactgggattacaggcatgagccaccacgcctggcctatcattcttgtttttgttgacgacaaaaagttgttggattaaattgctttcagccttctgggttgctaagtgttgcagagttggctgtgttaaatttcattttcttttgttaatgttacccacacaaggtgaaggttttggttggggctcaggagggctcctgactggggagaaagtgggaagatccagagcaaggagaagacaatgaggctgccaggctttgggctgctctggcctctctgctgcctgccactgtcttcatgtccagcctcgctgtgtttctataaaggtggagttgtacctctctgatttcccctaaaggtggcctggatgtggtagaagaaagaggaggcaaggcattacctgcacctggaatactgatgagtggtttgctctttcttgtatgcccagtggcctggtcttaagcctaggaataaatgtagtcaccatggccataaaacggccccactgctgggcttgctttccctggcctctgtgagttccatgctcattatatggactccccatagcaacgttgagagcttgcttatcatttccagaagtgaccatggcagattaggaatatatgtttattttgaagtgggtttttttctttttaaattttacacattgttggatgaacataacatcaagggctgctttcccaactgtcttaggaaaagagctctaatgttggagccagtagccctgcgtgttctcatcccagttttgattataactgactataatactgtaatgacactctgacctgtgttcttttatgactgagatttccggtggggatggaggaggtgtctgatgtacagaaccagggggatgctgcctgagccaggttggggacggagagaagaggctgaatttcaagacactgacatcatcagtactggccctagtgcagttacatacctggtcctgcaacaaataatgagtatttagggcacatatgccaagcattaatggggtcacgaggtggatcgttcttttgggtgcccttttatatgccgctgcaatcagagaagcaggacaccatgtaggtgagcatctgctgttttcacagctatttgaagctgcaacccagtgtactaaaagtttccaggctgactcagtccaaaggtgactgttttggaaactttgaatgagattggttcggcaacttcagtgttatgtaagtaaaaggatgagagcagttgaaagagccactgctctggacatgttctaagtggcttctaccaatgggaatacgtgagcgtgcattaagaatgtagcaagtgagactgacatgtctccagtacaagcacagcacgtacaaggacacaacttcatgtttggttcaatgtgagacttctctgtggctcctttctcttcatttgcacagatatctgtaccacccagtataagtggtatactaatcgtagctagcctgtgctgcatgcctgctattttctgggtaattcccatgtgttttacacaggttaactctacttcctctcatggaaactacttgttgtcgaaataatggttatattttaccaatatggcaactgaggcacagagatgttaagtgtttcagcccaggtaaataagtggttcaatcaggatttgaactcaagcagcacctaccttggagcctaagctcttaaccacagcacttcactgaacctataaaatacatgtttattggttttaagctctgctagttgaagaacatttatacatgtctctattaaaaattcacttgtgtgtgggttatgaattcacccataaagaagactgccatgacgcacggaggagggatgtctgtggagcttcaggagacgtgataatccacaaactgtcctgggttgaacttagctattattctgccaggaaactgtctggagaaggtccaggaaagtaccaagaagtaaagaagtacctgagagtgctcagctcccagtgtgtcccttggcacctgccagtcacagcttggttggttctggctgtggggccggccttcctgagacccttgtcagggggctcataccctggtgctctgttttcactgatgatgaagcctcagagcccttggtcccctcatgatgttctgcgggaaaattgtgcacacttttgttgtgtgacttaggttctttaactcaggctggttgacatggagcttggttccagtgatcagtgctggctttagatatgatttgcgcatctctgcaggctagtgtcacgctgcactgtggatctggactgtggctcgggtgccagttgcaacatagtcttcaaggatagccaatggcgagacaacagcactctgtcatgcagctgaagttatggaaacacatgatgtcacatgaatgtctattgtgtgaggtgatggttaatacctgtgtttccaagaaagtgccaggtactggctagtcctcaccacaaccctatatgtggtaagggcagttattaagcttattttataactgaagaagcattagcaccaacagagaagataacttgcccaaggtcatacatgaaaaccaatggagaaattaaggtttcaacctaggcagttaaggcctaaagtctgtgctcgtgaccaccaagctatctcaccggtcccctgtcaggctttttaggggataaagtacagagtaaagtagaactttcctcaaagactgtcttattggtctcacttattttttttttttgttagtctttgggtttactttaaattgatgggctgctggaaaaaatgtaaattgtcatttaaaaagaaggcatcaaggttttgtcttaggttaatttttcaaagggcttaccaagaacacagaagacagaatgccagctgggtgccgtggctcacgcctgtaatcccagcactttgggaggccaaggcaggcagatcacttgaggccaggagtttgagaccagcctggccaacatggtgaaaccccatctctacttaaaaaaaaaaaaaaaaaaaaaaaaatagccaggtgtggtggtgcatgcctgtaaccctagctgcttgggaggctgagttgggaggatcccttgaacctgggaggcagagattgcagtaagctgagatcatgacactgcactatagcctgggtgacaaggcaagacaatgtcaaaaaaaaaaaaaaagacagaatgctgagcaattaagaactactttatttagtcctgtcttatcatttgtggcctttgtgtattgagcacgtcctgagagctgggcactttctaaatactttacatgtgtttcctcactttatgcttgtaactgctttctggaagcaggactgtgattattcccattttatggaagaaggaaatgaggttcacgaatattacataatctgctcatagtcacaaagctagcaggtggtggggctggcgtagaaacccaggcagtctggctccagagtccatgttcttaattaaccactcctctagggtggaaagctcactggttttggggttaggacactcatgccagctctgccaaaatgtcaacatgtgtgacactggccaagtcatatctcctcttgggttctcattcatttatttactgattcattcagcagctctttccagcatacctaccatgtgctaggcattgttagtactagatacataacgggtgataagatagatttcctcgatgcttctgtagagtttacagatggattttcagtttcctcatctgtaaaagatgagaattaaaatatatgaatgtttctcatcctttacaaaacccacacatctttttataaacataaaaagttatgccttccctaatgttatttgaaatttctgagtaaataaccatgactaaaaataaattaaagcaattataatagtgagtaatttttgtttgaatcacacaagccctcatgcctgttcctgaggagattctcctgcgctggccctctgagccctgggcattctttcggttaagaatcatgggaatagtattcttgctctaaaaacggacctacagttatattttttaattgctttgaaatgctggagttgtgtctatttaatttgtattcattctttcaccaagttttggctcttgggtttgtatggcagataaaactttactcattccttttactgaaaacctctttcccccccagggtatagtcgtgagtcacgagctctctcaccaactgacatttccccatcctgtttttggagggaacaacaaaggacatgcctggtgcctgacacagcgggcccacaggctgctcctttagtggccttgtgagttcgatgagcttttggctctaggaagtgcctgggctgctattactctgtgaatctcatgagattcacagacctcttaggagcaccagccaggttgtaaagatctcttgaggactgggctctggaaggactggccactccaacaccctgccttgcccttaattgtgcattgcctggtgttctttaattgcctcacaaatgcccttgaaaactctcagggatggcctcactgtgcatgacaaaggaatgcaacctactgtctggttgtactgaaggagcagagagcaggattctcataatgattgttcaaagaatttatttatgtggagtcctaaaaggagtgataggtgtgaaaaaatgcaatttaattcaacaaacattgatgcaaacgctgtgcttggtgacagcaatatagagatgaataagaccagtgtctagtgacgtgctggcaagtacaactggctctgtggggaggcggtaccctgatttgtaccttttgctgatttccattgagtaaatactcttgccatgtttgatttcaagctaccaacatggtgtcaattggctcacagaagccctgaaaatttaataatcagctcttatgagcctgtacaaactgaacttgcattctgctaccaatatctacttttgaagttgtcagtttagattggaagatacataaattgccatgcagtctgataaagacagaaatagaagtatgtagaaggtagaaaggtatcacaagggacactggttcaattctgcggtgggcatatccacatggtaggctgcaaacaaagacaggcaaggcctgtaggtgggtggagacagagaccttcagagcatcctcagtgccttcaggtcatggggaaatgccttggcctgccttaaggtcccgtgcagtctagcctcaccttacctggctgaacattctcccacatttactgacacaaaccttctgctctagtgagtccagcccagtgttttcagtcttgagagcacatccctgccttggctgacacccacctcctcccaccaccgtttagaaagtgccttccctccacctccacttccctgctctactcatccttctttatgaatgcttcctacaacagctccaagccacagaaagcactgacagaaagggaaagattgatcacgtgaattccattaaagtgaagaatttatgtttatcaaaagtcactgttaagaaaggaaaaggcaaacaatggagtcagaggaactgtttggaacacttatgaccaatcgaggatttgtattcaggacatgtaaggacctctcacaaatcaataagaaaaagacaagaaaagggaaaagagaccagaacaggaacttcacaagaatggatatccaaatgacatgaaaagaagcttgccttcactccacctttacctcagtcactagggaaatgtgatgccactacatacccactaaagtggctgaaaccaaatagacttgtattaccaagcattgttgaagacttgaaagagtgggaaataatgtatactgctggtaagaatcagacatggtataacctatttgaaaaacagtttggcaatatttattaaaatggaacatttgcatactctatgacccagcatataatctgaccatactctatgacccagcatatgatatgacctagctataatccaatgaaaatgtatatccatatgtttacctaaaagtatgtactggaatgttgatacagcatcattagttatggctccaaattggaaatacccagacattcatcaatagtaaaaaataaattataggctatttgtgaagtggaatctttttaaactatgaaaaagcatgacatactgctccatagaactacatggatgaacctcacaaacctaattttgagcgaaaggggccaaacaaaaaagaaaacaaatggagttattatatttatataaagttcaaaaacagacaaaactatatgaggttagacatcagtttacctgatacctttggggaagagcaagaggttagtgactgggagggctgtgttgggggcttctgagttgctgaggttgttatatttctggccctgagtggtgataacacaggtatgttcactttgtcattgagctttacgtgtgcaatttgtgtacttttctgtatatcttacatttttattagctaaaaagcaaaggagcttctgcatgaaagtattagaactagtgctggaaagtgagggagtgtttctgaaccgcctttgtgtttttcttttgacgttttctatctttatgagtttattcatcaaacaaagacattttgagagtgacaatgtgccgggaactattttaggtactgagagtgaaacaaaatagaaacaactgctgctttcatggagcttacattctcaaggggacagcaaggtccttgaacagacaaatgtataacaagtcaggggataagaaatactctgaagtggtattaggggataagaggataaagaataatggagctgggctgagggtttgggcactgactaggtgttgttttatatggggtggtcgaagaggacctctgaccaggcagccttggagccagagcctggatgaagtgagtaagggaggctgacaggtatgtgaagaacattccaggcagagagggcagtaagcgcaaaggccctgcattgggatccttggcctccgaagcaggaaactcagcatcattcttggcttctctctctcttcttcaccttcatatttgaatcaaatcatgatccatttgatttcatagctaaatctctcatagtttgcaacctctgcctcccaggctcaagcgcttcttctgcctcagcctctcgagtagctgggattacaggaacatgccagcacacccagctaatttttgtatttttagtagagatggggtttcaccatgttggccagggtggtctcaaactcctggtttgtctccatcccctccattgttgcctatttgggtaatagtttcttaactctgccttcccgtttccatttttttctcttctgattttaagtcactgactggatatgccactcctctgcctaaaagccctccagtggctctgctttgctctcagagtaaatgccctacaaggttttggttttcctcactggtctcatatctttctgctttgccgtacactccgtgcttgagccacaccaaggcgattccatgtttcccacattccctctgaggaaaggccctttagtctctgggtctttctttatgagggtgcatctacctgtggagttctttcccccacctcctcattttatgttttgcacatcccttagatctcagcttagatgttgtttagtctgggaagctgttcctgtcccttaaaccttggccaagtccctgtgttctcctatcgttgccccgtcatatcattttgtcattgatttttcttttttccagcctcccatgaaactctaagacacatgtgggaagtaactatgttacttattcatagtgcttagcaaagtttctgatgtttagaaatttctcaataaatattaaaaaaagaatgcatgttgagctacatttctgtgatatgtcaaaaatctagaagtatttttattagtaactgatagaaatatctttcagtcaaaacattattcatcaactcacaaaaaagcagactagctttgtgtttgagttttgtttttgtttttcctggtaattttgtgttccataatttctcagacacagaaacattatctttcaaattttaataccactttatttgactcaatcacatgtaaaatttttgttcagagaattttgaatgtatccgtgaaaaatattcaaatgtcgaaatccaaatgtcttgctttggctgtggagcaatatcattactgtgacttagttctagaatttagacttaattgctaaaaaaaaaattttgaattcaactttattaattttgtcaagtttttgatgtgctaggtggacattctttccaatttattacagtcccttcatatagacacaaaagcttttaacacgatgggaaagctggtgagacaagtcagaaaataaagcagctcttttttctttttttgttgagacagagactagttctgttgcccaggctagagtgcagtggtgcgatcttggctcactgtagcctccacctcccaggttcaagcaattcttgtgtctcaggcaccgaagtagctgggattacaggcagtagccaccacgccggctaatttttgtatttttagtagagatggggtttcaccatgttggccaggctggtctcaaacttctgagctcaagttatccacctgcctcggcctcccaaagtgctgggattacaggcatgagccaccgtccccagccagaaagccgtgatttttaagctgatgctttgtaccatcagtgtgaggagtgatgctattgatccctgctgggcatgagcattagaagaaagttgagcagggacttaaaatggggatgtggagcactgtgccaatgtctttcaaatgggcttttaaaaattattttaacaggattatttggagaatcataaatgtttgagcctcagatacactcatagctaccatttactgagtacttgctatatgccaggcactataaaaactgctttaaatagacaatcttgtttaattgtaataacagtcatatgggattgttaccatcattcccatttaacagatgagaaaattaaggctcagagaggttgagtggtttgccctaggtcatatagcaggtcaaagctaatgctgaactatgaacacagttcctctgactgaaaatgtgcaaggctactaacgactaggtcctactggcttatgtattgaaaagtagatcaatgaactcattctggagctaaatgttgtctattactgtggattatccatgacataacccactcattatattccagtattggttaaaaggtaggagagaagtgatagtaaatttcatgggttcggcatatcttctgaccgacagaagacatggaaatgttttaaatgtttcttttcctttttttttttttttaaaaaaaaaacaaaaacaaataacactaaaagtttcaccaaacaagggttcataaaaggatcgtctctaaattgtgagtgtggtgagtgtgcatgctctgagcaaaaagagcctcccctttctgagggaattgtgaccctggaaaggaggagagcaggaacagctggccatctccccctgaaaggccagggcccccctctcaggcctctgggctccagctctggctgagggtgtgtttgtttggctgtgactctttcccttctgtttccctctcggtgtcatatttcatgagctccaggctcctgcctgtttcagcttgagcctctggctttcatcgctgcctccttggccaaagctgagtgagggcttgaaaaaaacactgattggatgcacatttagtggaggcgattgctggaccagcacctcaccaatccccagccccaaatgcaactgacagctacaccctcctggctggagcctaaaccagaggcccctttcctccctcctctccacccatacccttgctgtttgcccaactcttcctgctgaaatcagaggcagcttgtgcctcccagccttcttccctgcccccgctgtctgcccagccaccagcttcccctgggctggaaagacccccgcttgtctgactgtgctaatcctctgtttgaggttccagaacttcccaattgttgggcctgggttcctgtacttagctgcccagagtccacttctctgctgagatttctattatacaagagattcaaccagaaccctctccgtgggcctccatgcctctttttgctgaattccccattctcattctgcgtagggggtgggagttggtgggggtacatgcaccttgagtctaatcatgatcttactggggagagctcagtaggaaagtaataacatattcatttaaacaactttttctctgttaatctttttattgaacttcatagaattaatggataaagactattggttagagtgcgtctttcttagacgagatggagttagagacacttaaaaaaaaataaggcttgccactgcaggagtgcacagagcacctcaactattggagcccaggtgatctcttcagtgggtcataaaatctgagtcataagaacctcatggcaaagaaaacttgaaactgcaaagtctcacatagtcatttgctgaaaactgaagtgtcccaacaaatgtcgggttagacctactttgagaaacacattccaatatgagatcgaacctgacaattttgcatgctaacctggactgtttcttattagagcaaaggggatgggctttttgtttgctttgggtgtatttgtttttgctgccaaagtgttgtaatgtcatgattatttaatatgtatgaggcctagttgtgtactagggagagtcaaaatacatttactacgaaatgagaccagctccagttgtttaaacagctccagttgtaataataagagctaagacttgatgccaagcactgtttctaggtattaacttattgagtcctcatgattactcctcacgatggtcctcttggaaaggatcctatttttctatgagaaaactgaggcttgagtgttaaggaacttgcttaaactcacacagttagtaaaggtcagcttttagatttaaagccaggcaccctcattctagagcttgtggctcaaccactgagctatactgcttgttagggttgttggtggagtgatagtagaagtagatgggctagagtttttcatttctaaccctaaaaatctatagctattaacactgaagacagcaactgccaattaaataaatcctcaacaagactgagaagagaatctgctaatctgttggtcactaatgtctgcagtttatctgcttatctatctgcagcaaaactgtcttagaacactttgctgaatgaaattgaacatggaaagctgactgaagggaaaacagagaaggtgggatagttgagaagggagtaagatcagacaaatggcaatgctctgtgggatactgcgtccaagcagaacagtcaagggattcagttctcagaagctgttcaggtagacgccctccttaccagagtcggttagcctcttgctgtatgcacacttgaggctgctcaaagcgcgagggaggcatggtctgtgctcattccaggcatccaaagcaccagggaggcatgatctgtgttcattccaggtgtcttatctcgctgccacttccaggcctgcacattataggcaatatatttactacactctcccttctcctttattttttacttctggatgtgccatggtgaatatttttcaggcaaatggggggaatcgtttccatttcaagctgggttgaaatctagcactatgattagggttgtgctaacctctgcctgcctctcccctaactcctgctgtgtataggtgggcatggctcaagcatcctcagggctgggagaaggttgcatcaggaatgtttctaccaacagaagctggccagtgggaggcttgtaggcactttgtaatttaccattctcttcttgaactatgcagcagtctgaggggctgtacagaggattcttcccagtcattcccattgctagctttggaggccttctcccacaattcatagcctcctagtaatgtgctttattcctaaagcccagtccttggggtttttgaagaaaaggaaggcagatcagcatgccttccctagtctgaaattaccctgtttgactcatatagtgtggagctttataatctgtaatccaaaattgggattgtctatactataaggatattctctgggacttacgcttatttaaccaaggttgtctgcaatgggaagctcccatgacgggagattcaggagaaggctggcataggcttctaacttacaccagtgctccctgatgcctgtgaatgtggggagagggcaaggagattttgagaacagataagagacatttgaatttctcaatgccttctgaaaacctgtgtgcagagttgaattgaaacttaccttgttagcattataaatctgaacactttccttgctaggccacaatgacttaataatatcgtctaaaggatctatgttcactctgcttgcactgatttacatctcctttttccaattctgcgtagtctctggacacttctacttccaaatatcacctgtttaaggaatagcacttaccttgtcttgtactgtgaacccaaatttctgtgaaaaatggactgtagcagttgttccagtttgagattgctgagtgtcatgaacattggttttgaagagtatggagtgttgttggaggacagctcgaggctaaatgtggttgtgcaatatggtttctacacactgtccagcaggtggttggatacagttatgccattctctgcttcttgtttgttgtcttcaaaacatgaaaaaataaaagcaaaatatagaatatcttcgatgaattcagcttctcttaatctcacttttatctcctttctgtaagacttagtctattatttccgaatatgccatcaattttatccaagtgaaaattcagttttagttttaaaacacacagatataaaaataagatgcaaagttctacagtaaaattcttagacataaacactgagatttttggattcacaaataaatagtttagataacactcagaaagatcttttcctcctaattagcttctattgtcacctcttcctaagttgatatgtagctcaatttgttaggaaatggatttcccatgcatgccctaactataatcataagcatctgcaactctgttttcaaacaaagcatctgcaactctattttcaaacaaaggtagttactcatgagagagcttctttaaactgcaatggaccacacagaggtggatgtctagcacatttacagtgaccatgatcctatctctcaccatttcttcttttcaatattgcaggattctaaccatatgactttcccacccctcacctgatgtttggcgacaatatcctggcttctactggcaacaccatcttttgctatttgggtaaatgtgctccttatcagccttggatcctacccaggctcagggccttgtgagtgcaatgtctattgggctattgtggaccccatgactatgacccagacactcagttttgtatgccacatcccttttcagggagctaggtcaaggacatcatgcaactcatttgcatgccatattgaagattcacacttgggggaatattttattctcaggcagctaagaccttgaaactccagcatagtatggagagtgctgagccttcagcatttttagcacatgatttcagccttggaaatctgatgtacttgcagacctctacacaagaggaggtatttgcatagaaacatgagcatgctggggctgggtcatccttttactacacatgttaaagcatacattgtaaccaaaattttggaagcaatgagaatctcttactctactattgggatttggggtcacagcaagactttggaagaggtattactgagaagatgcctctatgaggtgttactcaaagtcattaattacttacagggctctacgagaatggcatagttcatgtcttaaaaccgcttatagctactggttgagacagaaaaggaaactatgtgctgtgtgattaaaccggtgttttcttttttgcattctgtcttctacatgtgttgtggtgaaatgaaactttaccacattcagcagtgctcaggagaaacattgagcagtgttggtatatatttcaatggcattcaaaaccctgataaataatttaggacttggggagatctgggtatgggaagaagaactgaaaaaaaaaaaaagcagcggtaatttactaatatatgtttgtaggttaaaacactttttatagctgaccgtagtagatagaatcattctttacaactattaagtggtattaaataggttgacccaactcccttggaaaagtgattaattttgtcttccagacctgacttctgaagctcaaagttggtttaaacagttcagctgtagtagaggatagcctgatatcctagttttgccacagtatctgggccagatggcatttgcagtaaatggaaggtaacaatgatcagctctggtatttacgtgtgtaggtgatatggtcatgtgggagtgttcataggcttacaagccatatggctcttggccataaactattgctaggtaaggctttgactctgtatcagtatgaataaagtagctctttcagctcatgagtatccatttgctttgtgtcaggctgatgtcaagttaacctgcttttgcactctggtgaacagacacatagattattaaaactgaaagtgatctaaaaagttatctaaaccaatatcctacatgaagaaggatcctccctacagcctcacaagtaagatgattagtcagcctctacttgaatatttccagtagtggggagctcataacctcacaaagaagcacagcctgtttttggatggctctaatttttagggtgttccctcttatttttgatgaaaatctgcctctctgtaacttccttagtcatgactggagttctgttgtatgagctgaatccttttatttcagaatagggcatcacatatttgaagaccaacattaagtcccagtgtagttttcttttttctgcatgaaacattcgaaggtctttcagtaaatccccttgttttcttggtagggagtcactcatcaccacttttctcttcccactggagctgtattaagctccttgaaactttgcatcctggagatacagctttctagtcacaaagcccaatttaccttctctgagaagagtctagttctttttattagttttagttgtacagtttgggattctcctttttctcctctttgtcttatttttcttcccagcttcctcctcacgtggcgttgttgtgcataaagttctgaatcatatttttcatctttgttcgttgcaattattgtcactctgtcttccttcttggattatttctttcattctccttagaaaatttttgaattctcccatcagctggagaaaaggtatcttttaccttctcctccatcttatactgactatgcaagcagcttatacttaggtcccatgcaagcagtgacttcagaaaaaacaagaataccaacaatgtatcatctcctattgttggctcttggttttgaatagatattccctacccaactagattcatgtgtgcgactctgagtataggtcattcatcgaatgtctgttactgctagagtctttgagtatgtagtctgttgatgtgaacctaaatgtaattggtgttacatgcagtttaaatgtcaccctatttcaacctcatgattctcaatctttatgccaatagctacagtatatttattgtctaccataggatctaattacataagctttggtactgctcgttgtccagaaggatcataatgttagagaggacatgtcttcctcacattatgaaggactaagaaacagaggctcagggagaatatttggctcatccaagattacaccattagttcagcagctggtcagatgctgtttccgataagccactcagctagctaactcccttggcttcaatagagaaagtgacttaaactgtggcatttctggtcttttatactctctctctctctctgtgtgtgtgtatatacattttttcttctttatcacctagcatattttctgatatgtaataagttctcaataaatgctggttaatgaatatttcaagccatcctttccttttggaagttgggaacatgtgtaaaggaagaagactagattgagtgataaagcataaaatataactaggaaagtcatagcttgggatagagagtatatgcagtttgttcagaagtatataaggcattgtgctatgtgccacgatgcctatacagaacgtatagcctagttcctgatatcagtgagtttataatgagataaacgtattatatttggcattgtgaaaatgagataaaaatagagataagactgaatcatatggaaaaaattagtttccagttcaagagaatgttatcaacatcaatgaggagttcagagaagggaaggtaatgaagagcctgctattatgctattgttctcatcagaagaggggtgagtgtgagggaggaagagaggatagatggaagatgagaagagggtgtgtgccagagcactgttgtccatttagtgccagccctgtgtggcaaataggacacaaacctccaattggcttaagttcctgaggtagaagagattaagaatgttaaaaagggaacaaaatttattgagcacctactataggtgaattcatgaatatttcttgatcacctgtctgtggaaggcactgtgttaggtgttagagataaagagagatactatcttcaccttcaagggcaggccaagcagtgtgctaggaacctcacaaaaggaggtgctgaagtcacataagctccccttatgtagttattccagttcctggttttcacgtctaatggatttttccccatagcttctccccctccacccaaccccagcctttccagagtgtgtctgtcttcccaaaatgagtttgatactttgtgcgcatgccgggatccccatgggattgatgacatcatacgccattggctcctattgcacacaagagaggagacagatctgcacattcctgcagttaatgctgagtagaatcttggcagaggtggtggcatccttcatttgactttagaccttcagcctcccttttaaagccctggctcacacagttattgagaagccttatcctgcaaggaacctacagcttaggaaagagttgcccatgtgtctttgctatcaaacaaaagatattggcaaatcttttatcgattttctattctggcagaggtaccatttattatggggtagatgggatatagataaagcatctccctgcccctaatccctgccttgctgagataaatgcctgttccattccccaatcaccagaaaatgccttggagcaatggagtctaacagcctgagagttgtaaaggggcagcaaagccacttctgcaggaagagagtgtgcatgaaccttattcattgtccatgtgtggagttgcttcatgttcatgctcttcaccctgatttgacacataccaacatcaaataactatctactctaccccatttggatactataataaaaaaaagatagtccagttaccttataaacaacagaaatttatttctcattgtcctggaggctaggacgtccaagatcaaggtgctggcagattcagggtctggttagggcccactgcctggtttatggatggcatgttctcactgtgtcctcacatggtagaagcagtgaggcatctctgcggggtctcttttaaaaggaccctgaaagagggtgccaccctcatgacctaatcacttctcaaaggccctacttcctaatactatcacattgagggttagaatttcaatataggaattttgggggaacacacacatccagtctatagcactatctgataaggcttctgaatagtcctgggccattttacataacgggggtttactaaggactctcaacagcatagctcttgcttcaaggggttttccatgcggggcctgccagaatcccctgaagatttgcccttttgcttttgggagaatcattgagagaaaaaggacctggctcctgtgcttttcgcatgctcacccactccggcccttctgattaatgtttgctgttctgctttgcagatgcctcccaggacccagagggagactgtagcctcatttctgtggagacctttggctggactctcctggctctcccagaggtgagagaccgtggttcctgtagcctcaggcttggcaccagctcatctctggtggatccaggattccagatatccaatctcactacagccagggcctctttgtcccagtgtgaccttgtgggctgtccccctgactgcgtcttaacagcccctgccattggtgattttcattccagctacgagccaatggatccctgaaagcgactgtgtgggcttctctcaccatgtcgctctggcctcagcctggcggtgtgctcctctgtggtctggatggggatgatgaactcgggctgcccgttgtttttgttttgtgatatttaaagcagccgaagctctcattactgtaatacagtatgtgcctgggctaaagggggagcagcattccttctggatcagggggcaactctattctgttgtggtacacccgctggagtgtttagaaccacggctggtagatttacagtgccagggctgacaggggccttggaactcctccattttcattcattccagcctcgttgttggaatgaagagggagctgagcccattctgggtatgggacgattgcttaggccctggggtgatgagtggcagatctgggactagaactcaggcccagaggccagcttactgtcatctggctaagtttctgcttctgttctcttcacttgttcaagatccttctgaggccctgaaccaaatgaggaaaattcatgtaaatcttagcacactgcctgatacataataagtgctccataaacgtttatcagtgctctcataagccctgagacatgcaaaatattcttgcccttcagggacttacagtcttgaggaggagataaaaatttcacacatacacactaacacaattaaggagcaatttaagtcactaaatggttatctgctaagttttggggaataggtgcagtggatcacgcaagagaggagacagattattgtggcctagaagaagtgccatggtgaagataagagcataatgtgtatgacatctgtgtatgacatcttttcaactcctggcagtgagatgaacaggtcagcagccattcctggacactgcagagccctcaggccatccactcatctacccagcacattcactgattatctcccaactctgtgctctgcataagaatgtaaggaagaccatgacaagaccctttcctcaagcctagccagggagacagacatgcataaagatactaccactgaaaaattctacattcatatgtgttcatatcctcaaagcatcgtctgagcccacaggtgggtaggcaagtcagataggagcaagagtttgaaggaaagcatacatttacctggtgaaaaggggcaactcacaagccataagctcttgtgcaaaggggctggtaaatgtgagtcttctgcaggagaggtggagttgctgggaggttagacccaagcaagggcattctgagaatgagattgagaagcctctgaggccagcatggggcaagcccttggtgtcacacttggccctggcaatgtggtatttttaacctgggccagaaagtggagaggagcgggcctggtaggatagagaggagggctctttacttatcaagagtaggtaccagatgctggtgactcaaggggaagcttcctgagtggagatggagcctataggtgtttaatcgcctggaacaaacatattttctgcactgcttggttcagaggctgcaagttaaagtaacacagaagagaatgtccggccagcaatgtgaaggaagcatgaaatggaaagggttagaagctgaacttctcttgatcaatgactttattatcttggcaaggattgcagaaactgtaggtgctgagggactgacttgtttggaggaaggggtagggaccaggaaaagaatcccagacacttggtgctaatccaactgctgaatgaggctttcaggctctgggattcaggcaggaactcctgggccatattcttcctaggtatggggctagagagccttcaatcttagtgtctgtatgtccctgggccaatctgctttgttctaccatgcctaacatcagaaaaaaaggggtagattaagtttagagccactgctctgtgtctccatcctgcttctttttcctaaggcaattgagccttacaaggccttctaagtccctatgaggtctacagctgtcagggattggtgaggatggagaacaaaccagtctgttctgaattcaactcttgctttctttctccctctcacaattgaaggtcttcctgagcctttgcctctttcaacagctggatgttgagactgcaatttttcatgattgcttgttttgtattttttcttcatggtctttcctaaagtctgttattcatccaggtccacttatacatcttctaatctattgcaccaaccctgcagccatggcctggcatgaagctgcttgctcattgtcttgttggtttttccaaatgctcacaggcgctagtcatgtaaatctcctcctggcaagaaaaaaagactgactttttgttgttgttgtgttgccccaggtgattcagccagtcctgggctcacaatagatgctaaacatacgattgccacctcgactgctgatctttttcttcctatacaccattctattcataccgctattcaaaaattgatatttataagcacttactatatcccaggaatggtactgtaagttctttatatgcattattccatttaattttaatagtgataccattttctacttttaaccagcttatactttctacactgatagaaaagtgtccctaaacccacagactagttagtacctggctgttttagaagttcctcactcatgacatttctgaagttatcactacaggatatggttgcaaaggcctgggaggagaaatcctttctgtctctgatggtttcagagaaggtgagaggtctctgtctctttgtggtaaaaacaccagggtaggccttgatctcctgagtcttgagtatgttaagggaaagacactaagattgctctgccaaaagggcagacagaccctgcctggtgtctgggaagttgagcccaagtttctctccaaggagggtctcctgcagggatcaggaaggagggtctattggcatcacacatgatctcttctgggttcaggaggggttcctatagctagatgagatagaattgattgatgtctcagtgatgcttcaggccatgttgattgggcctgcactaaaagtaagcagcccttcagagccatgtgctctcaagaggcagcacagccataaccgcaagagtaggatggtcctggtggaaatggcacaatcaaaacaagctcctgggccttgtggctttgagtggctgaactggaaggttcttgaggtatgagcactctcactcacggtattgatcaagcagcgtaatcacatcactgcccccacagaagtggctgccactcagttctcctcagcccaggctgatttctgctctgctggttcataggaaactgcttgggtctttcatgactgctgaagcccaaggcactttccccagaggcagcatcactcacaggatggaccaaatgaaatgtcctggtcaaaggcaggaagtttgtattgttgttcttgcctattttactatcatgtaaatacctgccaaccaacctacacatattctctgagtacttactgagtacttactatataggtgttaatggatacagaaataagagtatggctaggggtggcatgctttttgcccctaacttgcaaatttattgagaacatgatgccaggcacagtgaaaaccaaagagaaatacaaataaatggtaacatttatgagacaggtactaggttctagacacttcttacatgttaactcatttcatccttacaacattcctgtgggcaggtgccattattactcccatttttacaggtgagaagacagaggtgccaaggttcaagtgtgtgcccaggtgcatgacactggtgagaggtgggagacaggactcaaacccagcaagcctggtctcagacaaggtgactcataaggagcagcaagggaggtaggaggcagaacattgagtgcaggggctcagagggtggagggaagtaacttcaatctggtttaaagaaaccagttatcagagacagacagggcctaaagaaggtatgggtggctcagagttttaggaaggaaaaacaggaagttgggctaatagggatagcgtgataagagaacaagtgctaggctggaataccaggggcctggccttgcctgtgagcagctgctgcccctggggaggtcactttgctttttgggctgccttatttttatcacctccaattggagagaattgagaaagatgagctttcaggtcccttcaggtttttaccgtatggttctatgattttgagggctggcatgtttccttggttgcttccaaaagcctctgaccacagtccctcaggctgaccctcttgtgcccagtaatgtggaaagatgaccttctgctcaccagcacatgcttccaagggctgcggagcctgggacagaaggtacggtgggaaagaaaatgagaggagctggttgggaaagatactcacatgcagaaaagtttccagcaagtcagaggtgagagtaaaagatccaaatgaaaagctagagattgctagggctcaccaaggttgaataacttgtccagggtcttagcagactgagggatactggatgataacacttctaaaatactgttttgtatctggaaaatgctctgccttcagtttgcattttctctccttcttcctcccagtaatcaaatgaagacgttagatttgacatttccagtgtgtacagtacagacaggaaactaggtgaatgaagtaatgcagtcaatgttctgtgactccattctgcccctggaagagggatgttttctataatagtcatgtgactcaacatcttcttgtcttcttagaaaggagtgagagaataagatagccatctagcactttcccccctcacctctcctacaaactctagcatctcattttacagaaggaaaggctgagatggaggggagcaaagtagtcttataacaaaggcagaagtggagcttgctatttcatccagtgtgggtcacctcaggtcacctggggcacatcctatgtgcccagatacttacggaaggggtcattctgggcctttggctccacactgaggggctgcattttgagaatcacgaggttgggactcccagaggaaagttgagagttaggaaaacttcaacaaatcctcaggaatagaaacagaacatgagatgagaatgtttgggacagctctgctgtttgtttctgtgtatgtgtttgagggcccatctcttgccaaaaccaagctcatttctgcatatttgtttgcttaatatgaaatactccaaaactgctcttcatatttgtttaatctgaaatgaaaatgactcagcagagaggaaaaacaagatttaaatgccctgaatggcccctgaattaaaatacatagccctaaatcatgggggtgttcttctccccaccaaatcttaatcttcaacacacacaaatgcaagtgccacacacagtcatgcacacacacacacacacacacacaaacattgtatttgcctgccccaacttgacctcagtccctttatctcttttccccttcatactccagcctttccagggtcctacctttcctgcaggggaggtgcatttgagcttaggtggagaggcctggcctgggctacaggccacagatgattttcctggagggccagcacttcctctccagtccagatcacaggctcagtgtcaagatccctgggggaaatctgaattttcattcttcagcaaagtcgaggccacctcagatagtccctagcttttggatctggaaaaatggactccgtggagagaatggctgtctaccaaatcagacatgtcttgctttttacacaagctgtattcctgaaaagttgggtataaactggatcttggtatgttgcatcaattttgaatgtactgaaaagatttgctattcaaaggaacccagcactggattcttttgtcaagggatgaattactttgtaatggctactcatctagtgatttatgagtttggtaagtagatggaatatttttatatactgaatgttattttaaatgtactgtgtgggattttttattcaaagttacccggcattgaatccttttgcgaagaactattctgtagtgtagataaacatttcatgatttatgagtttggtaactttaggcatttcttaaagtgggatatacccctagttctgcttcagagaaaaagttgttttttgcaatgatcagacttggagaaaaaagagttctaccatatttgagttatggtcactcctgaggggcttaggaagaatggaggtactcaaactttccattttgttggagcaaaagatccaggagttgcctgctcttcttactttccatattatcactggggtggaaatgatggaggtatttttccaaagaaatgtagttcactattatagctacatttcaaaggtgtttctcttcatatctatatcatttgaatatatatttatatatatatacacacacatacatatatacacacacatgcacatatgtttatacacacacatgcacacatgtacgtatatacatatataatctatcatgtgtatttagatctaaagcaaagacattgcagtagggcttgtgttttgaaccactgaagggctgctgtttccaccagtccagagtgctggggcttgctctgagatcaccaggggtataaaccaggcaagaggagaacttaacttcctgctcactctttctcacttggcaggtcaaaaatcatttcagcacttatctcccaaggttcctagctgtgtccccataccatcctatctgagcactagtgtgaagcttgttttgggaaatgatctgattgctaaggcagttggaaaagagaaatatggtgtcatgtgtgtacaaccaagagctgatctaggatgcccacatattcctggctcatccatgagccacatattcattgaagttcttataggtaggagcaaaccctgcctataagaaccctacatggactggaactgtgtcaggcagaatgttcagataacttaccctttcaccatgatttggccctgaatgtgtctcagaaaaaggcttttagaagctcacccaagtacagagataatttgtgagacatttaacctctcagactcttgcttttttctttcctggagagctgctaatttctagttgtggctgccacactcctgtctgcctgatcttccattttacttcctggtttcctggtggctttgacacatggcctgtccagatcccagtgggggcagtcctgagatggagagctggtggtcttttgtcagatctgggaagtcctgagccatgacttcctttgaaatcaatttggaatgtccatccagcttggctagggaagaggattttgactgtgaagagggaagtgggttctttactacaaaggacatattctctctgagccacatgctccttgatgttctttggtaaatattgggctgtggtcctagaaacactgaccttggagtcaggcgaactgggatccagttcttactctgtggtcttctaacttagtgacccaagcaagtcaaaattaatctcatttcgagatagagatatgcaagatccttgaccttcaatgactcatggtcaggcttgagagaaagtcaggtaaagaagccaactctaattcagcacaatgaatgggaagcaccagccagaccaggtaaaacagcctcaattgagggtgaagtgacttagggccgtacttttctattgtcaaaaggagatgataatttctctccacaggattgtggtgaggctcaatgatgtaatgcatctataagtaactgataaagttcaggaattctaaaatagaaacaggcagtaattctcaactgttttcttcttccactctattcatgtgcaagatgtgctaagacatttcccaatacaacaagtgattcttgaagtataggacgtgttccccccacacctccaactctcggaaatgcacagaaagtgtccttgagattctgatagcctgcttccaggaaaaatgttttgtttggttttgtcagaaaagctaatataaatgacattaacaaggaacacattttccttgttgaaaatcaaaacattacaaataaggctaaagtctccctttgatcaccattcacaatctcctctgacaaatacagcagtccatctcctaactctgtcttggagggaaccactgctgtcagcatggtgtttaatcttccagatcttatatatatataaatgtacatgagtgtgtgtctatcataaaaatatatagtgtgctttacataaactttgcaaccttcttgttcacctaaaaacatgtcatagacttcaaccgttgtaactgtgagtagctctaatgcattcattgttactattgcatagcatttcacagtaggaatattctatagttaataacattatcctactggtagacatttttctaagtttttgttgttaaaaaatatattgcaaagcacttttttgtgcatgcctcattgtgtacacacacaagtctttctttagggtaaataagaataaatgggatatagaaattatggtatatgtatttttattgaaattatcttctaatttatatatccagcagcagagtatgagagtatgcatttgccatattattgccaaagtttatattatcacactttaaaattttgccagtctgataggtaaaattggcattcaactactgctttaatgtttgtctttgtgactacttgagaggttgaatacttttagatgtttacagcattatattgtctcccctgttgaatgctttttatttacttggcccatttttctagtggcttttaaaaaatgatttatagagattattaatactagaagttatttcattatacaatttcaaatatttatcttagccagttgtttacatgttatgtttatgatgtcttttggtcttaaagaagttttgaattttggtggaaatttttattattcttttcatttctggattttgctttccatgtctcatttgtgcaggccttccttatctttagctcatagcaaatttttctagattttccttgaaatattcttatggttccatctttacattttgggctcatttttgtgaggtgtagatataccttcatttgcttttgaaaaggctactaaagcatctgaaacttcttcaccaagtttaaatacccaccttctcatgtagtacatttccatttattcatgagtcttttctgggttgttcattctcttcagtgttctgcttatctatttctataccaattgcatactcagagaggcctttgctggccaccttacctagaacagctctcattccctttctgttacattactctattttattttcttccctgtacatatgtttctttaaaattcttcttcatttacttgttttcttatgtactataagttccatgttggcaggaaccttctttgccttttttactgatgtgcttatcacctgtaatagcacctaatagatatttacaaaatagttgctgaatgaatgaatgaaggccaatggcttgaccaggggtgtttgcattttgagttttatttcttgaggcttaaataaattgtcaaaggggtttgtactactaactaaataagtgggtagagaagggctttcctagcagctccttgacatgcttccatgtatacttttgagttctgttcacatgtcacattgtttaaatattgaacccttggaaagactcattcgaaggtgcagaaaagggtgattctgctcacaataagctttagagatacttccttttagggtatggaatttagaatgaccagatgtagtcactgaatatatggctcaaggcaatcattaattcattctgcaaatacttatcaggcactctggtagtgttgagactacaacaacgaataaaatgaacatggagcttgtgtgtgttgggggggaatacaaattaaacaatcacagcaatgaatatataatgagaaactatgatcatttctatatagaaacattatgtttttagagcatgtaacaatcaaggggatgagagaatattttgctgagaaagtgaccatttagtagagatttgaactaggcaaagagaggagagaaacttcttggcggaggtccttaggcaaaagaaaatggaagaaaaagaaaagaagctccagtgtgactgaggtggagaggatgaggagaagggcagctctggtgaggtaggtggagcccagatcaaaggatgatatagtgtgatgatgagcaaaaacaaaagaaggaacaacaaaaacaacaaaaacccatgtggattttgaagtaacacaagccttaggttcacatatgagtttggtcacctatcaggtgtgtaacctgattagctttaacctctttctccttagcttccttgttgttgaaaacaaacctcattgagttactgtgaatattgtaagagatggtctctgattcgtagtagaagtacatggtataggtataatacttctaggtgctttacagtgctctgtttgttagctgacagtcatctaattttaggcaaaacagaaaaataattattgcttttggagattcgcagcttgaagcccggcaacagtttcaaaaagtaaattagtcaacattttttgaacacttagtaggtttggcttagttcagttaaaaaccatttttgagcacatactttgtgcacgatgtaaagtaatactttggcaatataagaatgaaccattttgaagttaatgattaaatggataattttataacaatgttgtgaaggatccagtagagttaaattaagcatgtgttttggtgaaggaaagaaaggaaatgatgtgtgggagacattctttgcagaaggaattattggggaaggttatggaggggaggaagttacggccagtaacccatgagagaggtgccacaggagagagagagaattctaggactgtcctgcaaaagactgctaggagagggcggtgagccaagtcagtcctgggcctcagcacttactggatggctgcttacaaagagctcgggtctctctggaaggacatcctggattatggtcatgagttagtgctcaactatagccaagaccaatgtctccaggattcacctgtgtgtttctttctctgggcatgtttatttagggacttatttatggaaatagtgttcccgttgctggaagtggctaggaacactgagacatgtattttatcttatccaaatcaattgctatgaaactatgctcatcaccctttgtagttgtagatcacatacccctcagcccctcactatggggccatttaaatcttccgtgttttatttgctttggatccatcctcttcagtcaaaaccatctgactacattgcttttttttttttttaacccctctgggtgtgtcagtattatactgcttagaaattgtcttagaaagcttctgtttcctgaaaaagaaaactccttactcatgtcatcctctgatttactccatccctgttattgcctattaaagtcttgtccatccttcaagaacctgatcagatatttatttctccatgaagccttccttaatcactccagcttaagggaatttcttctctctttataatattgtgtcacatactatttctaatattgcatccaatgcttgcttgattattagtgttactcagagggaattttttaaaaatcactttgtattctagaacagtttttttttttttgtctcactctgtcgcccaggctggagtgcagtggcacaatctcggctcactgcaacctccacctcctgggttcaagtgattctcatgccttagcctcccaagtagctgggattacaggcacccaccaccaagcctcgctaatttttgtatttctaacagagacggggtttcaccatgatggccaggctggtcttgaactcctgacctcaggtgatccacccgcctcggccttccaaagttctgggattacaggcgtgagccactgtgcctggctttctagaacagttttatatttacataatcattgtgaagctagtacagggaatccttgtatatcccacatccagtttcccctattattatcatcttatattaacatagtacatttgtcaaaatgtatgaactgatatagatacattattattagctaaagtccattctttattctgatttcctcagtttcccctaatgtcctttgtctggatataacattacacttagttatcatatctccttaggcaccctgagctgcgatagtttctcagactttcttgtttttaatgaccttgacagttttgaggattactcatcaggaactttatagaatttcccccaactgagacttttctggtgatttttttataagtagactgaggtaataggtttttgggaggaagtccacagaggtaaagtgtcattttcatcacatcatatcaagaacacatactatcaatatgacttatcaatgttgatgttaaccttgattacctgtcttgaggaagtgtttgtcagatttctccactgaaaagtgaccctttttctttctctgtttttacactgtacttcttgggacaaagtaactatgtgcaacttactcttaaggagctggggaagggagatagtaatgcttcattttcttaagagcagattatctacataaattatttggaattcttttgcattggaaatgtgcatattctccccatttgtttattcaatcattaatttatagcagcatgaactcatggatatttattttattctttggtttataattcaatactgctgtttttgaggggaggaactcattaagttggctactgtgtccctttgtcataccccatcatctttttgtgtgtacattttctcaatttctggcactaaaagatactccaagtccatcttgtttatagtctgctccattcccagaatcagccatttttctgaggaatcctgtctccttttattgaagaatgttattagaaatcaagatctgagcactaggtttgctcattgctactgggatgtcattgcctctaggccttttcagcggatggaacatatgtgtgtatactaacccaggcatatacacatatctataaatatttccatatgtaactatttgtatccttattaagctaaacataagttcatactgatgtctccaaatctaatctattatcatagattagatattatgaatcattttggggaaacctgaaaatacagaatcccaggtatcactccaaagataatgaatcgggataaatattgaacttatatgttttgaaaggcaaacattaaaagtaaatgcttctcttggttgaatattggaatcaatatcaagattatgaaaacatcagtttacatgataaatataagttttactttaccattattcaccatttgggtaagtatttatcttaggaaaacttcgtgtgtctgactatacttttgctaatttaaatttcatgagtgtgcaatctgatagagtttgaaaattattatattaggtgattattggatgtgccattcaactcccaaagtctgtgattcgaagtcccatatataaaaacaaacactgcaggaacacaaaattaattgtgagaattgtactcattcatgttggcagtatctgcctcactcatttcctctccttctctttctgttttcttgcattattggttggtggcagactccagttccaacaccatcttctgagatgatcctgattcccagaatgctcttggtgctgttcctgctgctgcctatcttgagttctgcaaaagctcaggttaatccaggtaacatggctattactcagctatatgctagaagaccagcagaatgtttaaacccatcaatgttcaatggtgggtctaaaagctgccaagagggactacaaagctctttctttttaaatctccatggtgaaatatgactaaaataggaagaaaaatgaatatactttatatatatgtattttaatacttacaacctgttgaatattgtaaaatattttcttatatagagtaggggtgcagtaagagggcattttaaaaaatgggaggtggcagaagcaaccatttgcttctgcatcttctgagaaaaacaggacagaatttttagatgtcttggagaacttcttcaggttggtttaccagttgttttgggctgtcttagactttgattttacttggatgtcctgttatgcttttgggatcctggtcctgtgggatctcaggcaggttctctttcctctaggatgtggccatgctaaaaatagataggttaggagaatcttttgagcccaaatttgtgggattattttgtattacatgcatttttaaagtttaaatggaagtaaataattgtattatttattacacaataatgctgcttaacaacctatccaaagctcaatgtctttaaacgagcatttatttggctcctagctggacttgtttggactgttctctgttctgtgttgatttactcaagcataactggaagtcagctggctattggctcatctaggatggatgtggcactgatgaatggggcaactttgctgtgttctgtttcatcctcctgcagactaacctgggtatgttttcctggaaattgcacaggaacaagaccagaagccagaatactcaaacatttttcaagccactgctgaaatcatgtttactaagtctcattggccaaagcaattcatgtggccaagcccagagtcagagtgggagagcacaaaaaattagatggtaaaggtctgggatgcaggtattggagaagaattggagtcattttttttttcattttgctacaaatatgaacatggaaaagtatacagcttaaatgttcaattttatgaattcataaactgaacacatctaaacagtacctggattaagaaacagaactataccagcactttagaagctctcttcatgctcccttccagtaacttttctcaccaccccgcaaaggtagccattatcctgctttctagcaacatagattagttttgcccatttttgtactttatataaatggaattagatgatgcataaatactctttgtgtctggcttctttcactcaacattttgtttatgaaattcatcctactgttgcatgcagttgtcaactattcattttcattgttgtatattactttgtttgaacattttatttagccaatctactgtagatgggaatttgaataatttctagtttgggcccattatgaacaaaactcctataattattcttatataaaacttttggtagagataagtactcagttcctttgagtatacacttagaagtggaacttcatatgtgtagcatatgatatactattctgcataataccaaaaattttttcaagtactttaccattttaccatcccatagcagtatatgcaagttccagttgttccatgctatattttgattcttgagggtgctttaattttgtcctcttcatagcataagggtacatttgtgaaaatgcttgctctcctcccttcataaaagttccatgtgcatgggtttttctttataccttcaataggaaatatgatcaaacatccttaaaatcaaagaattattggctgaaggagcccagtgccttgttactttctcgtaataagctcagctgttgcatctcagatcctaacttgggtaccattttttcctttttctgttctgtattcctctcaatcaattgttgatgtttggttgcctcctactacattcttcatgctctgagttctaaggaagagtgctgtgagtgcatggaatggtgggatgttttggtggtaagcatagtcatggagactggcatgccacgaggacatttaaatgactaaccaggagagctgatcttctgtgttagagtccacactgtggccctggagcaggaaatgggctatttggagacagcaaatagtcatcttaatttttttttctatttctggtgtcaggtatttttgttggctctttctgacagggaaagagaaatagacttcttgctttgcaaagacctttataggaaaacaggacatgttgaaggactaatccttctctctgccatttctttctattttaccaagtcaaaccagagatgagtgtttgaggcagatgagacattttcattcattatcagtgataaagagtctatcatgaatcctgaggctcatagaatgttatagcttgcacactgctgagcataaagtcagcatatgataaatgcatgttgatttaaggatgactcttcaggagtccttactggtgtcaactgaaagactgactataactgaaagtattgaaaggtaactgaaggcactgaaagactgagtgaattcttggccagttaggtttttcccacagaatggccacatgatataacaaatagaacttaagccaggagacctgagttataagcaaatccaatatgcaaccaattattaaattactgaaacattttagttggttattagctataacatattggttggttaatagtaactgagctaagcattaaactcaataaaataaaaataaaataataattagttgaagctcattgttgaagatcttacaatgactattggtcaataagccttcagtattagcatgatttagttgataacaaacattaaacatgatatgatatgaaatatcaatcttggtgtctcagcagataccaagagaggataaataatcttgtttacatttaaaaaaactctctagtatttgaaatcataaatgtctcacaggtgtcatccatggaggctgcagagtagtggtggtatgacagagatagttggctgaagcacgaaggcagcagagtttttggctcactgttctaaagtatctgagttttggcaaagcaggcagtcaggcagatggtgttagtggcatttccagtaatggcagtgttaaaggtagcattgtcaatggggcctggagcgtaggctacgcaagtctttgtgggaaatgctgacatgaaggtgtatatacatagtcctgaattgtgggcagagttctcagctatcttccagctgcaacagtgcaccaggaactggaacctaatcatcattaatccagtgggagaggttattggaagaattagaggcagtttcttatgtcaaaatcatggctcagaaataccatttagctagtgacatccaaatcaaacaaataatcatcccaataatttctgaaaatcatttatacaaatcaacagatgattggaatgttattagttctgatgaatgatttggagttaacttagaaaaaagtatttagcttaacttttgagtaacaaccctaattataatcctgacttggtcataaattaattgtgtgacagtgagggagttgttacgtgtctctttatacttccttaatattttcacttgtagtaagattaagttggattagataatctatgggaccctttctgctacaaaattactgtgatttttatgatgtgagaactttatagcccatactggaagatttcggcttggaagtatagcccctgaagttgcatggctgttttttgcaagaaagactacttgtttccaactccctaccacttcccaggctcagggatgtgaagtctgaatttcaggagaatcttgcctttggggctaagcacacaggaagtgactgataaatacttaaaaattttaaaccctaaaactctgcttagtggcaggtgaatgcagaaaccctgccccagcctaacctgcaggagagtcatagtgctacaagctaccctgctccagagcatcttttgctctagaggtggggccaagaggtagcatttcaggctgaagatatagcgtatgcaatggctgagaggagggtgaggaacatttggggctcctggtggaggataatgagtgagagagccagcggggctatgtaggagatccattcccctgtgggatccttgagtcaagttttcccttatttccagcttgggctgggactgccaaacttgataggagaactaagggcatctccatgggaaagagaccccacaatcatgcacaaaaatacggggctgcagtagttgtttgagtggacatcagtgtcaggctcccctaggggatataaaaccactgtttcagtggttagtggggaactggcaccttacgtttttccaggtaggaggatgaatagaactatcctgatgatcctgaaattctagcccagcagtctgaagccctgggacccacccagccaattagaggattgttgtgtataaaaaacacaggggtgcttgttcttattcccctgacttggcctgtgacaactgtttgtgctcaggaaagggagaaacatctcttcttctcagcaggcaaaccaggcctttaggatccatggtataaagctgaggcagggcagtgctggaacttcccattttcatgtcacactttcccctcataggaagcaggcaacttactaccagttcagagtcctggggtgggagtccccctttggtatccagaatgcttccactttgaaaaagagtggcaaagccattcagggtttgggattaggagaggacgagcttttctcctcctggccccaaatttattttaggttcaccactgtggtttttgttctttccagcatcaatcccacatgtcagtgagttcttagggtcaggcaactagaattctagactgttcatgttggaatggaccttagaaatatctaagtcactcttcctcactttacagatgaggaaactgggagtcaaagcaggtgagtgatttgcccatgctccacatttagctaatagttaagctaggacgaggacccagggctacctgtctcccaatcccaggtgacttctacctgggccctcagggagcaatgtgctgaagtgacctttatctaaaaatcacatatatccatgcagcctcatgctttcctttctgcaaccaacttccaatgtatatttatggggatgagatgtaattgagatttgagggacagcctgaggccaaagaatggagtcagacgaataggatatacagtgctcacacctagtctcatgctaaatgaggaaggctggagctagaagccctgcgggccaacttacccccacccagaaactgaagcaccagggatgctttggttcccttctgcaccaggttgtgcctttatcaccgctcccttgtcttccaccaagactgctatgtgttaattcacctacacatatttccaaattggaaactcatttttgtttccctggcttctcgtcattcgtgttcccagagatgtgctgagaaggtttatgtggcctcatctgttaacgagaaggtgatgctagtttcaggtttgtgaaaccaggcctgaggtactagtgttgtgatgtgtgtgtatgtgtgtgtgtaggtgggtggcgcgggggtgtagtgtgtgttagacagcctgaacaggccttgagaaaaagataaaaggccggcaaaagacctctctggttgaatttatcttaagtgagcaatgctagaagctgcccagattggctctttcttgcttgtgtgtttgttttttaagtctaggctgacgcctgagagtggcctttggcatccttcctgccagtaaaagagcctttctctgggtaaaacagaaactcatctgccccttgagccctcttggttgtgccaaatagggaaaaagagaatgcaaaactcaaagaatattcaatgaacacttaatatattctgggtaccattttaagtggtgtcaacaaatttaatcttcacaataatcttattagtattagtgttattatataatagtagtattattattccagttttacagaggagaaagtgaggccaagaaacattaggtaactcatagcaggttacagagaaagctaagtggcagaaccggcattcgactctgctccagcaagcatgctcttttcttctacttcttttttctttatcccgtttttcaaatttccaacaatgtatcagttaagagtttttcgcttgtttttttgtttgtttttggagagggcatgttgctctgtcacccaggctggagtgcagtggcatgaacatgactcactgcagcctcaacctcctgggctcaagccatcctcctgcctcagctccccaagtagctgggactacaggcatgcgccaccacacccaactagtttgggtactttttgtagagaaggggttttgccatgttggccagactggtcttgaactcctgacctcgccctcctaaagtgctgggattacaggcatgagccaccacacccggccacaagcatgctcttgacctctgtgctctactgcctttggagtgtgagactcaaggaatgtcagggcagaggaaacccagattcatggaccagccacgaatgggctacagagacccgtgaatcccctgaaattgcatcccaaacttaatgtgtgaagacaaaagtacatttgcaaaatgaaaaatgttttctattatcagatgctcaaaagactctgtgaccagttctagaaaagactaagaatggtggatttaatctaatcttgtacaaatgaggaaactgaggtttagggagataaagtgatgggaggaaacatgtttgaaaagactattagcagacctaaccaggctttgcctactcgctggacgagcatggtcagagttttgggttctctgaactgcagtcttctcacctatcactgatcgctgccttaagggctgttaggaagagtaagagaatatatgtaaagtacctagcatagtgtcaaacacacagaatgtgattaataaatgctggaacttctgtcctcttcctcaattttgtatattgtgctgtgataatggcagacttcattagtctttccattattctatactgtcctttatattttagtttaatcatttcattaattaattatttaacttaattactatactgtaaaaatatttcattttctttgagggcagacttcacctaattcctgggctttgtatcttgggataaaagggttccaaatacatctactgcatcatcacctttccatccaaagtagccaggtgaattcccggttcataccctaaaactttgccttcaccctgttgttttgcattctgaggcctagattcctagttgtaaaaggcagtcagaggagctaaaagtaatgcaagaaaaaacaaagctccactttttttctgttgtcagtagggatagaggcccagggagacctagtctccttgagtctaaactttggggccaggagcatgatcatgggactccaggaagagcttcacacaaagtcccttttctggacctctcagttttcacaaccacctgcagagctcagttttgctcagggctctcgtgtggaaagactaagagtctacagaagaacaacagtgttggcaggagcagacaaggagacagggaccctgcttaccatggaaactgggcgcactggggccattaggtccgtgcatcactgctgcttcacatatttgcttattaatgttttgttctgaaagctgacaagaactctaggggcttcaagcccataagatcaagacatacaatatagcgatataagtatgtaagaaacatagattgatacagatataaaataggaaaaggatatgaaacaaatataatatatatgataaaaattataaatattataataaatatattataaatattataatatttaatattattaatacattaaaatataaacatatatttatattttgtaaatataaacatatatttatattttgtaaatataaacatatatttatattttgtaaatataaacatatatttatattttgtaaatataaacatatatttatattttgtaaatataaacatatatttatattttgtaaatataaatataaatataaatatatatataaaatatgtataaaaataaacataataaatattataataaatatacacacatatatatgtgagtatatttatgtatgtatttatatatagatatatctatatttatgtgtgtatatttatgtaagtatatttatgtatgtatttatgtatatatagatatatctatatgttcacatgttacatgttatatagatatatctatctatatatagagttaaaaataaataaataaataaataaaaataaaaataaaaataaaaataaataaataaatacagagaagcctgggagtttccttgacttcctttttccccctccctcttcttattcatcaaacatttgttgattgcctatataagccaagcactgtaataggtgctggtcatgacgacacaacagattatcactacaccagagacaaagaccaaagtcataaaaacctctgaagcaggaagaaaaaaaaagttgcataaatttttttaacaactcatcacctcccacttaggctcataaaaaaacctcactgattttagtgtcttaacttctactttactgtgtatgtgtccaaactactgaaaaattctgtgagggctatcttgccacatccatactcttcagagacccacaggccaggaccaagagctaagtcgacaatcacactatatatatctatatatatatatatagatataatcacactatatatatctatatatatatagatataatcacactatatatatctatatatatctatatatagatataatcacactatatatatctatatatagatataatcacactatatatatctatatatagatataatcacactatatatatctatatatagatatatctatataaatatatagatagatatctctttatatatatatagatagatatatctttatatatatatagatagatatatctttatatatatacatacatagtccataaatatgtacataaatatgttcacattttacccaatcaggtcaaatctccaatgtcatgctagttgagatactgaaggtatgagagttagctggagctgaaagaatttgccaggccaggtaaaaagaggaagggaaagcttttgagctgaagaaaaggcacagaggcacaaatagaaaaacaagagtgaggatagtgattattgaggggtcatgaaggcaaaggtggggttaggatggcaccaaaagtaggaaccatataatcttgggatcctcagtatatgacaaatgttttatgatcaaaggccttgtcttcacctggtgttaacataatgctatgccatgctgtctttcccagagtgcaggttccttttgctatcacatttcaacaaatcctgggacaagcacattctaaaaattagacaagcaataatcctccctgggctctctgtccagattcttccccaacttggtgattcttgaccctagtgatcacatgataaacagggtgtgtgtgctggtagcagggtgtgatgaccacgtgatacggttactagacagactgtgacaatggagatcaagagatctagattctagttccagctctgtcactatctagctttgtgactttaggtaaatctctgcacctcactttgctcatttataacatggggtccataaactttgctctctgaacttcatagggttactgcaggggattgaaagagataatggaaataaatgggctttggaaaattacatgcaaatatcaaagactgtgatttgttacttttggaagaaaagaaaatgaaaataaacactatgaaacaacagtttctatcaagcagatgatgcaggaggaagaaagagaaaaaaactccattagtgatcattaaggtcccttgtggtccccaagaccgactcaagttgcttttggggaatggggcttctaacagtcctgaactctggccaccctaactctaaagggatgcaggaccctgtgctcaagccaagcatatccatttatatatatatatatatatattttttttttttttttttttccttgggagaatagtgtgattgttgacttagctcttggtcctggcctgtgggtctctgaagagtatggatgtggcaagataaccctcacagaatttttcagtggtttggacacatacacagtaaagtagaagttaagacactaaaatcagtgaggtttttttatgagcctaagtgggaggtgatgagttgttaaaaaaatttatgcaactttttttttcttcctgcttcagaggtttttatgactttggtctttgtctctggtgtagtgataatctgttgtgtcgtcatgaccagcacctattacagtgcttggcttatataggcaatcaacaaatgtttgatgaataagaagagggagggggaaaaaggaagtcaaggaaactcccaggcttttctgtatttatttatttatttttatttatatttatttatttatttttaaatggagtttcactcttattacccaggctggagtgcaatggcgcaatctcggctcactgcaacctccgcctcccaggttctagagattttcctgcctcagcctctcgagtagctgggattacaggcatgcaccaccacgcctggctaattttgtatttttagtagggacgaggtttctccatgttggtcaggctggtctcgaactcccgacctcaggtgatccacccaccttggcctcccaaagtgctgggattacggcgtaagccaccatgcctggcttttttttttttttttgcaaaaaaaaaaaaaaaaatctaaatgatgccatgtgagacttgatctcagaaagatgttgggaagctgggaaggaacccataggaatatcatccctttaaatgatgagatgctgagtatggtgtgagtaaattagaaggaagataatgaaccgaggccatttcagctgaagctaccaaagtgcagcaccaggtccagccttctagtgttagagaactgggagagcccatctccttgcagaggtagagcagcccgggactgcaggggagggtgaggccttcatgcttgttcctaaatgcctaaggtcttcgtttaggctacaagcggagcattttgattgttatacataaaggaaaatgtggttaaatttaattcaaatatatgtaaatatcttatgattggcatttcaagggaggaagtcagattcaatcttttggctactgtaacctatattaaagataggaagtatgcaatgatgtgtactgtctatgtacaggtattgctaacttgagaaatgtattggcatgggaggagccctgggcttgcccataggacaaatccacctcgaaagcagagcagagtgtcttcattctgggtagctggtaggatgtaagcctgaattcttggtcttccagtgcttcttaaaaactcccacgtgctctctttcctcaccaggtcctgaactctaatctgtgtcctgtccgactctcaaaaaatcagctcagctcttcagagggcttctccttacattccccctccacacagccccagcatttggcacatgtgctgagtgagatacactgcatgctcgagggataccaggtctccctcaaaaactctgctaattttgtcccgtagagaccgtctgctagtgccaaacccggagtcggcctcctgcccctgctccaaatgggcaaatggctgaaagtggctacagaagttccctcacctctctgagattctcccttctctgaagtcttggtctctgcattctcattgcctcagaaacaatcagattccttcaagtagatgatttatgaattttatttagctcttccagttacttttagagggagcactaattactgcacactactccatcccacctagaaacagagatattaataaaaagtgaatttatactttattgccactgtgattcatgttaactaatcatgttttactttttgacttgacttctaggaagctcagagccaaagttgaaacccatcatcagccagtggtatagaaccaaatgtaatactctttctgtattaaccttagctctagcttatctaattgttcctattttctttttcctttatccaaatttcttcacttatttatttatttatttttatcttatgcaactttggaagccgactccaaactttactgagtgagtcaaagtaaaaataattaaaaataaataatacctaactttattgaatattagtgctctaagtgcttgacataattaactcatatattccttatggcattcctataaacaagtgcaattactaccatgaaattgagaggctgaaagcttaagtaacctttctaaggtcataaaaccttttaattgtttaaggaagagtgaatgtactattttaaacaaatagttctctcttctcctcttagatatcatttattgagccccattacattctataaagtatgctaacttctttgtatacattatgttaaccttggcttggcaggattatgaaagatgaagaaaccgaagttcatagaggtttggtaactggtagtggggtcccataattcagaagtggcagagccaagtcttaatataaactttccatgattccaaaccgtggcctcagttttcttcttcactcctgatctgcatagctacccagtttcctcttcagcttaccttcttgttggggaaaggagatactatttactatgaaagtttcactgtctttgttaaccaggaagaagaattcattatctgatccctatgttagtatcctgaaacccactacagcttggggactgctctcctggggctctgcaagaattgtttctggaaagtattttgggcttccaggaaaactgcaatcctaaaggtctattcctaaggggaatttcaacttgtgcaagaggtctgggtgaccattatacccaaagaatagccctgtaggctgaagaaagaaacccaaataatctttcttggcccccctgtggaatcccattgtgtcaatatttatctgcacaaaggaccagtctgaaacagcctgctctgtgaagcttgtgggaagcagggcctcagtgacagtttctttaagtggactaccttgtcctttcagaaactggaagaactagaccatggtagcctagggttggaggaggaagaaccagggatcaggagacctgaatttcagtcctggttaccctagccctctgtgtgaacttgagtaagtcacttcacctttctgggcctcagaggttctgatatttaacacggagacattagagggattggcttcttaaatttgcttctgggctccaacgttttatgattgcagatgtccctttagattgtagactggcttgagaccgctgaccccaataatgcccctcagtcagtcttgtctgggcccagagaggcccaggtgtcaggtctctgcacctcaggcctcatgtgggccatgtgtgtgttttcctggaagctgcatataggacactcattgacggggagcccgtggtctggagctagtagtgagatggtaaacattatggaacaagcagccctttcaggctctcagccttggcaggatagtatgaaaaataattcttgggaagctggggactggtggcagctgcttctcctcagcctgcctgccaggccctaccagagcttggagggctggagctccctgctgggcctgccacagcctgtgctggtagttttccactctgggaaactggaaaagtgaattggcttctctgtccgggagattggtgggtagcggaagcatcagaaaaccgctaagacaactcagcaggaaaaaccaggagacacttctttgctgcagggtctcttgcttcccttgccattcccagctttttcatgcttctttacagttcatgatagaacaaagacagactggtgggatttgatgaacgaggaagtggaactgggggaaagcaaggagacctgacatttagggcttgggccaacttggcagttctgagtcttgactattggctgagatcccttccacagaaggagtttacccaaaataggcacattcaatgggaaaaccacactggtacagctcagaagtgccacgttggttgccctgggcttttcctggttccaaagattcagtaggatgagaaaggtcatccaagatcatcttgtccattttcctgtgccttttctctaaggcccttgggcatactgagtcactgagaaactttgcctattttcttaatgtgactattgctgatttactaagttcttatctctgaattgtctatcctcatccttatattactttgtcacaatttctagacctccatcctaactttcgttgtctggagattgtgtgcaatacttgtagccctctctgccttttcatctacttatttatttgccaaacgtgtgttaagcatctcatgggtgctgtgtgttggcaggtactgagggggaaaaggaagaatctgacatgattactattctcaaagttgctcacaatttcaacaaggaggtaaccaagcacaagagtaacagaaaatctccgttggagtttgttacttaatagagctcgcctacacaccatcatcactttaatcccataccacgttttagtattttccatagcttcgtcacattatctgaatagaaagagccagtaatagctactgtcaaatacataatcaaattgtgcctatttgattatgaaaaatctattttcttttttctgtctcccctaccggaatgtaagatccatgagacaaattattttatctgtcttgcttactactgtatcttcagaagaacacccgatacacagcaaaaacttatttattaaataaatacatacacatttgtaaaagaaatacatttgtgaactcaatacatgcaggtaaagataggttgcaataaaatatgtcatgactcagacttacaaggaagtttcctgtatctcctgtctgctaaaacaccattagccaaggctacccttgaccaaactcccaggactttgtttttaagccttgtaaagtgatgaacaacagaaaacacttcctttatcacttttcaatagacgtttattgagcacttggttaatgccagacatcctactagaaattggagatacaacagaggaagatagatatgatccttgccctcataacacatgctgtttagtgggcagaccaaaattaaacaattatttacattacaagtctaaaaactgttatgaacgaaaaccagtttgttataagagcatataatagaaattcctaacttagctggggacttgggggaattccttgggggagtgactggctgacagctgaaggatgagcaggagctagtgagtgaaggagggaggatgcacatcccaggtaaagggagcatcatgcacagagaccttgaggctggaagatactttgtgcattcaggaactgaaataaggtcagcgtgcttggtagagagcaaagaacagggaatagccagagatgaggccagagagtaggctgagacccaatcgtgtggacctcaagggtcacattttcttaagaagaatgaaaacctgttagaaggttcatgacagaataaagttttaggaagctaatttgggctattgtgtggagaagggatgatagaggaacaacgaagaagagctagaaggcattatagtggctcagatgggaggtcatggaggttgcgcactgcatgggaagaatagaggagagaaacagctggactcaactgcaggaggtaggatttgtagaacttgctaatggactggatggttctcaaaggccaagcttacttctcattccttgactgccgcctgttgagagtaacatcttacctatcattcctggactcttcctctccaagaattctattttggtctccaggcagaggttgactcagggagagcctttccagttttcatcaatgtcattgccactctgctgtccaccacacagttgacctaaaccctctgtatgctggaagagctggacgagtcgaggaagaggggagcgctgacatgtgtaacaagttatttacatgaaatgaagcctcatgtcctcccctacttcctctagttctcaagcttgagtctgcattagggtcatctagagtagtggttaatacactgtttgctaccccctcccagcaaccccaccagagtttctgattcattaggtcaaatggagactgataattagcgttgctaatgagtttccaggtgatgctgatgctgctggtcctggaagcatattttgaggatcacagctctaaatggtaactgaaatgcaatcacaatacatagatcaaagagctttcaggaaggaaactggcactcctttgacaccacatagcagagtatcctatatggatctacctccacatctgttatataggaaaattcctgaatgggttcagttaggacacaaaatataaagggtttctatgcctaggaaatataatttaactgaaatgtgtcataaaagcagctgcagcagcagtagctctgataaaactccttagttgccattctcagaatgagcagtacgttagaaggaaagttatttgcaacaatatcatgattcacctcatgtgacccacattccctatttctgctttactttagatattccaagaagcagaggctctcattgcattcatggcctagtgtttagagatgcattaaagccagggatgaaagcccagtgggacggtcagtgtggctttctctggtgcccagcatggtcctagagaatcattacacgtccaggctgaagggacctgggagcagtggctccagagcctggctacacagcacagtcacctggtggactgtaaaaatatgcaggttactgggctcagcttcaggtataccaaagcaaaatctctaacaggaggctcacaaacatgtattctaaaacctctccaggcttttctaatgctattggtccatggactggctttgggaatcactgccttacagaaagcctaatagaactctcttgctttccacatgaagaaacagaccgaaagagagccaggagcttgctcagatcccacatggtataagtggtagaaccgggagtggatgcgaagtcttgattttcaagggttgtgtgctcagtggaattacaggctttagagccaagttctaagatgagttagtatttactcaaggaatggcctttgcagttaaaacttacctgtagaatgtgtgattagtgggaaacatgaaatattgggtggaaaatgcttatcatattgcctgacacttggtaaatgcttctaaatggatgtcatcattactgcattttactgaatttaagcaactcacgactctaagatgcatcattactttatgtgcctctaagaaagaaagaaaaactactgccagttaaactatgacactatttgcttgcgaagtgcatccagatttcagagatgtcagtacgtgaaagaatgggcagtgtggtatttcacttctcttttctcaactctatgaagattcttactttactgaattagacacttaacagtacatgaaaattcctgaaggagaagtatacttagtgtgtttgaggaacaacaaggaggccagtgtggctgatggggaaagtggggtaaggacaaggtccaagacagccaggggatgtctgattccatgtcttcactattgtgaatagtgtgaacagaagagtttcatgatatgactttcatttcttttatgactacatagtattccatgctgtatatgtaccacattttcttttcttttctcctttgctttttctttctttcttttttttcgtttctttttttttattacagttttattttttatttattttttttggaataatttttttttttattatactttaagttttagggtacatgtgcacattgtgcaggttagttacatatgtatacatgtgccatgctggtgcgctgcacccactaacgtgtcatctagcattaggtatctctcccaatgctatccctcccccctcccccgaccccaccacagtccccagagtgtgatattccccttcctgtgtccatgtgatctcattgttcaattcccacctatgagtgagaatatgcggtgtttgggtttttgttcttgcaatagtttactgagaatgatgttttccaatttcatccatgtccctacaaaggacatgaactcatcattttttatggctgcatagtattccatggtgtatatgtgccacattttcttaatccagtctaacattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgataatgagcattttttcatgtgttttttggctgcataaatgtcttcttttgagaagtgtccgttcatgacaaacccacagccaatatcatactgaatgggcaaaaactggaagcattccctttgaaaactggcacaagacagggatgccctctctcaccgctcctattcaacattgtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttcaagttcatatggaaccaaaaaagagcccgcatcgccaagtcaatcctaagtcaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaagggcttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacgatgaactcaaacaaatttacaagaaaaaaacaaacaaccccatcaaaaagtgggcaaaggacatgaacagacacttctcgtttctttttttttgagatggagtctctctctgtcgcccaggctggagtgcagtggtgtgatcactgcacctccgcctcccagattcaagcaattttcctgcttcagcctcctgagtaactgggattacatgggcacaccaccatgcctggctaatttttgtatttttgatggagacagggttttaccatgttggccagtctggtctcaaactcctgacctcaagtgatccgcccacctgggctgcccaaagtgctgggattacaggcgtgagccaccatgcctggcccacattttctttatcgaatccactattgatgggcacctaggctgatttaatgtctttgctattgtgaatagtgtgagcggaagaatttcatgatttgatttacattctaaaagatacatgggaaaaggtggacaaagggagatcagttaggaaattattgcactattcctggcaatggaagacagtgaattagcttattatgatagtaaaatatgtgagaagaagtaggtgggatatgggaatatttttagggtagccagtagaatcttctctcagtggatggactgaatacagggtattgaaggagtcaagaatggcctcaagatttttggcttgagtcgttgaaagaatggaacctgaaaaaaaaaaaaaagactgaaggatgagctttggagggagtctgtattttactcaatgttatctttattccttatttacatctatctctaaagtttacctctttttttaaataaatatttttaaatacctattttctccccaatatgcactgagaaataaaaatgaataagatacagtggctttattcccctcaaaattttgccacctgcaggggagataggactcacacgtggtacattacaaagcagtatgtatctaatagtataagaaagatatttaaaatgtgagaaatcagagaaaggaggcattcattgtaattggccctatcctcccctcaaaatgcttgcttttgttgagtacaagttcattacattggaaaaggagaatgctagcataataactttaactagttttttcactttgggtaaactgcctccttgctgtacctcaaaccacctccacaacaagcatgctttttcctcaagtttacctttgcatttgctgttccccttgcataaaccatcatccctgcaagagtcacctggttgctgtcttccttcactcaggtctctgctccgagtcaccttatctaagaagcctaccttgatttctttatataaaagaatgcctattccttttgcatactttttcttcacagcacttgccatcttctctcacattatatatttatttgctttattggctgtttccccacatgagaatgtaaactcagtgacaaaaggcactttgttttgtttaccactgtattcccgcaaggccaatgaattgcttaacgaattatttaataaatataggaattaaaataaaccatgggtttggaaagcaataagcaaatggggttggagataggactggactctgaacacagcgttggtttcagaagagagagaagacactagagaacagctctctgactaagctacatgcctctgtggcagcctggaatcttgggacacacggcttgcaccaggccactcttttggttaaagcaaaggttaaagtctggtgtattgggacaaactttggatagagatacagaatgtgatctacgtcaatccctactacttaatagctgtgggccttctgccagtttcctcatacaggatgagtatcccttatctaaaatgcttgggaccagaagtgtttcagatttcagaattcttggactttggaatataatataatataatataatataacataacataatacaatacaatacaatataatataatataatataatataatataatatagtataatgtaatgtaatgtaatataatataatataatataatataatataatataatataatataatataatataaatttacccaggtgagcatcccaaatccacaaatccaaaatccgaaatgctctaatgagcatttcctttgaacgtcatgctggtgttcaaaaagcatcagattttggattttagatttttggatttgagatactcaacctgtatatattttgagagtaatagtgtgtactctgccaactacatagggttattgcaagggtaaagcaaagataagccatgggacagcactttgcaaactgttaagaattctattatcagggtcaagatggcaatcagggacactatgacatggactacagtcaaaagatccaggaatgcctgccttggacagctagatcttctccccaggaggtgcctgagggagacatacacacaggtgacagtcacaaagggtaagtgaagttctacattattagtagctgggcttgggtcctaaatgccaatgtgagcgttctgataaactgacctgggcatgtagcccaggttaaaggcctccagaagcctctctttattcattaagtcactggtgacaaggactaaaacacttagcacactcagcgacatgtaagatcagtgttgaggagggattagagcaggcccctgagagggccattttctttgtgtgattttcaaaaagtacattgatctcatccattggaaattttggccccattagcatcctgtgttagtgtttcctcatccttactcttcccttcaatttcacttctcagaaagtggaatttgagaatttgttgcttcatccccaaacagttcagatttgcccttaagattcaagcataatgattacctgtggcacacattacctctactggagaaattatacttttgataagaataggcaaagtgatattacattcatatgttcatctcttgattcaaaactgacttggaaatcatagtggatggtgtgttaggctgttcttgcattgttataaatacatacccaagactggtcaatttataagaaaagaggcttaattagctcataattctgcaggctgcacaagcatggcattggaatctgtttggcttctgaggaggcctcagggagcttataatcatcgtggacggtgaagtgggagcaggcatgtcacatggcgaaagcaggagccagacagagagagtggggtggcggggaagggactgcacactcttaaatgaccagatcccctgtgaacttagagcgagagctcacttatcaccaagggcatggcccaagccattcatgagagatcttcccccatgatccaaacaccctacctcctctcccacccaccagcccccacctccagcattggggattacttttcagtatgagatttgggtgggcacaaatatccaaactatatctgatggtgtattaatccattttcatgctgctgataaagacatacccaagactgggaagaaaaaggggtttaattggatttacagttccacatagccggggaggcctcagaatcatggcacgaggcgaaaggcacttcttacatggcagcagcaagagaaaatgaagaagaagcaaaagcagaaacccctgataaacccatcagatctcgtgagacttattcactattacaaggatagcacgggaaagacgggcaggcccccataattcagttacctccccctaggtccctcccacaacatgtgggaactctgggagatacaattcaagttgagacttggtggggacacagccaaaccatatcagatggtgaacatagaagtgttcctgtgggtatatggccatgtttcttgccaaaacttcctgcatatgattctggttaattgcagtttctggaagtatcagctaatccttggcctaaagctatctttcccttttttagggtgagataagactccaggagttctccttggtatgatacaagcagaagggccctcttgccttcagttcttcatggttgtagtggatatcctccttcttcaagcccatgatgttccttagggaaggtagttctgctgtttctgtgccaagcctgggcattatgctcacgtgaaacctttttcccttgatttttgctacttctccagggcacttcctgggaatggggcttggtacctattaggactataaatttgcctctctctgacccctccaagctgagagaagtctcgcctttctccctgccacctctactccaccctgcagtccctttctgagggcaggctttctaggaagttctttgtcttcatgtagtttcttttttcttccctgtaaacataaatgtcccctagggtgaatgaacataaaggcctggccacaggctttgaaaaaggaagtgataatacacaaaaatcttcaaaattatctttctccagagattatttcaaaaacagttttattgaagtacaatagacatacaatagactgcacacattaaaaatgcacaagttggccagttttgacttacatataaacctgtgaaatcatcaccataatcaagataatgaccacatccatcactaccaaaagttgcttgtgtccctttatgattcctctggccgctcctccttcccccaggaaacaactgatctctttctgtcactatagattaacttgtttttgttttctaaagttacatataaatggaagcatacagtatgtgcttttttggtctgactttttttattaagcataattgttttgaaatttatccatgttgttgtagcatgcatcaatagttcattttattgctgaatagcaaggcatgatctagggtaggacaagtgaagtgcctagggttaaaatgcagtcagttccttatgatgataatcataatgatgatgactgtaaaaacatttaatgagacctgctctctgaacaagtttttaagtgtaatataccgtatcgttaagtataggcacaatgttgtacagtggatctctagaacgtattaatcttgtataaccgaactttatatccctcgaatatgaattcctcatttccctttcctcccaattcctggcaaccatcattctactttgtttctatgatttaggccatttttgatatgtaacgtatgtggaatcaggcaatatttacccttctatggctgggttatttcacttagaattatttctaccgggttcaaccatttagtcaaaaatgttaggatttctttctttcttcttttttgttcttttcattattattttttattatcattatactttaagttctggggtacatgtgcataatgtgcaggtttgttacataggtatacacgtgccatggtggtttgctgcacccatcaaaccatcatctacattaggtatttctcctaatgctgtccctcccctagccccccacccaatttctttcttttttaaagctgaataagattccattgtaggtgtatcccacattttctgtatctacttatctgctgatagtcatttgtgttgtttccatgtcttggcttttgtgaatggtgctgcaatgaacatggaagggcagatatctcttcaagatgctgatttagatcctcttgggtatataccagaagtgggactgctggagcatatggtagtcctatttttaattttttgaggagcctccatactgactgcatcattttacattcccactaacagtttataagggttccagtttctctacatccttgccaacatttgttatcttttgattttgttgatgatagtcatcctgacatgtataaggtgatatctcattatggttttaatttgcatttccctaatgattagtgatgttgaacaccttttcgtgtaacttggccatttgtatgtcttctttgaagaaatgtctattcaacttctttgaccactttaaaatcatattttttgtttcctatcaagttgtatgagttccctatatatcttggatattaaccttcaaatatataatttgcaaatattttctctcattccaaaggtcttttcactttgttcattgtttcctttgctgtgcggaagtttttgttgttgttgttcaattgtagttccgcctgtttttgcttttgttgcttatgtgtttggtatcatatccaagaaatcattgcttagaccaatgtttttttcatgtatcttcttccaggagttttatacttttagatatcatgtttaaatctttaatccattttgagttgatttttgggtacaatgtatgataatagtttaattttattatcttgcatgtggatatccagttttcccaacaccatttattaatgagatttttttttttgcccattgtttatttttgacactcttgttgaagatcagttgacctgtgtgggtgacttccaggctctctattctgtcctattggtctatatgtctgttttttcaggtaccatactgttttaagtaactttctaaaatattttgaaattaggacgtgtgatacttctgactgatttcttctttttcaacattgctttggatattttgaaactttttgtggttccatataaattttagggtttaaaattatttcaaaataatttctgtaacaaatgtcactgagattttgaaatgcaatcagttgtgaatccgtttcaattgttcttttttttcttacaatggtttctatttttctgctttgtcaaatgcctgataattttttatagtatgggacacacttacaccttaaaactttttgttagatggctgaataggaacagctccagtctacagctcccagtgtgagcaacgcagaagatgggtgatttctgcatttccagctgaggtactgggttcatctcactgggacttgtcggaaagtgggtgcagcccacagagtgtgagctgaagcagggtggggcatcgcctcacccaggaagtgcaagtggttggggaattccctttcctagccaagggaagctgtgacagatggtacctggaaaatcgggacactcccagcctaatactgcgcttttccaatggtcttagcaaacggcacaccaggagattatatcctgcgcctggcttggagggtcccacgcccacggagccttgctcactgctagcacaccagtccgagatcgaactacaaggtggcagcgaggctgggggaggggcctctgccattgctgaggcttgagtaggtaaacaaagaagccgggaaggtcgaactgggtggtacccatcacagctcaaccaggcctgcctgcctctgtagacgccacctctgtgggcagggcgtagctgaacaaaaggcagcagaaacttctgcagacttaaacgtccctgtctgacagctttgaagagagtggtggttctcccagcatggagtttgagatctgagaatggacagcctgcctcatcaagtgggtccctgacccccgagtagcctaactgggagacacctcccagtaggggcctacagacacctcatacagctgggtgcccctctgagatgaagcttccagaggaaggatcaggcagcaacatttgctgttttgcaatatttgctgttttgcaatatttgctgttctgcagcctgcactggtgatacccaggcaaacagggtctggagtggacctccagcaaactccaacagacctgcagatgagggtcctgactgttagaaggaaaactaacaaagagaaaggaatagcatcaacatcaacaaaaaggacatccacaccaaagccccatctgtaggtcaccatcatcaaagactaaaggtagataaaaccacaaagatggggagaaaccagagcagaaaagctgaaaattctaaaaatcagagcacctcttctcctccaaaggaacacagctcctcaagagcaatggaacaaggatggacggagaatgactttgacaagatgacagaagtaggcttaaaaatatcagtaataacaaacttctccaaggaagtttggaggatgttcaaacccatcgcaaagaagctaaaaaccttgaaaaaagattagacgaatggctaactagaataaacagtgtagagaagaccttaagtgacctggtggagctgaaaaccatggcacgagaactacgtgatgcatgcacaagcttcagtagccaatttgatcaagtggaagttcaagtgaatgaaatgaagcgagaagagaagtttagagaaaaaagagtaaaaaaaaatgaacaaagcctccaagaaatatgagactgtgtgaaaagatcaaatctacatctgactggtgtacctgaaagtgacggggagaatggaaccaagttggaaaacactcttcagggtattatccaggagaacttccccaacctagcaaggcaggccaacattcaaattcaagaaatacagagaacgccacaaagatactcctcgagaagagcaaccccaagacacataattgtcagattcaccaaggttgaaataaaggaaaaaacgttaagggtagccagagagaaaggtcaggttacccacaaagggaagcccatcagcctaatagcggatctctcagcagaaactttacaagccagaagagagtaaaggccaatattcaacgttcttaaagaaaagaatttttaacccagaatttcatatccagccaaactaagcttcataagtgaaggagaaataaaatcctttacagacaagcaaatgctgagagattttgtcaccaccaggcctgccctacaagagctcctgaaggaagtgctaaacatggaaaggaaaaaccagtatcagccactgcaaaaacatgccaaattgtaaacaccatcgatgctaggaagaaactgcatcaactaatgagcaaaataaccagctaacatcataatgacaggatcaaattcacatgtaacaatattaaccttaaatgtaaatgggctaaatgctccaattaaaagacacagactggcaagttggataaagagtcaagacccatcagtgtgctgtattcaggagacccatctcatgtgcagagacacacataggctcaaaataaagggatggaggaagatccaccaagcaaatggaaaacaaaaaaaggcaggggttgcaatcctagtctctgataaaacagactttaaaccagcaaggatcaaaagagacaaagaaggccattacataatggtaaagggatcaattcaacaagaagagctaactatcctaaatatatatgcacccaatacaggagcacccaaattcataaagcaagtccttaaagacctagaaacaaagagacttagactcccacagaatcataatgggagattttaacaccccactgtcaacattagacagatcaacaagacagaaagttaacaaggatatccaggacttgaactcagctctgcaccaagtggacctaatagacatctacagaactctccactacaaatcagcagcatatacattcttctcagcaccacatcatacttattccaaaattgaccacatagttggaagtaaagcactcctcagcaaatgtaaaagaacagaaactataacaaactctgtctcagaccacagtgcaatcaaattagaactcaggattaagaaactcactcaaaactgctcaactacatggaaactgaacaacctgctcctgaatgactactgggtacataatgaaatgaaggcagaaataaagatgttctttgaaaccaatgagaacaaagacacaacataccagaatctctgggacacattcaaagcagtgcatagagggaaatttatagcactaaatgcccacaagagaaagcagaaaagatctaaaattgacactctaacatcacaattaaaagaactagagaagcaagagcaaacacattcaaaagctagcagaaggcaagaaataactaagatcagagcagaactgaaggagatagagacacaaaaaacccttcaaaaaatcaatgaatccaggagctggttttttgaaaagatcaacaaaattgatagaccgctagcaagactaacaaagaagaaaggagagaagaatcaaatagatacaataaaaaatgataaaggagttatcaccactgatcccacagaattacaaactatcatcagagaatactataaacacctctatgcaaataaactagaaaatctagaagaaatggataaattcctggacatatacaccctcccaagactaaaccaggaagaagtcgaatccctgaatagaccaataacaggctctgaaattgcggcaataattaatagcctaccaaccaaaaaaagtccaggaccagatggatgcacagctgaattctaccagaggtacaaagaatagctggtaccattccttctgaaactattccagtcaatagaaatacagggaatcctccctaactcattttataaggccagcatcatcctgaaaccaaagactagcagagacacaacaacaacaaaaaagagaattttagaccaatatccctgatgaacattcatgcaaaaatcctaaataaaatactggcaaactgaatccagcagacaacaaaaagcttatccaccacaatcaagttggcttcatccctgggatgcaaggctgcttcaacatatgcaaatcaataaacctaatccgtcatataaacagaaccaaagacaaaaaccacatgattatctcaatagatgcagaaaaggccttcaacaaaattcaacagcccttcatgctaaaagctctcagtaaactaggtattgatggtaagagctatttatgacaaacgcacagccaatatcatactgaatgggcaaaaactggaagcattccctttgaaaactggcacaagacagggatgccctctctcaccactcctattcaacatagtttggatgttctggccagggcaatcaggcaggagaaagaaataaagggtatttaattaggaaaagaggaagtcaaattgtccctgtttgcagatgacatgattgtatatttagaaaaccccatcatctcagccccaaatctccttaagctgatcagcaacttcagcaaagtctcaggatacaaaatcaatgtgcaaaaaatcacaagcattcctatacaccaataagagacaaacagagagccaaatcatgagtgaactcccattcacaattgcttcaaagagaataaaatacctaggaatccaacttacaagggatgtgaaggacctcttcaaggagaactacaaaccactgctcaacaaagtaaaagaggacacaaacaaatggaagaacattccatgctcgtgggtaggaagaatcaatatcgtggaaatggccatactgcccaaggtaatttatagattcaatgccatcccccatcaagctaccaatgactttcttcacagaattggaaaaaactactttaaagttcatatggaaccaaaaaagagcccgcattgccaagacaatcctaagccaaaagaacaaagctggaggcatcacactacttgacttcaaactatactacaaggctacagtaaccaaaacagcatggtactggtaccaaaacagagatatagaccaatggaacagaacacagccctcagaaataataccacacatctacaaccatctgatctttgacaaacctgacaaaaacaagcaatggggaaaggattccctatttaataaatggtgctgggaaaactggctagccatacgtagaaagctgaaattcgatcccttccttacaccttatacaaaaattaattcaagatggatcaaagacttaaatgttagacccaaaaccataaaaaccctagaagaaaacctaggcaataccattaaggacataggcatgggcaaggacttcatgactaaaacaccaaaaacaatggcaacaaaagccaaaattgacaaatgggatctaattaaactaaagagcttctgcacagcaaaagaaactaccatcagagtgaacaggcaacctacagaataggagaaaatttttgcaatgtacccatctgacaaagggctaatatccagagtgtacaaagaacttaaacatttataagaaaaaaaatcaaacaaccccatcaaaaaatgggcaaagaatatgaatagaaatgtctcaaaagaagatatttatgcagccaacagatacatgaaaaaatgctcatcaccactggtcatcagagaaatgcaaatcaaaaccacaatgagataccatctcacaccagttagaatggcaatcattaaaaagtcaggaaacaacaggtgctggagaggatgtggagaaataggaatgcttttacgctgttggtgggagtgtaaactagttaaaccattgtggaagacagtgtggcgattcctcaaagatctagaagtagaaataccatttgacccagcaatcccattactgggtatacacccaaaggattataaatcatgctgctataaagacacatgcacatgtatgtttattgtggcgctattcacaatagcaaagacttggaatcaacccaaatgtccatcaatgatagactggattaagaaaatgtggcacatatacaccatggaatactatgcagccataaaaaaggatgagttcttgtcctttgtagggacatggataaagatagaaaccatcatttgagcaaactatcgcaaggactgaaggccaagcaccgcatgttctcactcatgagtgggaattgaacagtgagaacacctggacacagggcggagaacatcacacactggggcctgtcgtggggtgaggggacgggggaggaatggcattaagagaaatacctattgtaaatgacgagttaatgggtgcagcacaccaacatggcacatgtatatatgtgacaaacctgcacattgtgcacatgtaccctacaacttaaagtataataaaaaaaaaagagaaaagaaaaaaaaaaacttttgttgcttatccgaaatttaaatttaactaggtatactctattttatctggcaatcaggtgtcctgagactctagcttcctttacttctctggactcccatttttgtctcctcaactcaggaaattctccaggctctgcctgagttcccactcattgtgttgtatcctggacacactctcatgccagtaagctgatgccaccgtaggggtcaacttttttgtttcctgactctcagattgttgtccttcgttgtcagatgctcattatcttaaaacataatttttcatatattttgtcctttttggttgtttcacactggagagcaaatctggtctctgttactccgtctttggttgaaagtggaagtctgtatccagaagttattgtttatagccaggagccagaacatggttctaaccagggccaaaaatgtgtgtttgatcccttcataggtgagtgtgtagtttctttatagtttttatgcaattaactactgaaaaaaataattctttgggtcataaaggcgcctggtgattatgagggttcctcactactgtcaggaaattgattagaagtaaacatcttctaataagagaatgggatgggccactggggttattaccaagtacaaagcataaattggcacattacattgtattacattgattgtcagagtttgaaccaaaatatagatttggctgggggtcaaatctcggaggcccaaattgtatttggagtcagggccaggaagacaagtctgatagagtcagggtgatcaaactggggccatagaggaatttaggaagatgtaaattctcttattccttgttcaatattcagtgatattcttcctagggggcttggaaataaaaataaaaccatgtcctctcttttctctttggtttctcttggtctagctatatgccgctatcctctgggcatgtcaggaggccagattccagatgaggacatcacagcttccagtcagtggtcagagtccacagctgccaaatatggaaggtgaggatggttacatcaagaaagcccatgttctggggttgggcagatttcctgggcacagattcctgaccctaggggctggggaaggtggtgttattggcaggaactgttgagaaatgaaggacagacagcaagtgggcctgtcctgctctgtatgttttcagggagagaatttaggacttagccacatgtactggtctggcagccccatctcaaccacagaggccccagggccacattacccacagtgaatgggttcattgataggaagtggatttgctttccctgactttctcattgtgagctgctgcaggaggcaggcaacagtggcacctatgggaaggtgcagattatgtaggacactgggagttagcatccactcctcttctcagtgggtctatgaaacatcactcactgcaaagcatcactcactgccaagcatcaagacactgaggcctccaacaagttctccacctctctcaaggatctcttacacagaagggccatccttgccaacagacagagtgtggcagtttcctggggcgattgatttcaggggtcttgtacatcaataaactccctactgctctactggttggacccaatactctacctggaatcttattattttgtgaagtattgattttattaaaatggaattacccataagaaaatgaatcctgatgaacctttccccttaatttcttagtgtatgaaagactagagtgatggtaggtggaattggaagggagcaacaaatgaatgggtaatatctgtgagaaaagggagcaatccaagggagaggaaaagtggtagggagttctcaaagtaaactttataataatttcacaattttgctcagtggtagctcagcctgaaggtaataaaatgaaaccagattatttactacttccttgacatgctcttccccctcatcctccccatgtgtttctatggctccttgctggtctgcaatgcccatcctgctgcattgcataacccacactggagaccctactatccctcctccctattgccataacttgatgtccaagcaaagggtggctagctttgttaggctgagtttgaaagagggaagggaaatatgaaatgactcatgcgggaacagagagtaggaagagttttatttctctttatgcttctaaatcaggatgggaagtgaaggctatgtgtgatctgaaggcctcagctcactgtctttcagggtctcatggtactccagggaaagggatctgaccacaaatgggtactgtggtggcagtgaaaactgtggcaagaacccaaaatgtttataaggacagcctgctctctcccctcagtacagggcagctgcttgcctgtgaaccagtaaacagctctgtggtttcatggttgctccctctctccccaaccctcacctctcaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtaggaagaagagacatccagatcctggatgtccaagaccatattttgacttaggctaggagaagaagggtacaggttttctgtgtggatatgtgtgtccacagaccaggcatgcccttgtaaatgtgtgacccagggtgagggaggcagggaaggaatatcaaggctgtggggaaagcagagtagatgcattctgctcctcgaattaagaagagagagtccatcaaaaacgtggtggggtgaagaaaagtgagcatgatttaataccacctcttcactcattctcttctctctcctcaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctaggtaggtcactagcccaggaagcctatagactttattaaaaactccaacttctgggaaatgaaggcaatcaaatcagaaagggatgggatcagttactcctggaatggtgatgccctcttgggaagaatagagacagaagcattgctcattaacccagggcttagggccccacactgagtcatgcattcagagtcattacgttgactgccatggaggggcactcctccaaagtcttccctcggtgtccagatggagtcctgctggacacgctgtgcaagcttatacccttgaaactcacatagttccctgaggtaatgggcctgagcagtaggcactcacttggctgtgtttcctttgcagatggcttggtgtcttacaatgctccagctgggcagcagtttgtactccctggaggttccatcatttatctgaatgattctgtctatgatggagctgttggatacaggtaaatcctgggaaactttattagaatgggaaattggccactaagaaagaataatattttatcatgtcttgggatcaataatcaatcaaccaatcagtatttatttagttcttgtacaaggcatttggaaataatttagatgaaggaatacacatgacctttatttccagggaacttaaagcccggtttgggaagacaagttaattacccagaaaacaatcaattacacaaagtaatggctaaagtttgtgatatggctctaagtataatagccatatttttgaccctcaaaacaggacatgtagtctgacacaaatattgacctacttatggaaacaaagggccagagaattgaagtaataagtataatactctgggcaagtcaagaagtcagaaagaatagaccttatacatataaatgctttgaaatttgtaaaaaggggactagtaagacttacaatagacaaggaaagttctaggttaagatgagaattgtagcagaggaaggtaggtagaaggtagcagaagaaaggaagcagggctgaaggcaagactgacctggctatagtagaagctggagttgagaagaacagaatggaacaatggataagcctgaagtggatcaaaggagtgccatggcaaagaagtgtgaccagatatagtaggaacttagggttgggtacaggatgctcccacctatactgtttcacttcaagcctttaagccttgccattcttctagcccacactaacacttttctctctaagcttggtctgcatctgcaaagtgagcctgggagagaattcagtccatcgtgaagaccagaccagatgatggaggttgacagggctcgagagaaggagatactagtgagtctcaggaagggagtgtggaattacagccttctactggcttaggtgtggagaatgaactattgccctctagctgccatcccctgggtgaagacctgattcatccactcttctactcctagtcacttcctttccatcttcttaatcactgttctttcctttttgcttaaacggtcttggcataatttcgctcagtcacaccccaacaggcatgtattcaaggcacagaggaaatcagagatcaaccgaattcagtttaatttaataagcctttgttaatcaactgttactatatacaaggaatttggccaggcatgttaggtattcaaaggtaatggagtcattgatcctacctttaaagtgctcacaatttggagtaggggctaaaacagaatataagttactatgattcaagtatatgagcaagagatagcctatgactgctctggggttcaaaggaaaaagtaaactatagtaggaaagcacaaaaatggggatgaaaacatctggatttcatataataaaagttacttctgtttgctacaaggcttaagggattaaaatgtgtgtgaaaagcatttcgtaagataaattgctatgcacatataagttgttatctgattatcatttttctgactgaaggaccagtaaagatatggtagaacagatgaaatctgaactgggtcccaaagaatgggtagtactttcacaggtgcagaatcttgaaatggaattttaggcagagggaataatagcatgaggaaaaaagaatcatggttataaagtttaggggactgtctgggagaaatcaacagtttatttaaccacgggccatatttatgtggcaaagtagtgcaggagaagcaaaacaaagcagattatgccatattttgaaggaacctgaagtcaaagccaaaaggagcaagaagtggaggaggaggaagaggagaaattgctgttcttattcttcataaacattatcattaatgtaatgagtcattgaagatttttaaagctgaggaaggacatgattggagctgtgctttagacagattaatcaagcagcatgcaaaggttagattggaatggaatgaggaggctatgaggaacattttaaaactcttagttctgccaagtaaaaagaattaatgaccaaggccataaccgtgactgtggggaatgaggaaaagatattcatttaggatgtttgaaatctgattggatgtatgaggcaaaacagtagggtgagaaaaagggtcagatgaagtttgacagtctaagtgactgaaacaatggggatgacatttatttattcgacaaatatattttgagtgcttaccttgcgccaagcattttccattactatgaagagaagtataatttatggaaaagggaaaccaaggagaaagacttagttcagtaggggatgatgatggatttagtttggagtgtaggtctgtgagactgagaagacattcagtagagaaataaggaaggtagccggaattatggctcttaactccaggggaaagataaaaaaaattacaaaaatgtagacatcattggctttcatttaataattgaagtaatgaaatatctggtggaggtggctgagtgaagagatcctctcagccactgagagatgacatcagagtctcaggaaatagtcatattagcaaaagttactttttaaatttaaaacaatttcaagaataatatatgcttactggtgattttaataactctaaagtatataaatattgaacatttattttcttatcccttcttcacttgatttaattttgaccaagggggaactgaacaggcattccttttaatttctgttgcttttcataaaactttcctgggatttatttttctgaggataatgggaaatatatttattgcaagtaaacttacgttctcctagctttctgatctgtagagagaagaaaaagatggcaaaaccttggaagggagatccaggctctggtcactgtggataaggccagtcaaattttataatttaccaaacattttcaatgattaaatatattttaaaaggctggcataatcacccttagtatttttttattttttgcgattcacaaattttacatattattgatctagctctaaacctcaagggtcacaccaattattgcttgagggtgagtatcccaatctcgtcatttgggaaatttgtgtcatatctgccagagcttgagatgcagagcttgaggaaagagaagttccacatgatggtttttgctctgtccctccataaaaagaaggaaggagcctcttcgtgttctctaagtagtcaaataagcatacatgcagttatattccatccagcagtcaggcttctggaaaactcagcctttaaaacagagcctcttactcagaagtcaaaaaagcctgctaagctagaacacaaaactaaatccaatacctgggattctcatgaaatccttgcatcttacttcctgggtctagtatcctacaaatttaattagaattaaatagaaattattatttaaatttagagcttgtattttcccccttagtttaatatcaaactgggttgttggatatgtggaatagaagagagtgtgactggattctctgaaattgattcactgaacaatgacaatatgtagttaaaggagagtcagcaccaagctctggaaacatttatatgatagtggggcaagtgctactatgtatggtagcattcattctatgcatttatccatttcctcatttactctatgaattagttcatcaaatgcatttgataatattaagtcattatgtgaagacatattcagtatataagaataggcaaggtgcaataaattatagaaagcttttcatattaaataagacattgtttaaaagttttactactaaaggagtaagcatcaaatattttataaaaattactaatatgaaattcttagttctccattgatgcaagataaacgagtcaatactataatgcaaatctgattatttacaatccttcaattccaagataataagctcatacaaaatctggagtgaagatgccgggtaaaagctcttccacgaatgtgtggttaactcagatttctctctccttttcctcctcttctcctggcctgagcagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtcagtggggtcgggtgtggtggaacttctttaaggaggcacaaatcatagtgtggtagagaaaaggcatgctagaaaaaagtctaggctgatgccagttcaatgacatattctgttactaactagctaaatgcatttcacaagtcacttcatctctaagggcgtgattctccatttgtgtgtaagggagttagaataggtcagtgagctctcttttttttgttgttttgacactaaaggtgacatatccattaagccaataacacagtgtccagggcccacagatttttaagacgcataaaaatgctctaatttcttttaatatcaggtgaaaaaaataaatttttagggtcaaagattatctttttaccagcacagttgtgtgtgtgtgtgtgtgtgtgtatacacacacaactatatatatatacacaatgatatatatatatacacaactacatatatataaccatatatacatatacaactatatatatacatatacaactatatatgtatatacatatacaactatatatatgtatatacatatacaactagatatatgtatatacatatacaactagatatatgtatatacatatacaactagatatatgtatatacatatacaactagatatatatatgtagttggtgttctgcagtcttctgaatttttccttctaggaacctcacagtggcagtgatagttggtcaggccttataaaacctgggctgcaaccctggttacctgtatgcactgtctgcccttggccacctcacttcatgttgctggactgcagttttctcatctgttaaatgaggactgcaccagcatcttctcagcccttccttgccttgaactctctcgagtctataatcctctcagccgcagttgccgtctaccctgattcgtgtgtgtatctatacacatagatacatacacacatatgtgagaatatgtgtattctcatttagaaatgagatttctaaaaaaaaaaatgaaattgttttagattgtacactattttgggtttctcacctagccctgtgaaaagaagaagactggctctgaaatgtacctaggaggaagcaggatggcagtcttcctcttacctcagttcagaatagctcgaatcagggtagacggcaactactgagttggctggcactgtgtctccatgcaccttagcagggccaacctatcactcacatgcctctttctctaccaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcaggtagggagctcaggtcctctttgggaagtgggagcaaggtgatgaaggaggaatgcacatgcccagaacttctcattagcaggtctctgagaggagtgggattgtacaggcagcttctcattgacggatacggtgaatcctttgtgtgactagttttaactgtggaggggatgggatgagaatggaagtgaacaaaatatgcacgtaactcttcttagaaagaatgtttttaaatgagagtacagtgtgttaaaaattttatataatttaaggtagttaacgagtgcgctgttaaggaaaagcacacctaagcattactgagatatttaaatgaaaatttctaaatatacacaaaagtaaagagaacaataaaccactcatcactcagctttactaatcattgatattttgccatatttgtttcacccattccttccttttggctgtagcattttaaagcaaatatgagatactacttgatttcattagcaaataattggactgcatctaagaaaatagcatcattttcataggtataatgccatgataacatctaacaacctttattattaaataatttcttaataccacccaatatcctgtccatattcaagtatgactaactgtccatcaatgtcttaattcagttgactttatcaaataaggatcaaaataaggatctgttggtgagtttctttattctatttgctctgtgtctcttttaatctaaaaaattccttccatttttatttctttttaaatggattctggcttggctgatggctttctgtggtgtcattttacttgagcttctgttctctgtcattcctaatgactggtgcttacatctacaggttaatttgattccagttcaatatttatttttgtcaagaattctttataagcattctatatatctcagtaatgctgtatattttatgctgaacttcatcatggggatgtaatgctagatcctctcactttttgtgatactaagattgatttctggttcctcatgaactttttccctaagttttatcctccatcaataaccactgtctgaattatttatttcactagggttgctaaatgacgattttctaattcttttattttttctgcatttcttagctgaatttcttccgaatagagtaactattcttcatcatgcaccagtttactcagaaatcacattgaaagagcagcatacgtgacttatcttcccctttaattgttaattttcagagtaatgacttgataccgtagcaaccctcaataatgtctaattaattttggtttttacccttatttttttggtatcattataaactcattgctttttatcaatttaatgcttaatcgattgcagttattattattagtagtagtatgtttatttttagacagagtctcgctctgtcacccaggctggaatgcagtggtgtgatcttggctcactgcaacccccgcctcccgggatcgagtgattcttctgcctcagcctcccaagtagctgggattacaggtgcctgccactgcgcctggctagtttttctatgtttagtagagatagggtttcgccatgttggccaggctggtctcgaactcctgacctcaagtgatccgcctgccttggcctcccaaagtgctgggattacaggcatgagccaccgtgtctggccattattctttttaatactcaagttgtgctgtctttgactagagtttgcatttttttttttttgagacggtatcttgctctgttgcccaggctggagtactatcttgagtcattgcaacctccacctcccaggttcaagtgattctcctgcctcagcttcccaaatagctgggattacaggtgcctgctaccacgcccggcttttttttttttttttttttttttttttttttttgcatttttagtaaagacggggtttcaccatgctggccaggctggtctcgaactcccaacctcaggcgatccagccgcctaggcctcccaaagtgctgggattacagatgtgagccactgcacccagcctagagtttgcatttttaagggggctctttgctcttttgatctgaccctagaagcctttgataactttcttgttttccgaaagaacaaggtatttcaagctcattttgaacatgtacagcacccgacgtggaatcaaccatttcaagaaatcttgattccttttagtaggaaatggtatttagaaaacacaaactgggtagtagggatgctcattactaataggttgtcattgtttcttggatttttcggtggaagaaagcaatgaaatatgtatatttaaaaagaaagattgtgagtttacattgttacttccaattcaaattaaagataaggtttttatttaaagttgattttatacgttcatctctattatttatgctaaatatcatgtttcctaacaatgttaacagcattttcttcatcctattattcaaaaagcaataccaatattattactagcaacgtaactattgaacattaagatttcttagcaattctcttttctttgtcctgagaatatatcctactaagaatgtgcagtcaaagcactatgttctaaggtcagttgggtaacagtgggataattcttttctgtatatagttatatcaccagtgtggtatacagttagggtaacagtgggataattcttttctgtatgtagttatgtcaccaatgtgatatacagttaggttcattgtattccatttgtttcaacctttagggattccttttaaactttaaacactacttttgattgaacagtaactgcagcaaatagtgatttaacttactacagccagaaactgtgccaaatcttgaaaagttaaaaggtgtttagaacattgttcataccattaaatttaaatgggaagatgaaagatacagaatgctttaaaaaaaaaaaaaaaaaaagaaatgtccaaagcaatatgaacaataaatggtcaggaggagagaggcactagcgtgggtttgtcatagacagcatcaaaggaatgagacttgtactgggcctggaagaaaagtccaggtgtaaaataacataaaagagaggaagagactaatttaaagataaaccacactttgggaggccaaggcaggaggattgcttgtattcaagagtttgagactagcctaggcaacatggcgaaatcctgtctctataaaaaacacaaaaattagctgggtgtggtggcacgtgcttgcagtcccagctacttgggaggctgaggtgggaggatcacctgagccctggaggcagagcttgcagtgggtcgagattgcaccactgcactccagcctgggtgacagagtgagaccctgtttaaaaaaaaaaaaaaagaaagaaaagaaaaataaatcagaagaacccatcctttcagatttgatttttaagggaaaaaaatttcaagatggtttgcttattaagatgtactgataagaaaatagagcatatttttaggaaaacaggtttggtgtttaaatgccttctgtgctaatgatttaatctaagagtaagttgattgattgtttcatctgaatactgagagtagaaatcaagatgctcaaagtcagtgccacttacactgtaagtgttaactgggggacaaatagattcccacccatcctcagggattctcctggcatagtaactggtacacttattatagctaattatagctatgaaccatggtttttactcctggggtctcttgagctttaaatccaatgcataataatattagttttcaccggagcctgacagccgaactccgaaagcacatgcagaggccagatacctccttatttatataataatattaagaagaagaaaaattaggatacctggaagaaatgtctcttagaaaggaaatacatattctaattcttgacccccttgattagacaaatcagagggaaaaactctggcaaagctgccaacatcaatctggcaaatacgcttttgtggtttagtctcaaaagctgtaaaatcacagaaaaagacactccaatgtcagtaaatatctataaagattaagccttaattcataaattgaagggctaggccgatgaggcatagtggagactcttttataaacaatctaatatccttgaaggaaaaagcatcttaacactatgtctgtcccttgcccatttacccgctatattctgtctatattttcactgaatttgggtcctgcttcttatgctttatgacaatgtgtggtacagccctttgaatcactgtttcttaaacttttttgtaccatagcatctagtatgtaatatgtgaaacaaaaattttacaaaggaaaacttgcttttactatttagataaatggtgattttttattcaacgtatttatgattttatctttttaaaagactgatgacaactcactaaattgatcttgtaatgtgctaggtcacaatatgccttcagagaaaacactagctgtctgtcttctccctggctctgactcacccttgttttataacagatgctgcaatgtacaacaactctgaagccctgcccacctctcctatggcacccacaacctatggtatatgtgattcctaattacacaaattaatttgaagggacttactgggggatgaagaagggtggagagttgcaaagccctggctgtgtgggaggctttacaccagttggctttggatgaagagtagccctggaaaggtaggactgtctacctccaagttatggatccaaatatactctcttcactatggattcatgtgcttcttcagctgaggcagagtctggagttgtcctaatttctccatgaaagtttgggaatttggggtcagaaacagggaaagggacattcctgggtcagacccatagtgggtatttctaaggaggggtggaaatcaaagaaacaaaatgctgatatctccaattggagataaatatgccatgtatgcattgctttaggcagtcattggtgacactagccagcaatgtgggaaacatgtgggattgaatgtgtccaaagaggactttcagctaccttggcatgtctcaaagaatgcagagagtgaaactggttcctcacctgtttttcatgaggtgtgattaagggactacagactcaggccataataatacagagacaaaattttgggaagaatagaaaaactcaccattactctgtctgacacatggagagggggagactactgtcttatggaagagggaaataggataggggaacaaagtaataaacagattgggcgtggtggctcacacctgtaatcccagcactttgggaggcagaggcaggcagatcatgaggtcaggagttcgagaccagactggccaacatggagaaaccccatctctactaaagatacaaaaattagccgggcgtagtggcgcatgcctgtaatcccagctactcaggaggctgaggcagaattgcttgaacctgggagggggaggtttcagtgagccaagatcatgccattgcactccatcctgagggacagaacaagactctatctcaggaaaaaaaaaaagtaataaaacagtagcaagaaaacaaaacagtagcaagagcaagaataagcagaagtattaaggtggcatcttccataattatcctcaaggaacagggtctacctccatgtttccagttcagtccctcatacttttacttgacctgtgagatgattgtattctctgccttctctccctggtcacagatccaatgcttaaagttgatgacagcaacactcggatcctgattggctgcttggtggccatcatctttatcctcctggccatcattgtcatcatcctctggaggcagttctggcagaaaatgctggagaaggtgaggaggtgcagaatggtcatgatataagaaactgctcctttctttcttaagccactgttgtcccaggagtaaaaggcaaattgcaaacatttattaatggttggaattaactgaggctaccaagaaacataggaatgaagccagaatagaattagctaagtctattttctcatttttagagtggagatgttggaaccttcctaacgttcctcggaaatgcagaaaactcttcttaatacattgaatctccattcaggcattttccttgaagattctgattcactggattttgggtagagtccaggcatccatatttaaaaaaaaatttaacaagtgcttctgatgcacattcgaggttaagaattactctcctaatgccaagctgaaatttctgataatgctgttgaagttccttctcatctttttcactttgcttgtctgtttggtgtgtgtgtgtgtgtgtgtgtgtgtagaaaaacatccagcttcattaatattcaagccaagtttctcactattctatttctacttttgtgtacttgaaggttgtgattatgtatccctctgagtccctcttcagactctgtctatgccaaatgatctgaataactttttacattgtctaacactttacaggaagcagaatttttcctcatgcataattttatatacacctcattgagtaataactcataggcattgttatgtttaactatttttctgatgagaaaatgtgatgtgcttaaggtcatacaactgatgtccagtcttctatgctttttccaattgttaatattgaaatgcattgatttctttcttcaaaactatattcatttcatcaaagatggaatatctatgacttgtcttggtttcttggaccaaatagcaactcccttggaccaaatagcaactcactgctgcttagtgtctgattcttttggggcctgctgacgactaagtgtttctgcctttggccatgatcacctctcctggtcaattagttcctctcaatagacatggactagtagaggccacaggaactctgagctgtggggctttgaactgcctcctgagggcagggaataggaaggaggagaaatcctgattgatttctgtgtttgggggtggggactcagaggagaccaatgcctgtgtggaacctctattccagaggagaggaaagggcaccatgagaatgggcttgagtctctagagctttctagatgcaggatgggagaaaaatggctcaaatcaggggtaaggaggagcaatcctgatgagtagcctgcaattccttctgatctgtgccaccctcaggttcctgagatggttgatgtttgttttaaggtttttaggaaggaatatttcatggaagagaaggtctccttgcttcccacaagtatgtctaccagtctgaaaacacttaaagctttcaattcgcaaatagcaacagaagactgaaatacagaatccacagagactcactcgctgtcacgagtatgtctcaaggcatgaatgaggcaaatatcaaaatttttcctcctttagaatgctggaaaacactagtgtttaatgaggtattccagagtgagggtggtggtgaactgaaggttcattgaactgcttgaagaggatatgtgaccttcttaaatagtctgttaggaccacattttagccaagggggaaagtctgtgttctctgctatatgagctctttttctctttatttgagccacaatttaccatacttctctgagtctttattctgaggcctgttggaatatcttcatgggctaagagagaaatgttggaatctccaggtaaaaggtagagcaaacattttgcccttgaatatttaacttggtcctccaagaaattctacccctgtacatcctgagtaagatgactcaaggtgctctggaatgacacccagtgtttcttcctgggaacaaaattttatgtggaaaatcattaagtacacacatacattctaagaacattacttaacatagctgtagactgtatgtagcattatttgtaggataattttggtggtgtcctcaacattccttctttgagagatttaacccacatatattgagtacctactttgttctgagcttcatgcttagtactggggatattactgcaacaaaagaccttcagtctagtggaaaagtgcacatctaagtttcgccattgagcaccaaagctgtgtttgttggagtggagcattttacatgtttaaacccaaatagtcacatacatgcaaatgctggcatttgccttttgatggagcaggcaggttatattagataagataccacagaagtagttgctttgttgttctccctcccttattaggtgtaagtcacattgttatctctggacacccagggctttcctgtcccatgttgtagccattttatttttggttagtgaaaatatgggtcagtggtgggtattatcctaatctagggtatcaaaatgatcaagtagaactactgattcatcatgttatagcacatgcattaagttaataaacaatttatgtctattccaaaaccaagtagttaaagggtaagccaggaaaacccatcatttaataaaacatagaaaactctataagattgagatctttggctactgatgggttcttatagcaacagggagataatcttttttttttaagtgtttcagaaagcacatcatagaaattagaagatcaaattctaccttgaagaaatgaaggattattctaagttcctacaacacaggcatttgtggaaccagactgcattcctagcacgtgcagtgttgctggggttaaacagtagtaaagagttatttcatttgagtgggagagctgagtttaagaagaggaggcattgaccatctcttttgtgccaacatgcctttctccttgctcttctcttccaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggtgaggatgatgtggtgggcagggtgtcaagggagaaacctcagcaagcatcaggtaggtatgacacgcctgctcccagttcattgcatctatttttagtctctgctaacctcctgagaagtccacattctctttctagatttggtctgccgctgctcctggcctaatttgagcaactctcctttgctactgaatataagatgtgtggagggacccacataccagaaaagaaagaaaaaaataataaaacatgtgaattaggtgttgacaccagaagaacctaaacagtccaaccagtctaacctcattttacatgtcgggaaagtgagaaagtccagatagagtactcacccaacaccaaatttcatgagtgggtaaaggcaggactagatttttacctggagaaataaataaataaatgaagctaaagacattccaaaattcccagtggtgtagccatttaaataactaaaataaataactacttgagttatctattttttgtgaatttctctttggtaaacgtttattagagtaatatgagattttattatgagagtaaaacatttctcaccttttctcaataaaagcattgaaataaaacaataaaacaggtaaaacagtaagtagtgtcagttgattcaaatttcgatgtctttcaaaaaatgatgcagagtcatatcagaagggaagctggagtcacctctttagctcagagcaacttttctataagatcatcaacctgagggacccgagtcagtagaaaagaacttgtagtgttcaggagagaggagctaggcctgagctggatgtagaagcagacaggactaaattcaagagcataggattttataggaaggagcctgaaggggtcttttcaaaggataaaaggaaacttgcatctattttattattcaatggatagaagacatgaaagagcatgctaaattcaagtaatttcacagagacagcaagaataaaggatataaactaatttatttcttggggtgaatggaagtaatttacctatttcctaagtctaaaacatcccccacttcatattttaaggcttttttaagttagaatatgtcttaagctagatcatatgtctttaatctgaaagttttttatacctaaaatcagtttttaagtcaataacagtgtcttaaaattaaggaaataagttattaaaccttcaacctttaatattcccaccctgatataccatgagccttcctatagcttcaccacacaattccacaagtttagccacagaatttgttaatgatcatgtattatgaggaaaagaatgagaaataaaatgatgttctacattctgtaggccacaagaaaatctctagaggaagcaaaaccattttccaagtaagaatgtcatgaagcaggttaggctttcacaggggcatgttttagccctcctctcagagttccttcctgaagagatctccaaagacactccacggaatgagggctcgttgcccttgtcttcccaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggtgagttgattctttgattcccttatagctcgaagaaggtggttggataaaaatgatcagtagaacaaagagtcccttccagaggtggattcacaacagaatgtctcttccatttgtctctccttgcattgtcctctggatttcagtattgggtcaacctaatctttgtcaaatagctgtggagttcctgggacttctgatttctatataggagtttttaaggcaggcaagtcactagacttcagatatcttgaaaaacattcaatattttcaaaaatgtttacaatagattatggagggtgggatccagaagatgtgatcatcttttatgaactgtccaggaacattctgctactcaatagccactttgtttttttcccctttaatgggagttatatgtaaaatggtcaaaaacaacctcgcccctgcctttggtcccagaatcagccactagggaatgaatcaccaactaagataaggaggagtactcttttcatttgccctcagagtgatgcatgcattattaaacttttcattcttgcatcagtcacatgaaccttctgggagctcaaagcaatgttttgaattctaataggaactcttcaccactgccgtctaaactccaaataaaacatttggtttcctaagacatgttattggttttcagtgtggatctcatgttctctccttagataggtctggtgttgcaagaggttgagggacccatgttatctgttcatggtgtgacatgtactcattctgtcccctgggttgaaaacccacatctgttatactgttactaatagacaggagtttcttataatgctaaaccctatactaagggattattttaggaaattgccttacgttttacatgatccagtgactaatgaatcgaagttcaagcatttgtaataaaagacattttatattgggctatgctgtaatataatattgttattgattcattcattcacttagtgttccaagcaatgtgtatttctaaggcaggagagtggcacattagctgggtactttaccattgttttaaatcttatcaattatttgaatcatagatatgttacacatatcttcttattggtcttttgatcattttgcctgagttgtaagagttagtttatctccaggaaatgcccagcaagagtactgagacatcttcaggagaaatgatgatgctgagactagatgacttttgtctaggttcatctctgtgaagtggagggaatggaaaaattcaaagacaaagattttgccctagatgtcagtgccaaccagcctgtcctggtggctgtgaaaatgctccgagcagatgccaacaagaatgccaggtctgtggtctacattttgaattttcctttaggtatttcatctttaggaccaggaatactcctggatacttctgagcaattttttcttttgagatgggaaggtcagtgagctgcctcccatttccactgttatcctttttcttattccgatggggtcggcagtcctcatctttttctccacctctctcaaacacaaaggtacattttccattgtacttgccacatatttacttcctaaccccctgtgcacaagcactgtacttgttcccaacatatacaactgtctaaatgtgtacttctttggtctttatacacagacatactcctgcatgtcattacctcctcttgacaaagtcttcagaatcacacatgactttcttgctaagcctcttccagtctccttttttcacatttctatttattttctcatcccttttttctcttttatgctccttttcttctatttgagcaaccctcaaaatgagaagctacctctatttggaaaattatctatgaacctcaaagcaaaaggatccacagttctctagcagttttccaaactggctaataatctcttggatctttttctacataaattgcagtttccagccacacttcattgtctgacagcctttccattacaataatggtgagttaatcctcacccagagagacaagctggttgaaagctggctgtatgtgtcccagagaaatctccacacctggataacatatgcattttcccatttgtgttgtcttgatttgtctcactgatattcatagtgaaaaaaagtttattattcttattttccaaattatcataaattccaagaatggtgatagacttcattaaaagtcttgcaatggacaagatgtaagataaagaagagagaaaggtgaggaaatgaaactggaggctttagaaatttaactgataatttcaatctttaagatactggtaagaataaaaagtgacattctctgggtcttatagagagacgaagtatttcttatattaatcttagcacatgattggagaaagtggcatgaggggaaacaaaaccaaaccaaaccacaggacataggatatgacaaagcctttctccgttgttccgatcggtgaagtttgccattcctccacctgtgtccttagcaatgatggatggccatgactgcaaaccctcccaagccatggaaacccctggtttgagacggaagggggaatgaaagaggggaggtgttgcatcaggacggcattgattccagtggtttatattgacgtagtatgacttccagtccaggattcctagcaaactcttggagggcttataactcatctgctccaacagttttgggaatgtgggctagaggcctcactaacaaaatcttgctactttatgacccaagggtgtctgtcaccatgtactcaaacaattattagtcttggtcaaatgaatacttcttttgacatgattaccaccacagcctttaaagagctctgttttcgacaggctactaaatacatgttgcaactgactgatggttcgtactgcattaagaaaagtcagtatgagaaaataaagagtaatcagataagccaaagatggttgttcacatcatacaaagtttcttcactagtaatagagtgactccatggctttaaaaaaaaaaaggtaaatatcctcgtgcacttaagatatgattttcagtgaaacattttactctgtagagtggtttttagcagcctatttttgattcagcaaatattaatcactttctgtgtggcagggattttgttagatgtgagggatagaaatgtgaataagtcatggatcttgttctcaaaaacattacaattgaataagggcccatgatatttcaggaggaatagaatgagacagatccaggtgtcaatttctctgtcctctcaaaagttatccaaagggaaacaagatttggcataatgtccaggaataggccttggtgtgcattcttctctctcttgattctgactctggcaacttctgagtttatctatgtctgtatcctcccaaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcaggtaaacaagccaggtcttccttctcctccctgtggtcatgagagtaacctgggatctgaaaatagggagcagtgagccttaaagtgtatcaatgttctgggatggtgggggaagtcagtgtgcagggaataatggagcagctgccctttggggaaacgcaagggattcatcaagagtagagaaagaatgttgagctttcaaccctagtttgttgataccattttagaatgtgtacctttcacatcttcctgtttccataggctaccttctgtcttcttgtctatttcctcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctggtaagttctcagcattttaaagccctgtctaacaactggcttgtgggctcacatgcatgacacgtggagacaaacctgagacagcaggaggcaaactcaatagactgtagtattttctctgatttgaaattattttctttgtgtactaattcttattatttaatgcttgcctatttctgctaaaaaattaacacacataaaaatttagggagagaagttaaaaagtataagagatttattatctttgtttctctttatcatttctacctagtgattgttcttaatttaagatattaaaaaccttatcatttaaagaaatgttacctatacaaaatattttcttctccattagtttcataagcatgtttctcataattacatagactaattcctataattgtatttcaatacttttcaacatgttctttttaagttcatcattctttgctttataatttttatttgattcttgatattccataccataagtgagtaatttttcccaaatatctctattagaggtatattttctgtccatgcatacctgagactttttattgttgattttataaccactcagctgatttatagactcattagactatacacttttacttcctacaatgccatgtacatgttattttatcttttttcttgtgtgacattgcagagaaaagtctgagaccaatttggttttgttcatttatgattaatctgcttatttcctgctaatattcttataggatttgtaaattaattttgaaataaaaaatgtatagttattcccttgcactcaccaggataaccactatcaatactttggtatattttcttagaggatttttttctatacatatattttttctatgcatgcaattttttttctgtgcatgcatttatatacatatgtacatatatgtaatttatattacataattgggatgacactatgccatacaattctctatctctatttttaacttaacattttattatctgcataatattccatgtgtagatatatactataacttaataatgcctctataatttgatatttaagtactttccaatttcctgctattatgaatgatgctgtgatgtacaccagtttacataaatccttataaagatctttttcacctatatatgtgaattgctatattttacccatttctaatgggatagttaggcattactctccctaaaggtattatatggtgttcaaaacaatatattagactgacattcagaggaccttggttcaaatccagtttttccactactaatggtcttattaaccagaagaatttgggaaacctctcctgtttcatttttctgatctaaaaaataaggataactggcatggtggtatgtacctgtagtcccagctactcaggaggctgaggcaggaggatgaaaatctgggctgcgctgcgctatgacaattgggtgtcctcactaagtctggcattaatatggtcacccctaggagcagtggaccaccaggttgcctaaagagggatgagccagcccaggtcagaaacagaggaggtcaaaactcccgtgttgatcagtaatgagatcaaacgtgtgactggccattgcactccaggctgggcaacataatgagaccccatttctcaaaggaaaaaatatttaataataaataatatcatccacttcacagtgtggttgtctgtattgagtagaaaatgtgagtagtcaatgcatgctatttacacctgaatctcattgctgtcacttgttaaagtctatctttcaacactgtgattatcactgaactggtaaatgagagtcctggattcactgcaggcacttaaactagattcctctatctctaacataaaaaccattgacttcccattcagattttgcctttctcaggagcattttcccaaggctaccctagagttgaaaggttgacctaacactcagttgcagagtcaaatagcttatggctgcgtttttttcagctcttggatctcatccccagagaaacagaaccaagctgagatcatgagaatgaaagaatgggctgtttctaaatactccatgcacatcttggcattttcagaattccttgcctgtggtgggggaaggggtatagctgcagattatgaaatttaacagggtgttgttgtgcacaggttattctgatttcccattcttttctttacttaaatagggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcaggtaagaactgttggggatgaatggatgtggacctgtgtaccttgaaggatggagaatggcaagtcctgccttagcaggagtgggccgagatggaagacagactatccaggtgttagtctttgtcactaactatccagatgatgtgaaagaccagtatcctccccaggcatccatacactttgctttatctatgtgtcaactcattgactcttggagagcataaagggtcatgtcaggtttctccccagctcaaaggtagcaggaaacaaagtcctatctctcatgatttatctatttcttgatctagaccatgtggtttttcttctgggtcaaaaaataaaagtgtaaaagggatgtattagcattcattaaaaatatagcttagtataagaaatggggttggttttgactatctagcaatgtttctagacttggatgtctgaaaatgggcagatatatcctaaacttgttgctcttggaaggcatctctgggcccagtattgtgacatctcaggactcagggaaagatgagttcccaagctccccaggagtctcaattcctagccaagatactccaagcttttttttgggtggcttagatttaaaattcctgtgagatctggaatttaaagcttgccagtaactacagcaccgcacttccccaaaggggcctggcaacagcatacccttggattatggtatctttaccaggaaaaggataatagctgggggaaggatcttgcagacaataaaaagtggatcttctgtggcttgaacagatccaagcaagccaaagatagataaggtattgacaagagataatacattatgcatattaaaaataagagaggggtctgagaatttaattgtatcttgatactctgtaaatattttggcagcagggagtctaaattagctatcttggttatgaggcaatttgccttcttactatagtcaaaggaaaatttactcctgagtacatgagataagtgagtgggccaaagaaaaatgttgttttctgcctctgccatgatcggctcagccaagatgaacttcaatatgggttgcccataaatggaagatttggtctctttttggttgtttcatcttttgcatgaaggtagggaccacataatggcccatcaaaaaattctgctgcagacaactgcagaagacaaatggaacagcttagaaaagggctgatatgattcagaactttcacgagtaggaaaaatggacactacacccatttcagttatcaagttcaagaaagtgggcagggggcaaatcaaaccatgatgcaaagatacttccctttcccccgtctttgtaatattctctctctctctctcttttgttttcctttatttttgttcccaaagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatacacttttttttttttttacattaaagaa

SEQ ID NO: 36721 - DNA, 9793 bp, Homo sapiens
aagacgtgcagcctgggccgtggctgtcactgcgttcggacccagacccgctgcaggcagcagcagcccccgcccgcgcagcagcatggagctctggggggcctacctcctcctctgcctcttctccctcctgacccaggtcaccaccgagccaccaacccagaagcccaagaagattgtaaatgccaagaaaggtaaggagggggacagagccctgtgccatcttccagggagcaggtccccctctccttagtgtgtcctcatgctcctttccttcattttcctccttttgagtcatctagggaacttgagtaaagtgggctttggggcttgggggagttctctcatagcagagttggttgtcagaatcataagaatccctgacccttagagttgggaagaaccttccagatcatccaaactgatctttgctcttctctcctcccctcatccccaatattttaaagaaaccaaacctttggcctgggagtctggcagcgctcagcccttaccagggagagctgcacaggctgggctttggagtcttccaacctgttttctcaactgtaaaatggggacagtggtatttgttcaaagacttctcatgaagattttatgatacaaaatatataaaggcacctcacttgttgcttgatgcacagggaaaagaaaaagaagaagaaatgaattctcatttctgtagcatatcacagccttcaggaaataaatgtaactcagactagtccaccagaagcagctttgctctgctttgtagcctctggggattggggtgtccctcggttgctttggctacagcaagacttgcccttgcagccccgcctgcagtgaggtcaccccaggctgtgttgagacaacatcagtggaatgtcatggcaatggacggggctgtcacccccccagggagcagaggctagaagagagtccaaggggatgagggtggggactgaggcagagaaacaagcagctaggaccaagggcacagaaaaggaaagaaggggctgtgggggcctcccttaggccctcccggggctcttcataaatggacagttgcccactggccaggaactagtgcagtgcataaagggacatcggggccatggggcctcacaacactgtgacaaagaatggggcaaatctggctgctgataaaaaaatcatcttcaagattcagtttacaaagtgaaaaaagaaacattcaaaagagaatgagtatgatgctgacatttgctttgaaaaagggatttatataataatacatttttacttgtatgtgcataagttctttctggaaggatccacaagagtgagtaacagtgattacctctgggaagaaaaaccaggggctgggcgcagtctcaactgggaaagaaaccagctttttgaactgtttggattttaaaaaattatgtgtgtatattaccttccacaaaatgttcatttaaaaagagaagacaataccgtgcatagttacgtctatgagcattagccaaaatcgccaccaagggagagcctttgtaaaagatgcagctccaaaggcaaatcatagaatttttgaatgtggaaaaccatcgccagcttctcaagtttaccaaagattcagtattaatataattatgtaaatctttttaaactcatgttaaaaaaaaaagggtcagagcacgtgatgccttggttctctccagctgtcacacttgaaccctggccctatgtggtctccatagaaggggcccctggagttccagggctacaggccaacagaacagccacccaggccctgcctctcgctgaaacccatggcagtctcccgcccaccaacatggcaggcacttatagagctctttctccacgtaggcaccagtctatatgctggacacacagcagagaaacaccgtctctgctcttaagacatgaaccatggtggttctcactcaggcatcaacatcatctgggagatacattagaatccaggtgccttggccaggcgtggtggctcaagcctgtaatctcagcactttaggaggccaaggtgggaggatcgcttgaggccaggagttcaagacaagtctggccaacatggtgaaaccctgtctctactaaaaatacaaaaattagctgagtgtgatggtgtacacgtgtagtcccagctactcaggaggctgaggcaggagaattgcttgaacctgggaggtggaggttgcaatgggccgagattgcaccactgcactccagcctgggtgacagagtaagtgagactccgtctcaaaaataaatcaataaataaaataaaagttaagaattcaggtgcttgggccccacccctggaaatgctggtttagggatcttggtgagtttagcatctgccttttccacaggtcttcagggattcctaggagcagccaggaatgagaatctcaggggcaatctagttgcagggctggtgcccaaaagtacgggagaaagtccaaagaagggacggtcatgccagaggagaccagttggtgccagggccaagagggggagagcaagtggcaggactggcaaaggaagggaatgccagcatatgctaagtccttgtcctggccctcagggtgggtgagaagcggggagcctagagtacttctgggagctcatctgttcttggggccacatggtcacacctggcagggaagctccggagggaaggatggcctcataggagtcacaggcctttagaacagggaactgggggaacctggagggcatccattctaacatcacgcagaaggaacctgaggctcagagagtgggccagcacaaaggcctcctgactctgcccagggccgtagagacacctactcccacagcttcctcaggtggagctaatgagagtagcttcctgtaccttggacagtccctggaggaaactttgcacatatgggcaccttggtgcaaattacaaaaggtacctcctctaaactgacaaattatagaaaggcatctctttttctggtctgacccactctagccagggcaaggcttaggagacaaatgggccttcatgtgtccctcagcagaatgcccttcttcagtgcccccttgcacagcctcacatggcaccctatgctggtacatcacgtgactgggtacagtgctgctataactggtggaggcagtctctgtgtgaggcacacatgacctcaggctggtttgccagccccaaactctccctttttttgccttgctcatcagggtgtttttgctccagtttggtaagttacatcgctaatttctatatacacaaccatgtgtcttgcctgtgattcttctgcaaaggcaccttatgggtggacgaaggctctgatctcactctttgtgagtgtggaatgtatgcagacacagccaaatggaccattaaagtgtttccccacccacttccccaagctgagtgcagcctttcctgaagccctggtgtttcagaaagaccagggtccgccccaggagctctaaacttacacacacatagaaatatgcttcccggcaccctcaacttacacacacatagaaatatgcttccccgccttcccctgctgactcttacatgactggctgccagcaggacagctcctgttaggaatccgtttgtgtgccatggggaaggtggggaagagcatggcttcagagccatgtgcacctgggttccaggccagccctgccagctggggctctgccatcctcggccagttggtttagggcagcctgggtttcctcatggtgaaatgctggtggtacagaatgacacgttacctgtgtcatagggttgattatgagcatcacatggggtgacatgtagaacggcttagcccagagcctggcctcctctgtaagagtggaaaacctgggttccttctgccctcatcttattagtagctgtgatgggcacacactcagccaagcactgaggtaggcagctctgcgtttcagttctcttagtcttctccagagtcctaggaggtggggctgtcatcatccacttcatacatgagggaaccaaatccagagaggctgagcagctcgcccaggccacccgtgtctgtggcacctccaagccctgcatatgcgtgccccaggctggagtgcctgctggtctgtgtcgcattcctccagcctggggaagtgaacctgggggcttcttgagggctcctgctgtgcttcctgtgctgttcttccctggagctgaaaaggtagctgggtggtgggggatcactgaagcctgtgcctacaccctcacccctgcctctgctaatcccagccccatctgatccccagcaacaatcccaaacaaatgcagcacaggagcaagtgaaggatgggccccctggcagaagtcacaagtggttaattagactaccaccagcaaggatagagagagagaaagtttcccaagatatcaaggttgaggggagtcttttcctctcatccctctgcagctaaggtaggatccttcctgctcagtccctgccccaccctgacatatttcctcctgcttcagatgttgtgaacacaaagatgtttgaggagctcaagagccgtctggacaccctggcccaggaggtggccctgctgaaggagcagcaggccctgcagacgggtgagtgcaggcagtagcctctctgggcaggagcgtctgagagaagggcccaggccagcagccagcaatgctcttctcgcctccgttcagcatcagggtcctggctccattagtccaggcctatgggtgaaggcaccaggttcagggagccccacctctttctcttggggagatcccctgacacgtgtctgcaaaactcacctggatgtgtacggccaaatctctggccacagctgggtggtgtggaagtggggatgtcccaagaggacaaaaaattctccaacaagaatccactactgcccaccagaagtgaccctggagcgctcgatggggcagaggtagtggcccaccctagcaaagctcccaggagcccctcactcagctggcctctgcagccccagagagctccacactcctgtgtgtcagcagctttgctgaccctgtctctcttaatcgtaactctgctgaggtgggatttgtcagctccattttaaagatgagctgtcagctccatgaaatgtcagctccattttaaagatgtgtcagcagcaactgaggcatagacaggtcctgaacctggctcatactcacctcgttggttagttgactcgtggaagagcaagagttgaatggaggcaggctgcccagtgccaagctgggccttggtgttcctggctctgcactagccagctgagggagggtgcacagaatcaccaagaacagggcccaggcgcatggtaaggtcatgccctctggccagcatacctggcagcctattgtttctcactccccatgttcctgtcatatagtctgcattttccacatacctccgatttacctacctttatatgacctcaccttccattctatggagaacacagactcacaatactgatgactatttacatgtgagcccactacattctggcactgttcttgatgcttgatgcagactcacaatactgatgactatttacatgtgagcccactacattctggcactgttcttgatgcttgatgcacgttaactcattcacagcacacccgtgcagtggtcctgttactacatcctcacccttattttccaccgagaaggaccttgtgacagccgaaaggagcagagcctcacttagctctgctatgctgcccctcgagttatcagctgggaaatcaccttgactcctcagcaaatctataaaccaccctgtgtccacagccactctcttacctgttgcttttgtgaccaaggcccatccatctgcaaggccttcccttccccgcctgcctcctcagaaacccccaacagccttctcaccggatggttttacacactccctcccattcatatgctttccttcagcattcacactgccatccttctgcactcccaccacagggcctttgcatgtgctgtttgggcaacctgaattgctcccccaagatccacctaataaatgcctccagcattatcttctcaggagtcactaatccctcatctcaatcagctcctcagttataagctctcccagaacagtgtcctttcttttatcacactgactgcagtctgtaatgatacactcatttcctgatttgtgtctgctgcctccactagactatagtaagccctgagaacacaagggccatgtttgcttttcattgcccttgtctcttccactaccctgcccagcatagtgcctgccacatagcaacactcagtcaatctctgttgaaggaaggacaaacatgtaactttggacagcttgcttggcatggcaggtaggaagagagtgctcgagaaagggagcatctccagaggtgtttttgacttcatgtaataggaaacctatcagtggcttaaacaaaaagtaagtctgcaagtaggtagttataagtttttgttcagaagtttcacctcatggtcttcagatggctgccccaactccaggcatcatgagtgcattcaaggcaagaaggaggaagagtagcccaaccacatctgtctcatttatagggaacgtagtcttccacttccatctcattgacaagaaatctatcatatggccacctgcagctttaagaacatctgagaatgcaagaatgtagcttttccagcctctatagtggaggtggacaagagagaagggatttggaggcaacagtgcctggcacagcgggtatgtttagaatgagcccagtgccactctgagcctcagtttcctcatctgtaaggtaggcagggtaaactctaaggtctctctcatgtctaagctctgtgctgtgcaaagtcaatgtaacccaggcatcaactgccacctggggtgaggtaatgaggtggggacctccctgaaaaaagttcatgacatatggaggcccaaagcatgacatatgaaagcccccatgtctgctgatttctaggaagctgctgggcttcttggggccttctcctgttcattgtcctcacaacccaaagatcaccttttcaataaacccacccaaagcattgcagagctctgttgacctaaccagagttgaaggaatcagggggcaacctttccctcctccaaccagcatacacatgggaggttcccacctggtacatctctgccaggcacaaggaggcagaggtgatgcagccagggccctgctccctgggaacctcaatatattcatggaatcacttgagcccttgaaagctgtgtaggaatcagagaagataaagagggttgattccaagcagatggcagggcaggagcagaggtgtggaggactagcataaatcgacaggatcatgaatagaccagagcaacaaaatgttggcagcaatgatagtatcacgagaagtagcattgactgaggactacctatgtgttggagggaggttcaggtgagggtcctaggaagcaactctgagatggagtttaacccacaggagacttatcaggagataccctcaggatcaacccctgtgctagggaagggatggaaggaagcaggagtgggcagaaggagaagtcgagctgtactgtggtgccacgaaagcctcagctgacttcaggagccctgatgacgggatgacccttcggcactgtcctgagtcggggcaagagggcttatgggtcagtcttgggtgtaggctgctctagggaggggcacggccttggaagagatggctgtcttctgctgaggcagtccctgcaggaggctgaaagctgaggactttcttcctgcagcattcctggcagccagggcagtgaatccttcatccccaacaaaagtctaggtagcacgtcagtgttaccagcaggaaggaaaggcaatgaaggccgcttggctaagctgtaggatagcacgaggtaggacagctgacttggggcagagtctgtgggtagacacctctgtaatgcttcaggccccatgtttaaagtcggttgtggtgtcagatgcccatggggacactgggatgctgtccattgatatttgttgagtgaaatggaagtaactgagtgggaatggatagaggggagtgcagacatcccccaaagtggtggggtcaccagcaagaggacaaatgcagacatacacctgtctgtcaagatattcctttccacagaaatctttagtaaaaggtgaacgatttatacgatctcaggagaaatcagagtatgtctagatatttcagctagaaatcaagctgaaaatgcaaactgcaaaacaaaaatagattttatcctcctaacttgaccaaatatgtgccttcatcacaacctttggggccaggctcaaactgagaatttgtggacacctcagagtcccttgcctgatcgccggcctctgaccacagcctgtgcccagcacttcctgtcttctctcttgcagtctcagctctatccactcagccccaccctaccagccctcaggagaactgaccctgcaaaaggcacttggcaggccctggaagcttgcttgggctgtttgggtagggatttggggccctgggtacatgaagtgtggcctaggctgtaggtgggcaggtgccctggccctgcaagctgcttgatcttagggaggggcatggaggaaggagaaccagagcaggtggctgtggctgggctccctgggaagctgactctgagacagagctaatttgttagggtgagccctaggagccacacatgtgggggcggggggaagaggaagtgggcagagggagagctgagctgcagtgcaggcaccaggccagcctctgtgacccaaggagatggggtgggtaaaggccagaaatgactgaggtggaggcctgggaaggggtgtcagctggggctgggtgcttctgtagcacaagggctgccttttctcccagccgcgggagcaccaagacctcctgagtggggatctggatctgtacattagtggccaccacagccaggtcctcaaagtgcatgaaccatcaggaccccttttgcctgggtctaaggggctgtcaggactgatgggataaacgggatgggatggaggacggtgggcttggcctgggcggttggctctttgcctggggaacagggggaccttcggtgacagccatttctccccactcccagtctgcctgaaggggaccaaggtgcacatgaaatgctttctggccttcacccagacgaagaccttccacgaggccagcgaggactgcatctcgcgcgggggcaccctgggcacccctcagactggctcggagaacgacgccctgtatgagtacctgcgccagagcgtgggcaacgaggccgagatctggctgggcctcaacgacatggcggccgagggcacctgggtggacatgaccggcgcccgcatcgcctacaagaactgggagactgagatcaccgcgcaacccgatggcggcaagaccgagaactgcgcggtcctgtcaggcgcggccaacggcaagtggttcgacaagcgctgccgcgatcagctgccctacatctgccagttcgggatcgtgtagccggcggggcgggggccgtggggggcctggaggagggcaggggccgcgggaggccgggaggagggtggggaccttgcagcccccatcctctccgtgcgcttggagcctctttttgcaaataaagttggtgcagcttcgcggagagg

SEQ ID NO: 36722 - DNA, 174027 bp, Homo sapiens
ggttggtgccttagcaactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacaggtattatttctgctatcattgtacgtgtgcatttagcccacacattgcggtgggtgttcctaagatacttggagtacttttcagcaacacagtttacacttaatgcttgttatatttgtagttgacaaaacaattctatggatatcctaaattaggtatgcagctatcagttgagttgccttaaatcttactcagttgttcaacgagttgtaaactgacctttacagcccttgggaccaaattaaggtaacaacgactggtttttaaaaaatacattactgtgaacctgagggcatcatgttgtaaggagatgggggctgcggtgactcgcgggatcaggaatttcaagagaaccgagcggaaagggaaatccgcaacatgaagccctctctcgctcccaggcacccctctaccagcagcctcctgccagagcagattagtctctatccagaaattaagggagagattgctcgtaaagatgacaagctgctgtcatttctaaaatatgtgtgtgttgattccaaagatcctgtgtcttccgtgcagctgaaagctgctgaaacacgtcaggagccaaagaaattcagattgccgaaaggccatcactttgatatgataaatattaagagcattcccaaaggcaaaatttccactgtagaagcattgacacttttcaataatcataaactttatccagaaacatgaactgctgagaaaatagcgcaagaatatcatttagaacagaaagatgtgaattcccttcttaaatattttgttacttttgaagtcaaaatcttccctcctgaagacaagaaagcaatacaatcaaaatgaagaaaatcacaaaaatttcctatgtgtactcctcatccctcatcctgtatattttcttatttttgcatattaaattatgttaattaccaagtgtttaatgctctcattgtgagagcatcctcttaatatttattgagctccctgaattttcaagattgccatagactgtattttgttttcttttaatttggtttaggcatatttcatatgtacatgttagcatgactaatcagcacatctgtacctttattataagtaaaagagttaatttgttattttagacacatcataccaacttttaaattggtcatatgaccccttgggaagtgtcctgaatccctcatttaagttttcctatccaatttaggtgtttagttcattcttcatatgtgatagtgaaagtaaaagctttcctgactcttaagactgacattttcttgctagggaaagagactcgatagtaaggtagactaacagtatttcccaaataaaggcacataggagaaaataaagaatcaataaaatctaattaaaattactaccccagggaataagaagtattgaggatttattttattttgaattggttttaagtatggaataattgtctttacagttataaaaagtaattagtggtgtttacgaaatgttgggaatttctgctttgacaaatagttaagtcccatggccttcagagagagaggcagtagtagaaactttcgaaaaagtaacatttctctggatttaacatggaactagaaaaatttaaagaataattaaaaaaccatggtaaatgaaatttggtgattatatatagttttggatgttaatgctagttgagagaagagagaaaaaatagcaagtagaagcagagaacaggatcattggaagggacctgagaaattgctgctttatccattttagcaaacttattagcacggcatgtaccagtactaggatcttgagtaagagtgtgtgagtttagctctgcctaatatattactacttgtgggatctttgggagactatgtcctctttgagattgaatttcttctataaaatgagcataatgctaccttacttaaatttaagggttatcatgaagataagtgaaatagtaaaggactacaaaagaccaagggaataatgaattttttttttgtagtggagaaacgcctggggagaatatatgacctaaggtttctgtagtttatgacctaaccaggcccagaacttagtttttcaaatcctagtagtgtgttttttctgatgtgccaaaaagcagcacacctcagagaagggaataagtgtgaattgtgggtatattggggttatcagtgtgcttctgagggaagataggcatcactacttcccagagatgcccctggaaatgatacagaagatgctaaagaattcaacaagatgacggaatgaggcatttgtagtaatgctgagaacagaaaaatgaactaagtggaaaatttgtaagcatgtctttgaatgtagattggttaggtgaacaaactacctagtttatttttagttcagtacaataattgttttaagaaaacatgaaataactactcaatataaaatgcattttaaaactcctgtaaatcagtcaaaactttattccatttgtcataatggtaactagttgagtcactaatactagtacactcttatttctgagccatctttattcatatctacattgtgtggttaggcagctgttatgtggtatcacatgataaaagatttcttcccataccattaaaaaaatactattacacaaaatcattggcagaattcaaaataaagaaaaaaatgaaataaaggggaaaaactgcttttcaaataggtagcattttccacgtaaacttccagatctgtccacgtgactccacaaatggttatgtagttaagcatatagatttggattatttttgcatctatgtagcagcataggtcaatatttggttgtttatatttagagacaagatcttgctctgtcacccaggctggagtgcagtggcaccatcatagcttactgcagcctcgaactccttggtttaagtgaccttcccatctcagcctcctcagtggctaggacttcaggtacatgccaccattcctgactaatttaaaatattttttttgtagagacaggggtctcaccatgttgcccagactggtcttgcaatcctcccacctcaaccttccaaagcactggtattacaggtgtgaaccacattgcccagtcttaaaatatattcctaataataattattttagtggctgtgtaataatccctcgttgaatgtacccgtgcaccataattcatgccattattgttatacattcagagtattgcagaaataacactattttaagcaattctgcagtgaatatctttgaaattttattctttaaaaaataattccggctggcgcgctggctcacgcctgtaatcccagcactttgggaagccgaggcagacggaccacctgaggtcaggagtttgagaccagcctggccagcatggcaaaaccctgtctctgctaaaaatacaaaaaaaaaattatccaggcatggtggcgggtgcctgtaattccagctggaggctgaggcaggagaatcttttgaaccagggaggcagaggttgcagtgagccgagatcgcaccattgcactccagcctgggcgacagaacaagactctgtctcaaaaaaaaaaaaaaaaataaaataaaataaataattccaagaagagaaattacaggcttgattcttttttagtaattacttgaattgacacctttttggtcatagttcttttaagttatatttgtgacaataatgtgttctcacctatacatacaaatgtttttccctaacagtcttcttctcaatattttattatgataaatttcaagcatacataaaattgaaagaatagtatagtggacatgtatatacccattatcagctttgattgtatgtatgtgtgtgttccctgtatcagttgaaaggattcggatatcatgacacatcactcctaaatgcagctgtgtctgtttcctaaaaataagaacattctcctatgtaatcacatcattattacatataagattaataatactggccaggcacggtggctcgtgcttgtaaacccagcactttgggaggctgaggtaggtggatcacctgaggttaggagtttgagaccagcctggccaacatggagaaatcctgtctctactaaaaatacaaaaattatccaggcatggtggcacatgcctgtaatctcagatactcaggaaaccttaggcaggagaattgcttgcatctgggaggtcggggttgcagtgagccaagattgcgccactgtactccagcctgggcgacagagtgagagtttgtctcaaaaaagaaaaaaaaagattaataataattccctatcattcaatatccagtctatattcaaaattaccatattaaatgtataacttagaattggaagagcctttaatgatatcactttacagtataaggcttcccaaatcccacagtagagattctgattcagtagttctgagtggcattcagaaacctatacttgtaactttacaacaaaacaaacctccctgtacctgggatgactatacatcccagttttcctgggactgatctcgtttactactgttgacccatcataatagtaatagtacccaggccgggtgcggtggctcacacctggaatcctagcactttgggaggccgaggtgggtggatcacgaggtcaagagatcgagaccatcctggcgaacatggtgaaaccccgtctctactaaaaatacaaaatacaaaaattagctgggcgtggtggtgtgcgcctgtagtcccagctacctgatgctgaggcaggagaatcgcttgaaccggggaggtggaggcggaggttgcagtgagctgagatcgtgccactgcactctagcctggtgatagagcgagactccatctcaaaaaaaaaaaaaattaatagcacccatcactttcagaagttagacagtaaatcacatggttactctacttttaattgttcaaaagagaaaataggatcccgaggtagttaagaggtttatttgctcagagtaatcaaagtttcatagttttactttgtactcaagatagcagttgcaaaatggataatatgcttaacaaatgcatactgatcacatatatgaaactgcatgttgatttacatttaaatatattgcataatttgctgcttttaaatgtaatgccttattcctacaatgggaaaataagtatgcaaataagctggtaagtaggaagactgggtgaacggcagctaaattttgagtataatttccttggccatgaccaaatttattaagtctagtctggaaatttactaacagcagttgaaaaggtcttcactgtgctgagcatgctgcttgagtacacaggtgctaataagtgctagttggataaataaaaatgttaatagattaatctttctgtatcacacatcaaaatatttttctgtccttaaaaatccatgtaaatgtgaccttattcacatagcctatcctgaatactttataccgttaagatactctcttttattttttcttgacattaattttattcaatggtaaataatagaaaattgtaattttaacagagtgtatttgtgtgacatgctgcccttgttgaaagtggatcctatgtttttaaaacatattttcataaaatggcattattgaggtattattcagtagcttcatttacctcaataaggtaaattaagctgcacatacttaaagtataaaatttatttatttattttattttattttttgagatggagtcttgctttgttgcccagtctagagtgcagtggcatgatctcggctcactacaacctccgcctcctgggttcaagcgattctcctgcctcagcctccctagaagctggaattacaggtactcaccaccacgcccagctaatttttgtatttgtagtagtgatgaggtttcgccatgttggccaggctggtctcgaactcctgacctcaggtgatccactcgccttggcctcccaaagtgctgggactacaggcatgagccaccactcccagccttaaagtataaaatttaatgaactttgacatatgtatacacctgtgaaactatcacgacacaagataatgaacatattatcactgcaaaatttcctctcagattccttgcagaaatttctctcctccccccttaacttttcccaggtaactgctgatctactttttgtcactatagattagtttacattttcaggaattttatataaatggaatcatgcaatatgtactctcattttcctggtttctttcacttagtataattatgttgagatttgtccaggttgttgcatgtatcagttggttgtttctttttattgctgaatattcattacatggatatattacaattcatcttacccatttatctgttgatagatattttaagtttttttcagtttgtggctaatataaatgaagctgctaagaacatttgtgcacaagtttttgtgtggacatatgttttgtttctcttgggtaatttatggtagacagactctggtggctacccattatctatttccttgaataattctttgctttttgagcgtgagtgggatctgtgacttgcttctaactaaaatacagcaaaggtgatatacgtgattatatatacatgattacattatacaagattgttaagtcaatcctgataggaaagatgatctcctgtgctggctttgaggaaggcaagtgcccatgttgggaaggacaacacaacagggagctgatggtggcatctggttagcagccagccaaaaaataaaaaatatggtcttagtctgacagcccacaaggaactgaatgctgctaacagccatgtgctcttggaagtgaatccttccccagttgagcctcaaataagcctttgtgagaccttaaaacaggatggaaaattgtgagataataaatgtgtatttatttatactactacatttgtagtaatattgttacgcagaatagatgtgaatgcagttagtaaatatcttgtagtgaaatggttgggtcatatggtaggtatatatttaactttttaagaaactctcaaattgttttcctaagtggttttaccattttgcatatccaacagcagtgcataagagttctagttgctccacatccttgccaacatttagtgtggtcaatctttttaactttagctactctagcaggaatgtagcagtatactattgtagttttaatttgcatttacttaataactaatgttgaacattttttgtgtgcttatttgtcatctatgtatcttctttggtgaaatgtttttaaatatattttgcctattttttaaactgggttgtttatcttattactgttgagttgtaagagttctttatgctttttgtgttgtattcatctttgtcatacctaagggcgctgagattttcacttatgtttttttctggaagttttatatagttttacctcttccatttaggtctgcgatccatttcaaatttaattttcgtgtatagtgtgaatgaatgtggaggttcattagtttgcatatggatgtcaaattgttccagcatcatttgttgaaaagatacgctttttcaattgagttgtcttggcacctttgtcaaaaatccaatgacagtttaattgtcagcataatttgatccttttaaaatatatttttcataattgtatgctaccttgtattacaattatttccatttattcattattaaacagaaagctccttgaggacacaactgtctttcttacttctgaattctctgaaatgcagcatatgccttgcttatagaagattctcaatgaaaatgtgatgtgtttaagtaaactttagcattcatgactcttcacaggccttggctgagtcataccaaacaggtttatgatttggcatcctttcagaccaatcatctttaaaatttttttttactatattaatttggggagactgaacactgtgtgttagaagagcagaaaaagaggactccttttgtattagtaaagttctggaaagaaaactcgtggcatactcagggaagttaactgaaaatttaattaagggactatttatagagatggaggcagggttaagggaatcaacaactacttatactaagccttcagaatgctccagactgcaattatatctttcatctctatagttgacataggaggaatatgctaatacagtatgattaagcattgaaggggttcagaatatgccaccccaaaatatgctactttggcctaagtattattttgagccgaagccaattgacaaccagtagatgcagttatgtcagtcactggagagcattagcaaatgtattccaaaaaaaaaaaaaattgcttaagataataaccacaatcagctcctcattgaggtgggcaacattggatggttatgacaaggtgaggaaagaattgtctagtttgaagattcttggtactatatttagtttctaggtgaagaaataaaaaggaaggctgggcatggtggctcatacctgtaatcgcagcactttgggaggccaaggcaggtggatcacctgaggtcaggagttcaagatcagcctggccaacatggtaaaaccccatctctactaatcatacaaaaattagccgagcgtggtggcgcatgcctgtaatcccagatgctccggaggctgaggcaggagaatcgcttgaacccagcaggcggaggttgcagtgagccgagatcatgccattgcactcagcctggatgacaaaagcaaaactccgtctcaaaaaaaaaaaaaaaaaaaaaaaaaagaaataaaaaggaaaaaacaaaatatagttttaaattggggcaatttatctgtagtttggtcaggctaatgtacactgtaagcttgaaatgcaaatttctaatttcagagtctaaatatttgtttctcagatttcattttgatgatggaatgtatactagatgcagagtttgcatcaatttttgtaatatattcatttatttacttaactaattttaatttgccataatagcaggagctttttgtttatgtttattgttgtatccccagtgcctagaatagtgcttagaacatagtagcacagagaaacatttgttaaatgaatgaatgaatgatagaataatggatgaaacatggaatatgaattttagtggaggtgacaggtaataagtataaaaatcaataaataatgtaatttcagatggccttaaagacagcaaaccagatttaggtgatagagaataactggagagaatgttgggatggtttttaaaatcttcataataaccctatgaagtaggtatttttatctcccttttttagaagaggaatttcagacttgcctagggtcacaaagtagtggaaccacgctaatctgatttcattaatttattccttcattaaacattccttgagtgcctgctcaacactgagccagagtctataaaatcagagtaaaacagtctttgccttcagggagcttataatctagctctgtgctgtctaatatagcagccacttgtttctcatcataattgagatatgctgtaattgagatatgctggattttggagacttatttaaaaaagtaaaatgtcaataatttaaaatattatatttaaaatgatattttggtgtattagataaaatatattattaaatttaacatttctttttattgttttgaaagtggcttctagaaaatttaaaatggcatgtttgacttgcattgtagattctgattcagtaggtctgggcccaagataatgtatttctttttttttttttttttattgagacggagtcttgctctgtcacccaggctggagtgcagtggtgccatctccgctcactgcaagctccgcctcccaggttcacgccattctcctgccttagcctcccgagtagctgggactacaggcgcccaccaccacgcccagctaattttttgtatttttagtagagatggggtttcactgtgttagccaggatggtctcgatctcccgaccttgtgatctgcccgcctcggcctcccaaagtgctggaattacactgcgcccggcccaagataatgtatttctaaaaactttcaagtgacgctgatgctgctgttctgaggaccacactttgagtagaaaaacttagactagacagaaaacaagtaattagagtactgatgtgatgctttgtatgactgggcaagcagagggtgcttagagtcttcgttttgttttgctttgtttttcactctgcaaaacaatctatgttcggttaaagcatttttgcacaatttttatttcctccataactacataaatatagatttctctgattcatgagtttatcttttgccatttaatgattatatacactagagagcagtatctattttatgaacagaagaataaggggccgggtgcagtagctcacgcctgtaatctcagcactttgggaggccgaggcaggtggatggcctcagttcaggagtttgagaccagcctggccaacatgttgaaaccccatctctactaaaaatacaaaaattaagtggcaggcacctgtaatcccagctactcgggaggctgaggcaggagaatcacttgaacccggaaggcggaggttgcagtgagccgagatcgcgccattgcactccagcctgggcaacaagagcgagacttggtctcaacaacaacaacaaaaaagaaggaatgtaacatcattataaagaagacataaacaagtattacatattatttactataatgagaaaatatccaaaataggtcactgaagtagattctcccaattgtgaacaatagtttttattgtaagtcaaaataggaaatattttccagaggttgcacaaacagattaaaccacagaaataacattatttcagataaatggtcaatccctctgtggtcttagacatttagttttgggtagagaacatggaaaacttcctgaaggaagtgatttctaagctgagaaacatcaataggcactagccaggtctgtaagtctctaacacccatgctttaactcatattttggatcaagtttttgtattctttcattttagtgtttgttttgtttttgtttagtttgctataatattttatctgaatggagactaatatcctttgaggagaaacaatttcaagtttattaattaggtttctgtttaagactccatcataatataccatttattagtttataattcagattctaaacctattgtaagagtgcctacttgcaaaaagcaaagaaccagaggttcaggatttgtgaaaataaaaatactgtaaaatataaatgtttaaatattttcttttctttttttttgagatggagtttcgctcttggttgcccaggctggagtgcagtggcgtgattttggcttactcaatctccatctcctgggttcaagcgattctcccgcctcagcctcccaagctgctgggattacaggcgcccgccaccacacctggctatatttttgtagttttagtagagatggggtttcaccatgttggccaggccgttctcgaactcctgacctcaggtgatctgcccaccttggcctcccaaagtgctgggattataggcatgagccactgtgcccagccaaatgtttaaatgttttcactattagatatgtctaataagaactaaaggaatatcttcttgaaattgaaaaggaaataatatttttctatcccataaggattgttggaaaggtttaaagagacaataatatacgcaaagtgcttacttagcaagatgcctagtataaggaaggtagtataagaaagtaatgttttgtttttggtgtccatttggggttctctagtagtttggacaggttattttaagagtaatcctttatgaaaattataatgtacacattttattttgggacaaggattctaatcatttcaataatttatttttaagcacagtttactggggtctcaacaaaagtcacatattcagaagtagtatggcctctaggctaggagtctagagacctaggttttagttctagctctgttaatcctgttttactttgtgccaatcatttcaaaaaaggatgctttactaattgctctgtaaggtgctttctagtctgcatcggttttgttgagactgcaatagcaatgtatccaaggtccaaactaatgatttgccatctggtttcatttagcaaagttaatgttcggtcatcaagtacatattcagtaggaagtattctttttcgaaacagtttctacagtcatttttttttaaccctgtataaaatgagtttattttggactgttaaaaaaattcaaaactttaaaatttgttatttttcaactaatgcaaaagaatatattagaaacatctgaataaaaaatgattctgggctgggcacggtggctcacacctttaatcccagaattttggaaggccgaggtgggctgatcacctgaggtcaggagctcgagaccagcctgcccagcatggtgaaaccccgtctttactaaaaatacaaaaattagctggtgtggtggcggctgcctgtattcccagctacttgggaggctgagacgggagaatcgtttgaacctgggaggtggaggttgtagtgaacagagatcatgccattgcactccagcctgggcaacaaagagcgaaactccatctaaaaaaaaaaaaaaagattctgttcttttctgtatttactgatgtccctaaacattttacatttttttttaaaatttaggttatctccctattaaaactatttacaagtgacagtgatgactcctgttactcaaaattaaaccaaaatgaacatcaaactgggatttattggggcccagaaacaagaagatataattcattcatttgaaaatgataaagagggactgaaataatagtgagaaagctgccctgagaccagagtaactttgtttctttgatgtatcatttacagtaataacccaacggggtgccaaggggctgccactctttggctatgctttattgtccattcacactttgtctccatgtttccttcccccttcctcctgtatacatgtatacagaagggggaaggaaacatggagacaaagtatgcatatacatatagaaattctggagcagtaacttactgatgtatacaacttatcgaatctctctgagttatgctactacccctagtgtgttgggcatgttggctcaaacttccttaatcaggaaactttggaatgggtttattgctagctgtctttgcttgggtttaatctcaatatttctgaggtgcaaagtgcactagattgagagttaatagatctgaattttaattccagttttgttcccaatgatcactgtgacctcaggcacatcatttcacctttcgtcgttcattcagtttatcttacctattcattaaaaaccaatctgcctgcccccagttgctttctagtggtagtgatgatggaggtggtgagagacacaataaatacataagcaaataggagaactatgaaggaaggaaaagttagtgatgtactagggatagtgtacttttgatagggcatctaggatttctctagataagtgaaaaatgaagaggtttaactggatgctaaggggtcttgcacattaaaaggcatgtgtttccgtcttttcactactgtgttctaggaaggcccaccaatgcctctaacctgtaaataaatgcaaatctatttaaatcaagtgatacatcaattttatgttgcttgatttggaagtaatccgcaaagaagcaatagctaaacattttagtgttgtttggggagtagctgctgaacaataaagaccaaaaccataactaaaaaacaaacaaacaaacaaaaaaacgcagcccgagacagatcagaaactaggtgtatgtagggcgccaggttatgacactgttctctgacatccacagggcgcaaaaagaaaacctcactagtcagcttcgcacgtgctctgcgcaggggctcctgcgaggccctagtccctccctgggagctaagagcaggacggaggctgtacctgactgctgcttggagggaaccctggctgagtccagggaggaggagccagaggaggggccgattggaagcagccacctcagcgaagctgcaggatttccgcagggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggtggcagaacatcctaggtgggggagaggagacgccgggctttgggatctgctgggttggctacgtgtagatcgggtccacagcacttggctcctcccttggggcgctgcttttggtcccggggagcaagtggaacccttgggattctataaggacacgtggctgggcttgcaaaaaagatcacgccgcaaacacattctaccttgactactacgaagggttgtatgtttttttcttcatccatgcagattcttcttttccttttcttgttgtaattagtgtactctttctactgggcttcagcagaaatgcccatatccacactgaactcctctctttgtctcgcatgccagttgatactgctttttaaaagtcttctttctaaatattaattgaaaacaaacacaaaaaccttcttggtgtctgcatcctctttaaaacaaaacaaaacaaaaacacgagaatctctgaactgtcacttagggaattaatttgctggcagtccctagctacacagtaactaatagtttagtgatgtctcggggaggatcttttcagttacaggtactttgtagaaatacttcgttctgactaatggggctgaggtctcataaaatgaagtctgtcacctgctacattagcgaagggctttcctgactctctgcttttgctgtttttcttttcttttctttcttccttcctttcttttttctttttctttttctttttttttttttttttgagacggagttttgctcttgttgcccaggctggagtgcagtggcgccatcttggctcaccgcaacctccgcctcccaggttcaagcgattctcctgtctcagcctcctgagtaggtgggattacaggcaggcgtcaccacacccggctaattttgtattttcatcagagatggggtttctctatgttggtcaggctggtctcgagctcctgagctcaagtgatccgctcaccctggcctcccaaagtgctgggattacagacgtgagccatcgcgcccggccctctgcctttgctgttttcagtttttttctgttagtttttttctctggcatcaagtccttaagctcttcctacttggtggtttattaccaccgtgtgtcagttgatgatattatactttactacaacttgaaaatgttctttcatccttaaaccagcaaacagtgtgtctttagttaccagaaagaagcatgatttcttattatagagtccagcacagctttggactacttctcaatgtctttgaatgttttaatatactctagaggttcttgtatagcactgttgcccttatatatttgaattaattaagacacactgttaaaggcatgcttccaataagattaatgagaaatttgttacatgaaaataacttgatctcttgtagtttagtcttattttttttttttgagacagagtcttgttctgttgcccaggctggagtatagtggcgcagtctccgctcactgcaacctccacctcccaggttcaatccattctcctgccttagcctccagagtagctgggattacaagtgcccgccaccacgccccgttatttttttgtgtttttggtagagacggagtttcgccatgttggccaggctggtctccaacttgtgacctcaagtgatccgcccgtctcagcctcccaaattgctgggattacaggcgtgagccaccgtgccacgtctatagtttaatcttctacataaaacatacccatgtgtaaattcctaatgtgtttccattttatgtgattgtaataataaagatcaacatttctatctatatttaccctgtttgggggaggatggtggtaacaagtataggtacatgtactaaaagtgaagaattgtttactgaatttccttagtgttcttcttgcttttcatgatttttatattattcatgtaacaaatatttattgttaatatttattctgtgttatccacagaagagatcatagtagataagctctgccgttttcttgtttttcatttgtgcacaaaatgcaattattagcttcaagcaatgttttatttgcaggaatgttttgcagccacttactcattctaggagggatgtattttattaaatctaaatagtataatctataaattcacctaaccggtcaagtattgcaatatgctgagaaggaaaaaaaatgaatgaatggtcagcctgctttcttgtggaactcttattctttttccaggatgcctcttcaacctcacaaggcacatgatcctttgagtaaaggcactggtcaaccatatcatacattttagtaaaacttaattttatttttattatttttatgtaaaaatcaaatagaaattgaagttctaatattttctttctgtgtcccactcttgcatggtaccggtaccgtaagactctgaatttcactgttctggctttctttgcattcttagcagttgtatctcttatctttactttctcttttggattaagttttaaaacttgttggattattgctatttttgtagcagttttattgacattcacgtatcatataactaattcatttaaagtttgcaattaaatgggtttaatgtattcatagagctatgcaaccatcaccataatcaaatttagaacgttttcttagaaagaacccagccatcccttagattatcacaccccagaactccattccctttcccctcacctagccttaaacaactactgctctgttttctgtatttatagatttagtcactttgggcatttcaaatgaatggaatcatataaaatgtgtgtttttttggtgactggcttcttccatgtggcataatgttctgaaggttcatgtatcagtacatcatttaacatgtatcagtatatcattcctttttatggttaaataatattctagcttatggatatacattttgtttatacattcaacaattgatggacatttgggttgcttctatcttttggctcttatgaataatgctgctgtatgaacacattcttgagtctctattctaccagttgagctagcagggtgacactgaatacatttttaatattaaaaatttggattatttaaaagtatattcagtaaagcctgaaaatcccacagtttctttcctgattgtctctgatttctacccttggctgccaatttctacttctcttcttagaagttattcatttggtttgtatccttgtaatattattgtgtccttatatcattgttactatattttataaaaatgatatattcacataagtccaataattatatttgtttttttttacttactttttttcacttaatctttctcagatatctggtatatcagttcatacagatatatttcactatttttacttatttcattttattttttgagacagagtctcgctctgttggctggagtgcagtggcactatcttggctcactgcagcctccgctcttgggttcaagagattctccttgtctcagccttccaagtagttgggatcacaggaatgtgccaccatgtctggctaatttttgtatttttagtagagacaggatttcaccatattggccaggctggtcttgaactcctgacctcaagtgatccacccgccttggtctccctgggattacaggctgagccgctgtgccccggactatttcactgtttttaagggctgagagtattttgtagtatgaataccattatttaaccactcaacatttagtacacttagatttctaatttttctctcttgtaaacaatgctgcaacaaacatccttgtgtacatatacatatgtacatatatgtatatatattctctgagcattcttgtgaattttttaaagctcatttatgaaaatggaagcagagccaaaggtaataaacatttaaaatgttgatagctcctgtcaaatggccctgcaaaaaagatgttattggattgcctatttcttgcttttttgtttgtttgttttgtttttaagagacagtctcactctgttgcccaggctggagtgcagtgtcatgaactcggctcaccacaaccaccacttgccgggttcaagcagttttcctgcctcagcctcccaagtagctgggactacaggtgctcaccaccacgccaggctaatttttgtatttttagtagagacagggtttcactatgttggccgggctggtttcgaactcctgacctcgtgatctgcctgccttggtctcccaaagtgctgggattacaggcatgagccacagcacttggcctatttcttgttatttttagaaactctttttatatgtgtgtatttttgtatttgtatgtatttttaatagaaaccatttattctatatatattataaatatagtttctagtttaactttatgacatcttatgtagacattttataatttatgcattgtagtatgttgaataataatgatgatagcatctttgtcttcacccttattttaatatgtcatccaaatgaccaccagaatggtgagatagtagaaagaagagctttattggcactatcagtttgtagaccagaagagagagtctgcagtgtggactgaaggtgttctaacttcgagtagggaagaggaagtttgggttttaggccccacagagtctgtcttatacaatagagtcatacatattcagtaggttttggggaaaagctatacatatttatgaggggagccaagcacatgcgcagtgggtaaacatatatgtaacatacatcccatgttcccttcgtggcaggttttagcattaaaatgaggtggaatttggctcacataacaaggtgagctataggacacaaagacagttagtgcacagcctttataggctggctgaaactagcttaaggtctgcagttgtttatcagaaaagaatgtttgtaaggctggtcctctgtccaatcagagttgtagtggcctggatcataagtcagagttaggaggtgtccaatagctgctattgctagggggtttagcaagagagtggttttacttgtagccatgagaatttaggaagttgttacacctcgacctgtaacttttgttaccttaactttagagtcccccttacctgataaagggacatctacttaagtttctcagatcacaaatgggaatgcttctaatattttgccatcaaatatgatgtttgctgtttctggtaaacatcctttattaaattaaggacatgcccttttctagtaggtgagaaaagaaaaatagctctgagccatctgaggtatgttaagggaggcgaccacctctcatattgtcttatgcccaatttctgcctccaaaaaaagaagtaaaaactaaaaggcagaaatgaaatccacaagcagacagcccagtgccacaccctgggcctggtagttaaagatcaacccctgaccttatcagttacttgcataaaaaagcactgtgaagatccctgtcctgttctgttcccttctaattaccagtgtatgcatcccccagtcaagtaccccctgcttgctcaatcgatcatgaccctctcatgtggacccccttagagttgtgatcccttaaaagggacaggaattgctcactcggggagctcggctcttgagacaggagtcttgctgatgctcccggctgaataaaccccttccttctttaacttggtgtctgaggggttttgtctgtggcttgtcctgctacaatgtgagatatgcaaagatttatcaggcccagagagacatgaatatggcactttagtcacatccctcgccctccttgcacccatgtgccagggggcaatcatttaaagaccttttgttcctgacttcccctgttcctgcttcccctgttatcttgatgttcctgtaatctgtgatacaaagtacagccaatcaataggttatgctattttaatgtaaattcttggtaaacaagttaggaaccaccccatttttttcctttaaaaaccactagtaactactgctaatcagagggtatattcatgttaacttgaatctatgttcctgggttgcaatcttcaaacttggcccaaataaactctgtattaagtttgcctcactttttttgtctttagatcaacgcatgacagagatttaaaaaattttatattttatttttaaaaataaggaatggctatgaaaatacatttgtttcttatttggattttttgagaggatcatgaagtcatagaattttcttctttttattctgttagcatagttcatttaatcaacagatttctggtgctgattaccttcatattcctggaatgaactctgcttggtcacataggttattttaggtaattactgcattaaatttaccgacattttatttagggtttttctatctatttccacaagtgagattagcctatagtttgcttttgagggccattcttgtcaaatgtaagcatctgggttagaccagcctcctaaaatgagatgggaaactttccacagcttctattatttagaaccatttataaaaagaaaataccactttttccttgaaggtccaaccaacttgttgtaacactttttgggctttgtttctgacaacttttctatttctttatttttaaactcttgtgtcaattttagaaatttgtattttttctagaaaaatcagccatttaaaaatttttaaatctttttaaaatttatgtttgtctattatttctagtattgattatgtttaatgacactcaaagttctttttctatatatttttttaaattgaagaaccaccttgtaatttttttatccaatctgctattttcccctggttcaataaattttgcttttatctgttaatttgcttcttctaatttatttaactactttttgctaggttcctatgttatatgcatactttatttattttcattatttattttctttttttcttttaaataatttatgttaaacctattgtatcacacagtatgttttaaacactgccagataactccctaatcagataaagcaaagacaaaaaagtttatcttactagaaacaagagacatcatcacttatagttttcaaacattattgcactttaactgtcataatttgacaaagaattcatgaaataatctacagactagttttaacagacaaataatacttgtaagcagacatgactgtcctaaattgttttttaggtatcaactttacaaacattacttacattagtggtaacggtggagttggagagtattgtgccttttccaagatgcacagtgagaatcaccaggagtgtggtggaacttatgaccctaccaaggccacggatctttcggcctgcagatgtcagcccatgcatcaccctttgcttgtggactggtttggtgatccactgggtggcaggattttttctgacagcattatggagtggatgaatgaggataacttcaaacattttgtatgttgaatcttcaccgaagtgagaactcaggactcttagccgggcatggtggctcacacctgtaatcccagcactttgggaggccaagttgggtggatcacttgaggccaggagttcgagaccagcctggccaacatggtgaaaccgcgtttctactaaacaaaaattacaaaattacaaaaattagctgggtgtggtggcgcacacctataatcccagctacttgggaggctgaggcatgagaattagttgaacccaggaggcagaggttgcagtgagtgagattgtgccactgcactccagcctgggtgacagagcaagactctgtttcaaaaaaaaaaaaaaaaaaaaagaaatactatatatatatatatatatatatatatatatagaaataaaatgtataaatatgtctatatgtataaataaaaatatatgtacatgtatatcatatatacatgtacatatatgtatgcacatatatgtatgtacatatatacatgatgtacatgtatatcatgtatacatgtatatatatgtacatatatatatatatgtgaattcaggactcttagaaccccacagtggcgtccagctttctcgtcttcaatggacttcaagcatactttagctggttaacaccacagtggacaggcttgccataagctgcacccttaggaactgggcattttcggccaccatggtgcacacgaatcctatatataacgtaaacttgcttggccttgtagccctgtcggtgcacttttttgggctgggtgggatgtggagccctgtggtagagcagagagctgtcagtactgctagcagggactctccgaagaaagtgcatggtatcagactgctgcttcctccacagctcctgaatgtacttgtatgcagttatcttggcttacctgatggctgttgccagacggaaaggaaagagcctttctcccccattatttattttcttatatgaatagaaggctagaaaattttctgagtgctattacggttgtgcctcatgggttttgatatgtagacctctcattattattttcaaaatagctatagctgtggccttaatttccactttccttcagcttcttgctcattaatttgctctttaactcttttcattcttctattcaacctatctactatttttattttcaccatcataacctcgttttctaagatctctaatataattttaattttgtttttatgtttaatttttgatcttggagaaatttattgtgatgaaaggaacaaaacagagattcaaattcaccctcctttcccaatggtaattaccaatctttgaaattccatctctaacatatattaaattctcaaatataacagtaataatagtaataactaataattattttatacttataaaaccctcaaacaaacctttgcagtgagttctagtattagcctcagtttgtagatgaggaaaattgaggcatggagcaactcatacaaattaacataaaaattcatgttataaccaattgttcttaaattagtattaaaaattaacattttctataatgccatgactcgatatcctgatattgaagagaaaacaagcacagacaggatgggggacttgcccaaggtcacagtggaagactgaaaatacatgtcatagctcctgaaattttaattcattcatttctgcagttagccacacggtctgagagaatcagtccttttattaaagtccatttcattcacaacagtcatagctttgtttctcaagttctgttactaatactgctgttcttttttctttgtttctttcttttttttttttttttttaagattttaagtcaaaagagcattcagagcaccagagtcagcaatttgtgctgcaatactttggccaattccccatttaacagtatgatctttgtaggagctcttattttcatattgaaatgctcattgtattttttggggggcatactttcagtgactgcattaagacacaaggtcttgttggtagctcacctagaggtaaaatacagctacttcccccaattacagccctaccattcattattagagggttaggtatgaagtttagaaaaacactgtacacttcagttctttctgttcttagagaaaaatgccttccttgtttccttttatagcctccatgcatttgaatttctaaggtaggaatgttgtatagtaagcctcttggtactgaagcagttataagccatgaacagactgccttcccaaggaagtctaggaaaatgacaaagttttataattcaaaataatttcattaagacacattttaggagacttattctaactctgctgttagcacttcatgttatttgtgtttgcagtccttataaaaacaaattaataaggattcaagttcaggaaaacttgaatttcatctgtatatgattttcacaggcagaaacattaacccctattaaggctagcaggattatctaaaccagcaaagtgggagttgtacttattgctctttttcccacatttaattgtaccaattcctttggatttgacatttcaaatatcaccttaatttcacccttctctacctatagctttgaagtactttcagcatttctctctagatatattacaatgaactgctattagatctctttatttctacaatccgaattccacacactacccagtgagctttttcaaatgcaaaattgatgatttacttcatttttaaacatctgttcacatccattgcctgtatgttaaaagccaggtttctcaatatggcataaggccctttaagatctgagacttgatatcctccaacctcctcccctccttttctcttctgatgtttttagatacctaattgtagttttctgaatgctgtatgcttgggccttttcatgtcaattgcctagaatgcttcaccgtaccccacctgtctgacatcatcctttaaaatttatttcaaacattacctctttggggatcctttaatgtaccttccctctttttgatttatcttacggctcatatcatattctgtcatagcagggactaaatgatgtttctctgtgctcccaaaggactgtatttggccgacttatcactctgtattgtccccctgtattgtgaattttggcttacctattttcctcttttgctagaccaatccttccttccttccttccttccttccttccctccctccctccctttccttccttttctttccttcctcttccctcccccctcccctcatctcctcttctttcttttgagacagggtctcactctgttgcccagaatgaagtgcagtggcacaattatggctcactgcagctttgactttctggtgattctcccacttcagcctcctgagtagctaggactacaggcatgcatgtgccatggtgcccagctaattttttgtattttttgtagagatggggttttgccttgttgcccaggctggtctggaattcctgagcttaagtgatctgccttggcctcccaaagtgctgggattacatacatgagccactgcacctggccaacttttaaatttcttaaggccaaggattcttattcatctcctttcaaagagtacttagtaaagcatcagtaaatgtttcttttttaaaaaaaagacttttttttttttttttttttggaacagagtctcactctgttgcccaggctggagtgcagtggtgccgtggcacgatctcggctcactgcagcctccacctcctgggttcaagcgattcttgtgcctcagcctcccgagtagctgggattacaggagcccgccaccatgcctggctaatttttgtatttaaaaaaaatagttttttattttgaaatatttttagacttatagaaaaatcaaataataattgaaaaaagtactgtatattcctctcccaaattccccaaacttaacattttaccacatttgctttatcattctctatctctgttttaattttttttaatttttattttttatgggtacataatatagatgtatatatttatggggtacatgagatattttgatacaggcatacaatgtataataatcccatcagggtaaatagggtatgcatcacctcaagcatttatcatttctttgtgttataaactttccaatgataatcttttagttattataaaatgtaaaataaatttttgttgactataataactgttatgctgtcaaatagtagatcttattcattctatctaacttcatttttgtacctattaaccatccccactccctcatctctgctacccttcgcaacctctggtaaccatcattctactctctttctccatgagttcaattgttttaatttttagctcctgcagatgagtgagaacgtatgaagtttgtatttctgtgcatgacttgtttcacttaacataatgtcccccagatccatccatgttgctgcaaatgacaggatctcattcttttttacggctgagtagtactccattgtgtgtatatgccacatttctttattcatttatctgttgctggacacttaggttgcctccaaatcttggctattgtaaatggtactgcaataaacatggagtgcaggtgtcttttcaatacaccgatttccttttggatatatgcctagcagtgggattcctggatcataaggtagttctatttttaattttttgaagaacctctcaactgttctcggtagtggttgtactaatttacatttccaccaacagtgtatgagggttctcttttctccacatccttaccagcatttgctattatcttttttttggataaaagccattgtagcttgggtgagatgttatcttattgcagttttaatttgcatttctctgactatcagtgatgttaatcactttttcatatacctgtttgccatttttatgtcttttgaaaaatgtttattcagatcttttgcccatttttgaattgaattattacattttttcctattacattgtttaagctcattacattttctggtttttaatcccagtcagatagtttgcaaatattttttctcattctgtaggttgtctcttcactgcattgatttttttcctttgctgtgcagaagctttttaacttgatgtgatctgatttgtccatttttgctttggtagcctttacttttaggacattagacaaaaaaaatctttgctcaaaccaatgtcctggatgtttccccaatgttttttgtttatcttttcaaaatactaacttttccttttgtttatcttctgtattttttgctttaatttcatttatttctgctctcatctttattatttcttttcttatactaatttcgggtttggctttctcttgtctttccatgtttagatgcatcattaggtcatttatttggtgtttttctacttttttgacatgggcatttatttctataaacttttctcttagcattccatcactgtaacccaaaggttttgctgtgttgtgtttccatttttatttgtctcaagaaatttttaaattttcttcttaacttattcattgacctactggtcattcaggaacatattgtttaattgtgtttgtatagtttctaaagttcctcttattgatttctagttttattccattgttttcagaaaagatacatgatatgatttcatttttttgaatttttaaagactagttttggctgggcgtggtggctcacgcctgtaatcccagcactttgggaggccaaggcgggcggatcacttgaggtcgggagtttgagaccagcctgaccaacgtggagaaaccctgactttactaaaaatacaaaattagccaggcgtggtggcacatgcctgtaatcccagctacttgggaggctgaggcaggagaatggcttgaacccgggaggcagaggttgtggtgagccaagatcacaccattgcactccagcctgggcaacaagaatgaaactttgtctcagaaaaaaaaaaaaaaaaaaggactagttttgtggcctaacatatggtctgtttttgagaatgaaccatgtgctgaggagaggaatgtgtattctgccaccgttggatgaaatgttctgtaaataactattattaggtccatttgttatagtgcagattacgtctcatgtttctttgttgattttctgtctggatgatctgtccaatgctgaaagtggagtgttgaagtctccagctattattgttttggggcctatctctctttttagctctgataatatttgttttatatatttggatgctccagtataaggtgcatatatatttacaattgttacattctcttgctgaattgaccccttttatcattatataatgaccttctttttctcttcttatagttttttttttggaaatctattttgtgtgatataagtatagctacacctgctcttttttggtttccattggcatggaatatcttttttcatctgttttctttttcagtctatgtgtgtctttagaggtgaagtttgttgcttgtaggcaacagatcattggattttgttttgtttttaatccattcagccattctatgtcctttgactggagagctgagtccatttacgttcaatgttattgttgataagtaaggacttttctgccattttattatggtgttcttgttgttttgtagtcttctcttccttccttcctgtcttgctgtttgtgaaggtgattttctctggtttctaatttctagctttttattttttgtgtatctgttttgtgttttttatttgaggttaccatgaggcttgcaaataacatcttatcacccattgttttaaactgatattaacaccaattacaaaaagaaacaaacgagaaaagagaaaactaataacacttcaacttcatctaccttcttttttaagtttttgttgtttttattcatatcttattgtctatgtcttgagaagttattgtagttattattttagatgggttcatgttttagtctttctactcaagatataagtagtatacatgccacaattatagtgttacaatgttctgtgtttgtgtccttcttattaccagtgaattttctatcttcagatgatttcttttttaaaaaaattaacttctactgttgatatgtgggtacatgtgcacctttgttatatgggaatattgtgtgatgctggggtttggggcctgtatcctgtcattcaggtaataagcatagtacctgatagtttttcaacccataccccactcctcctttcctctctctagtagtctggagtgtcttttgtttccatgtttatgttcatgtgtgctcaatgtttagctcttactcataagtaagaacatgtgatattttgttttctgtttatgtgtttatttgcttaggataatggctttccactgcaaccattttactgcaaagaatatggtattactcttttttatggctgtgtagtattacagggtgtttatgtgccacattttctttatccagtctaccattgataggcacctgggtttgattccatgtctttcttattgtgaatagcacagcaatgaacatatgagtacatttgtctttttggtagaatgatttattttcctttggatgtatacccagtaatgggattgttgggtcaaatggtaggtctgttttaagttctttgaagaaactccagacactggctaatttacatttccatcaacagtgtataaatgtcccctttttctctgcagcctcatcagcatctgttagtttttgacacattttggtaacagccattctgactagtgtaaggtgggtatctcattgtggttttggttttgatttgcatttcttcagatgatttcttattgcttattaacaaccttttctctcagtttgaagtttcttcagcgtttcttgtaggatatgtctgctgtcagtgatagcagtttttgtctgtctcagaaaatctttgtttctttttcatgtttgaaggatatttttgctggatatactattctagggtaaacatttttttctttcagcactttaagtatgtcttgccattctctcctagcctgtaaggtttccactgagaagtgtgctgacagttgtaatggagctcctttatatgttactggtttctcttctcttcctgcttttaggatcctttctttatccttgacctttgggagtttgattattaaatgtcttgaggtagtcttatttgtgttaaatctgcttggtgttccataaccttcttgtacttgaatattgatatatttctctaggtttataaagttctcttttattatccctttgaataaacgtcctatcccagtctctctcactctctatgctttttcaggccaataaatcttagacttgccctttacaggctattttctgtaacttgtcggcatgctatattcttttttattcttttttcttttgtgtcctctcactgtgtattttcaaataccctgtcttcaagctcactaattctttcttctacttgatcaattctgctattgagtgactctgatgcattcttcagtatttcaattgagtgtttcactctagaatttctgtttgattcttttaaattattttaatgtatttgttaaatttatctgataagattctgaattttttctctgtattgtcctgaatttttttcttttttttttttttttgagatggagtctcactctgtcgtcaggctggagtgcagtggtgcaatctcagctcactgcaacctccgcctcccgggttcaaatgattctcctgcctcaacctccgagtagctgggactacaggtgtgcactaccacacccagctaatttttgtatttttagtagagacagggtttcaccatgttggccaggatggtctcaatctcttgacctcatgatccgcccaccttggcctcccaaagtgctgggattacaggtgtgagccactgcgcctggtctgttatcctgaattttgttgagcttcctcaaaacagttattttgaattctctgtataaaaggtcacttgtccctgccactctgggaatggccactggtgcctcatttagttgatttggtgatgtcatattttccttgatggtcttgatgcttgtggatgttcactgatgtctggacattgaagactcaagtattatggtagtctttgcagtctggatttatttgtatccttttggggcaggctttctaggtatttgaagggaattgagtattacgatctaagtctttggtcactgcagctatatctttattagggggtaccccacacccagtaacactgtgtctcttgccttcttgtagaggtactgccttggtggtgttgggtaagatctgggagaattccctggattaccaggcagagtctttaaatctttaccatcattttcccccaaagagaatttctttctccatactgattttcctggagttaggggatgggagacacaagtagacttgtggccactgtcagtgggactgcactgggtcagacccaaagttcacacagcactgggtcttgcctgaggcctgcagaaaccatgtcatggttaccactgatgctccctcaaggcccaagcaggtggcaaacccagccagacttgtggctttctctttagggtgatgagctccccctaagcccaggattggtccagaaatgctgtctaggagtcagggcatagagtaaggaaccttaggaatctacttggtgctctattccactgtggctgagctggcacccaagctgcaagagaaagtctttcccactcttccctcctcttttcttaagcagaagtatttccctgtagccacctcccccagcctgtagtgagtaatgcctggttattgctgatgtttactgcctggctcccactgtttacccaagggctcttctgtcagcttgtagtacatgctcctgggcctgggatgctcccttcagggtagtgagctcctctctggtccagcatgagtccaaaaatgccatccaggagccaagtcctagaattgtggaccccaggagtccttgggtggtctgcatcacagtaaccaggctggtacccatgcttcaggacaaagttcccgttaatcttccttctttcctcaagcagaacgagtctctttccatggccaacacactgggaatgcacagggtcacccaaggcctatgacaagtactgcctggcaaccactgatggttattcaaggtctgacagctctttagtcagcaggtgatgaattctcccaggactagttctttctcttcaaggcagtagattcccctctggtccaggatgtgtagaaatgttgtcagggtttacagccttataaaggcttagagtgcctttcagatttgtttaggaacctgttgtgctttagcccatggtggttgggctagccagaacttactttcaggctgctgggatgggcaatttccctctagctagggctggtctaaatgctgcttccatgggcactggctgatttctgcactgtgttactttctactgttacaagacagcactgaattccaaagcaaagccccataatcactgtactcctccatgtgcacagcttctctctccatgctacatggccaccaccattgctgggggttaagagagtggtggtgtcaatgattcaagactatctttccaaccgtcttcagtatctctttccttgacatgattttaaaaccagatgttgtgattactcacctgattttgggttcttaagaaggtgctttcttctgtggatagatagttgttcaacttggtatttctgcaggaggatgatccctagagggttctatttggttatcttgctcctatccccttataatttttttcctgaacagtttgagattaagttgaggacctgattcctggtagaagacaaaatctcaactaatttaattaaatgctgtaatcagcttttattattattttcaattcctgaattgggcagcatgtaaaaatagagaggtgctaggctaggcatggcagaacagttggttttcacaaaatagcttgaagaagcacaaggaaacagcataataaaaagcagattattatgttaacatcaggttacttaaggttctttttcttgtaagggttaaaacagaggggacttccttaccatgcaggctaaaactggcctgtttaggaatttggctaccatgtatcccctgcttttttatagatcagataaataatttagttttggtttggtgatgtggaactttagcatgaatgactccattttggtttggcttactggggcctagtggaggaactcagcccaaaacaatggtcttccataaattttatttaacatgctcttttaaccttaaatacttgaatgcgtatttcctaaacacaaggacattcttttatataatcgtagcataatgattaaaattaggaaattaacattgatagaacagtattctctaattacagacctgaagtgttaccagttatcctactaatgttctttatagcaaaatacagcatacgttggtggatacatcccaagacccctcagtagatgcctgaaaccacagatagtaccgaatcctatatatgctatttgcttttttcctatatataaatacctatgataaagtttaatttataaattaggcatagcaagagattaacaataataactagaaataaaatagaacaattttaacagtatgccaacatcactactcataggctttggggtcattattacataacattatggttacttgaacacaagcactgcaatatagagacaatacagagtcaagctgataatgagatgactaccaagtgactagtgggtgggtagcatatatagtgtggatatgctggacaaagggaagactcatgacctgggcagggcaaaatgggacagtgtgagattttattatgctactcagaatagtgtgcaatttaaaacttaggagttgtttatttctgtatttttccatttaatattttcagaccatggttgacagcagataaccgaagccacagaaaacaaaaccacaaataagggtggactgctatattttttcgtgtttcaagatccaatctaggatgtatactatacttacttattgcctctttaatcttttttattgtggaatacttcctcagcctttctatgtgttttatgagcagctattttatagaatattcctcagtttgagttttagggaaaattgtgaaaaacttcgaaatggaccaaaagattatcaggtatcttcaaaggaaaactagaagttttctagtataccctttcaaattatccgatttctatgtgagttctgaggctttcattgtattcatggattcatggtattttacaactctataggtcatataaaactgatagcaatgcaaatgattttttttttccatagaaatcgcaaattgcgtctggtggaatgcaactgattgccccctggctgttaatgttttcaattttttttgtatatatttctaaatgcatattggccattccttattttactgtatatgggtgagactttggattcttttttctgattggttataacatcttaccagttctgtcattaattactgagataaataaaatctttaacatatgttcattttatatgtcatgatgatatttgtcaaaagacaaaagcacaacaaatttagttttgttaaagcaaattaaatatggcctgaggaggcctctctacttctatatttgagtccttgtggatgaactgcaacctaacttaaaaggtagacaagactgaaaacctaacttaagaggatgctcctgtaacagtagttgattcttggccaatcccagcagccgtacttcaaccagtcatacactcctgagtgttcaaactgtgttcgaataaggcaaatgtggaactgtaaggaattcagttgtttctgtatgtcacttctgatttctgtgttacttccctttttttgtctataaatttgttctgaccatgaggcatccctggagtctctctgaatctactgtgattctgggggctgtccaattcatgaattgttcattgctcagttaaacccctttaaatttaacttgactgaagtttttcttttaacagtttaaagaccttacttggtgttatttgcagttctagaattgggcagcacttcattctataaaatagaataagtgttccaatgggctaaacggaggttggttttatagacaaagggctgaaaaaagcagaaaaaagaacaaaaagtggatcggtcattttaatgttaatttcctattaagggaggaatagggaaaaaaataatacaaaaataactggttggtcaacatcaggctacttaggttactttttgttgttaaaggcagagggaactttattgttacgctgactgagactggtctgtttgggaaatttggctattgtctctctctctctctcctgatttcttggaaagtcagataacaacttagttttggtttgctgatgtggaactttagtaccagtactacattttggtttggtctgttgggtctagtgcaacagcttagtctaaaacaatggcctcctataattttcatttaacatactttaaagaaatttctcccttaatgagtttgtgtaatatttcttcatggttagattcagcttatgtatttttaggaggaatacaacaaaagtgattttgtttctttagtacatcatatcaaaaggcacatgatgtatatgtcccatcaccaattctgttaacctaaatcacttaaggaggtgtctgctggtttttccactgtacagttactgttttctcttctgtaacttataagtatcttttggtgaaaaactttgagaatatattggtatcctatttcttaccaaattttcatttactgattttagcatccattgttgattcttgcctgaatcacttattactacaatgatctctaagtggtgattttctgtgttttttttttccatacttttaatttattaattggcattctactgtaaggaaatgcttttccttttcttccttttatatcactatggactcgggtttttattttattctatggattctaatgtttccattatttttgtatttattttgatgctcaattgtttcagggtcagatttgggcaatgggaacctcttcaggtgggtttctgtgtcattgcgacatgtcactatcattgagcacttccttactttctggtatagaaagatgtttcagatttatattgtgttgtttctttccagttctggaatcagccatttctttaaggaactgtaatttcttttgaaataaagatctgggcattagagatgcttattgctaatatgatagtaattatcccaggccatctcagcagataaagcactttgcttttttcttttaacatagtatttctggaagtcgctagatcaacatttctagaaatgatattcttttaaacagtttcattgcacttcattttggaaacaagtcagaatttattcaaacattctcctatgtaagagtgtttagattgtttccagtattttgcgattataaactattctgcaatgaatattatatatatatgtatatatatatatatatatatatatatatatatatatatagttggaggtgtatcttcagggcaaattcttagatagtggattgctaggtaaaaattaatgactatgtatttttgttagacaatgcccagttcccctctgaaagtgttgtaccaaatttgtattcccaaaacagtatataatagaagagtgcctgtttacccagaacctcaacatcagaatgcattgttactttttaattttaaccatctgatagtatctcagtgtagttttaatttgtatttctatctaaaagttaaggctgaacatcttttcatatgtttaagggccttttaaaaattttttcttttagagacaggtcaccctatgtggcctaagctagtctctaactcctggcctcaagcaatccttctgccttggcatccccaagtactgggattacaggtgtgggccactgtgcctggcctagggtcattatgaaactatcttttgttatgaattttctgtttataccttttttttttttttttttttgatggaatctcgctctgttgcccaggctggagtgcagtggtacaatcttggctcactgtaacctccacctccggggttcaagcaattctcctgcttcagcctcccaagtagctgggactgcaggcatgtgccaccactcctggctaatttttgtatttttagtagagacagggtttcaccatgttagccaggctggtctcgaactcctgacctcaggcagtccactcgccttggcctcccaaagtgctgggattacaggcgtgagccaccatgcccgacctgtttataccttttacacatttttctatcaaggctttggtctttttcacatggtttttaagaggctttttttttttaatgtaagggatattatctctttatctacaatatatgttattttctgtgcgttgttttttaaattttgtagtgtttttgccataaatgttttaaaacatttttatatagtcaactctatcaaattaaaaaaatttgcctctattttgagtcatattagaaaacctttcccttaagcctgcattatattgaaattcacttgtgttttcttctagttttctgtagtttcttttttacatttagactcctgatccatttggagattattattgtgtatggtgtaagatatggatctaattttaccttttcccagaagtctaaccaattgtactagcattctgtttttttatttttttatttttatttttttttttgagatggagtctcattctgttgcccaggctggagtgcagtggtgcaatctcagctcacggcaacctgtgccttctgggttcaagtgactcttctggcttagcctcccaagtagctgggattacaggcacgtgccaacacgcccggctaattttttgtatttttagtagagacggggtttcactgtgttagccagatggtctcgatctcttgacctcgtgatccgcccacgtcagcctccaaatgtgctgggattacaggtgtgatgtactagcattctttattaaaaatttacctttgtgggctgggtgcagaggctcatgcctgtaatcccagcactttgggaggccgagtgggggagatcacgtggtcaggagttcgagaccagcctggccaatatggtgaaaccccatctctactaaaaatacaaaaattatccaggcgtggtggcatgcacctgtagtcgcagctactcgggaggccgaggcagaagaattgcttgaaccagggaggcggaggttggagtgagtcgagatccgccactgcactccagcctaggcaacagagcgagactacgtctcaaaaaaaaaaaatttacctttgtgtcatgatttgagatgccaccatcatcatatattaaatttctatttgaatctgtttctggacatgatattattccactgaagtctgctagtctatttatgcactgatatctcactgttttcattacggaggccatatagtatgttttaatgtttggtaaggttactcctctctcaaaacagggtttttttgtttttgttttttctttttttagtgttttgcccactattgttacatatttgtttttcttttctttttttttttttgagatggagtttcactgttattgcctgggctggagtgcaatggtgcaatcttggctcaccgcaacctctgcttcccaagtttaagtgattctcctgcctcagcctcccgagtagctaggattacaagcacgtgccaccatgcccagctaattttgtatttatactagatacagggtttctccatgtcggtcaggctggtcttgaacttcctccctcaggtgatccgcctgccttggcttcccaaaatgcttggattacaggcataagccaccgtgcctggctacatatttgtttttcgtaaggtctttttagctaacttgtctatctccataagaaaagcttattggtattttttgggagatttagttgaatttgtaaattaactttgggagaactacatctttatgatgttgtatcatcttatccaaaacagggatatcttttcatttcttatttttttattttatttgagatggagtctcgctctgtcacctgtgctggaggctagagtgcaagtggcacgatcttggctcactgcaacctccgcctcctgggttgaagtgattctcctgcctccgcctccggagtagctgggattacaggtgcgtgccaccatgctgggctaattttttgtatttttagtagagatggtgtttcactatgttggcaaggctggtctggaactcctgacctcatgatccacccgcctcggcctcccaaagtgctgggattacaggcatgagccacagtgcccagcccgtttctttaagtctatttgtctttcaagaatgtttaaaaacttttcttaaatagattttgcacgtttattaagtttgtttgtaagcatttagtgttttttggtgctaacattaattatattttctttaccattctagtctctaattggtttttgttttcgcatatgaagtctactgatttctgtatattaatcttacatcctgttaccttagtgaattcttttattattcaagttggttttatcattacttctctgtggttttccagaaatttattactgacattataaggctttctgggggagcatggcaggttgcctaagctggtccaaaactggtttgaaagagcagggaaaggagactgacttggggtttttatgatggttagagggtagagccagggagaggatttctacatgtggtttggctggtggcaaaagagaggggctttttttttttatccctttgcttaatgttaggtagaaaggggaaagagggagagttaaggtctaaaagctggcagtagtcaaacatcaaaaatggaatcagactattatagtttctgatatatttggatagaggtctgcaaagtcatttcttatttaaaaaaaagtcttctgtttagtagtattttccctttgttatttttttattttgtacatttgtgctttatcccccatattattaattcattagctaatggcttattttgttaacttttttcctaaaaccgcaggctttgaatttttaggtctgctgtttttctactccccatatcattactttctgttcttatcttttttgtgtcattctttttgtttattttctagcttatggagctgagaatttagtttcctattatcatttttcatttttactgctaaagtgtttagagctatggagttttctgactgctttaaatgtatcccatatattttttatgagtagagcttttaatgttatcattatttttagattctatctttcacttcatttcccctttcacccaagagttgtttaaaagacacttaagaaatttgcaggtaggaagacctttttgttatttttcttgttaataatttctagttctattgcattgagtgttgtttgtattatttctactttatggaatttactaatgtttcattgtaaccaaatatatgatcagtatttgtgaatgttccatgtactcttgagaagttttattgcctattatcagggtaaaatgtttgatatatgtatacatccataaaatttactttatcaagtttattgagtcttttctctgtgtttttggactcattgatctactaaggtgtcttataatctcttattattaatgtatttctacctttatttccttacattgccttatagttttgccttatacaagtaattactgtttcatttgggatatttcttaactgccatgtcttcattttgatttgtggctctcagcattaagaaatatccttctggtaggctgaggcaggaggatcacttgaagccagaagtttgagaccagcctgggcaacatagtgagactatgcctctacaaaaaattaaaaaatattttagctaggcatggcagcatgcctctgtagttctgctgaggctgagaccacaggattgcctgagcccaggagttctaggctgcagcgagccgtgatcatgccactgcccattgaactttagcctgggcaacagagcgagtccctgtctctcactctctaaagaaaggtatccttctatgcacatttaatgtgtaagcttaaattctacaattttgatcaggattactacttgttttcttattgttttcatttgcctataatacctttgcccatttcttgatatttagtctttcggaatcaccttgttttagttatgtgtctagtattcagcataatacattcagtcctattttaggagcaaaattgcacatctttatgttttaatagttgaggctcattcacatttattaatgtgactaatatgtttgatttcagttctgtcatattattttatacaggttgagtatcccttatccaaaatgtttgagactagaagtttttcagatttcagatttattggattttggaatatttaaagatacataatgagatatcttggggatagcacccaaatctaaacatgaaatttatttgtttcatatacgctttattcacatagcatgaaggtagttttatacaatattttaaataattttatttatgaaagtttgtgttaaatacttaaatgtggaattttccacttataacgtcatgtctgtgcttaaaaagcttcaaattttggaatgatttggattttgaaattttgaattaggaatgctcaacctgtaattatatactatggtacattttatgtttttctttatctaccagatatttttcttttctcctttagttttgaaatttctgtggtatttaagaagatttatatttttgttttattggttacctttgtacttatattttaaaacacccttagaaaataggggaatattttcttatttaacttctactatctgctttgtcagtttttttttcccagtggtggctgttgaaaagcactaatattttatgtcattctatctcaaatccagacaaataacctcagttgtttcaacaaacttctctataaaatagaagaagctgggcagagagcagcaagatttatcaacagcatcattaaaattacccagtgcactaacattactaactatcctgacacaagctaaacacttaattacctaccatctctcattgcttgtgatgtattcttttttgttgttgttgttgagatggagttttgctcttgttgcccaggctggagtgcaatggcgcggcctctgctcactgcaacctccacctgggcctgtaatcccagcttgtgatgtattcttattcacctgcacagactggaaatgatattgaacccaggaactaagatacaatcataactaccatttattaaacacatacttcatgccagtgctgggctggacactgttccaaatgaccttattaatcttcccaacaaatctatgggatacatgtttctatcctatttaaaggagaatgagattaatgaatttcatcatgtgtagagaacagttttaagcccaggtctacctgactgcacaggccctgttctttgtttttgtttgtttgtttaataatatccttgtatatgcctgtactataacttaaaaaaaatcattgctttgtcagtttttttggtatcttttaacttttacctcttgcctatttagtaatcaatgagcttattctactttcctctttttctttcctacacttcacctttttttaataggtggactttttctttctagtagtagttttagattaatcttagttttggtggctcccttcttttctctttattttactcaattttcccttcctccccctcttcccctcccctctccctccctccctccctccctcccttccttccttcctctttcattctttcctttttttccaaagacaaggtctcatgttgcccaggctagagtgcagtggctactcgcaggcaggatcttgccgttgatcagtgcggcagttttgacctgctccatttccctcctaggttggtttacttctccttaggcaacgtgataatcccttggcccccacaggtcaccttattgaagcccaacttagtgcagacacctggacagcgtagcgcaccacagcccagaacttctaggctcaagcgatccttctgccttagcctccagagtagctggaactacaggcacacccagggcgtccggcttttttgcttaatttttgtttcactatgttttgtagttcactaatgttttgtagttcactatggtcttcttttctcccttcttcttttttccccctattatagataacttaaagtttggcatttcgtcttctagttatactgaagacaaagtttttgtatacttttatttgttcttgttttgttttttgaggatgtatagagaaagatttaggcagccgcatctaccaggtagtccagtagatgtattttgagtgatatgctagcgatatcagttattgtctccctgctgcaatcttttgttctcatccacagcctctgctgaaggagtaaacacaagtgaccatatttgtaactaaaacaagtgaccttatttttactaaatgacctcaccctttggccacagatgaatttatctttcctgtatggatacaggacctaaactctgccaagctgattatatcttttgagaatttgaacgaaaggacacagaaacgtaatcagttagtataggatgctggagctgttaagtcttgtagagtcaaggccacagtgtcatgaaaactgaaggtatggaggagcagaaactaagaggttcacagaagtaggtggaatgcagagtactcagcagagagaagtttataatggtgtctttggagcaacaagagaatgaggcaggaagagagccaaagaaactggtataaacagtttctgatgactattcaattcccaagagacgagcttgaataacttccaacaatattcaacatatttttctattattttattacattttcttgaggttttttgggtgtgggtctctgtttcttaattaattaatttcctgaatatattaggctttaataaatgtttatcatcctggtgttattacccagatacaatatgatgtgggactacaaataatgagggctattcacagaattgacttgagataatttgagagtatcaagttattaaatatattacaagaattttggatctggaagggacctatgaggaatatctagttcaaattctcaaattttagggaagagaggccaagagaaaatgatttgccgaactttgacattgaattagaggtctcattagaattagaactgtggtttcctgatacccagtctagttttcatttgactacatgttctgagttagacagtataaccccccaaattcatatctacttgaaactgcagaatatgaccttatttggactagcatctttgcaaatgtaatgaattaagatgaggtcgtactcaattagagtggatggactttaatccaatatgactggtgtccttacaagaaggaaaaacagacagaatgccatgtgatgacacggcagagattagagtaataaagctgtaagccaaagaacaccaaggattgacggctgctaccagaaggtagaaagaggcagggaagaaatgattctcctctacagctttcagaggtactactgacctctggttttagacttctggctgcagaattgtgattataaatctctgttgtgttaagccatccagtttatagttcttcgttatgacagccttaggaaaccaaatatactaccgcatggtacacttttaatgtaaagagattcttccctgaatgtcaccaaaaaagtatacagaaactacattcttcaaaagggaagaaaatagctttttctgttgggtatatcaatcttaacttttaaattcttcagtgtgcttagctatacttttgtgccatttagagattacagtattgttcatcttgggattttcaaggaagtatgtcactaggaaattttgcttttattcttttaaggaataattaatggtggcaggcatatggagtgtgtgtgtgtgtgtgtgtgtgtgtgtgtgtgtatgtatgtgtgtgtatgttatgttacggattttctgttatatgatattctgaaatattgtacttttattttcaggttactgaagctaaaggagatgtttaactccaagtttggatctattcccaagttttatgttcgagcaccaggaagagtcaacataataggtatttcaaaagttccttctcttaatttttttcttcatcctttgataagatctaaatttttaaaaatatatttctttcttaatttttcccaaaatagaatatttcacatgtatctactaatagtaagatgtgcctttgcataaggaacacactttacttttatctttcccaatccatgttattagtattgttcatttgttttttaaatgtattaatttgttgaaaccaagttgttaatattgttttcataaaaaatgaaaatatttttctaggccacaggttaaaattttagactgtggtaagtagttttgatggttttatatttactcactgggttagaggagcacagggaaaccttaaaattccttgctactaaaagtgtggtccagaatttgcagcccttctagatgaatttatctttccttttgtttatcctgtgaagtactttgaattttactaccttttagtggtaaataacacaacctttcaacattttgtttactatcattttatcaatgtccctatatataataattgacatagttgtacttagactacataccatttgtatctttttttcatttaatatatcataaatatttccatgtatctatttccattttctgctggtataacagaattccacagatggggtaatttatcaacaatagaagtttatttggcttgtgattctggaggcagagaagttcaatatcatggtactcacatctggtgatggccttcttattgtgttattctcttttttttctgagatggagttttgctcttattgcccaggctggtgtgcaatggtgcagtctcggctcactgcaacctctgcctcccgggttcaagtgattctcctgcctcagcctcccgagtagctgggattacaggcatgtgccaccatgcctggctaattttttgtatttttagtagagacagggtttctccatgttggtcaggctggtctcgaactcccaatctcaggtgatccacctgccttggcctcccaaagtgctgagattacaggcgtgagcctccacacctggcctcttgtgtctgttaactgacctctccctacctgcccttcctgccctcactacatgttatccttcccagcctctagtaaccattaatttatcctctatttttatgagatcaactcttttagcctccatatatgagtgagaacatgaggtatgtatctttctgtgcctgacttatttcacttaacataatgtcctctaagctcatccatgttgctgtgaataacaggatttcactcttttaggtggctgaatagtattccattgcacacatacaccacattttaaaaatccattcatctgtgaatggacatttatgttgattctgtatcttgactattgtgaatagttttgcaataaacaagagagccacatatctctttgacatactgatgtccttttctttggatatatacctagtaatgggattgctggatcatatggtggttctatttttagttttttgaggagccttcatactgttttccatatggctatactaatttactttcccaccaacagtgtagaagaattcttatttctctgcattctctctaacacttattattttttgtctttttgataatagtcatcctaactgaagtgagataatatctcctggtggttttgatttgcattttcctgattattagtgatgttgagcatttgtctatgattgtaagtcatttgtatgtcttctttttagaaatgtctatttagatcatttgccaatttttattttattttattttattaatttatttattttgagacagagtctctctctgttgcccaggctggagtgcagtggcacgatctgggctcactgcaacctccacctcctgggttcgagcaattctcctgcctcggcctcccgagtagctgggactacaggcacgtgccaccatgcccaggtaatttttgtattgttagtagagatggggtttcaccatgttggccaggatggtcttgaactcctgacctcagatgatctgcccaccttggcctcccaaagtgctgggattacaggtgtgagccaccacaccgagaccatttgccaattttttaattggaatatttgttttactactgttgagttaagttttttatatattctggagattaattccttgttcggtgaatagtttacaaatattttatccctttcaacaggttgtctcttcactctattggaaggtttcctttgctgtgcagaagctttttagtttgatataatttcatttgtctatttttgtttctttgcctgtgcttttatagtcttattcataaaatctttgcctagaccaatgtcttgaagtgtttcctttatgttttcttctagtagtttcatagtttcagttctgatgtttaagtctttaatccattttaaattcatttttataaatggtgagatattggggcctatttttattcttttgcatatggatatctagtttttccatcaccatttattaaacagattgtccttttccctatgaatgaaagtaactttgttgaaaatcatttggccttggccaggcatggtggctcacacttgcaatcccagcactttaggaagccgaggagggtggatcacttgaggtcaggagtttgaaagcagcctggccaacatcatgaaacctcgtctctgctaaaaatacaaaaattagctgggtgtggtggcacacacctgtaatcccagctacgcagggggctgaggcacgagaatctcttgaatctgggaggcggaggctgcagtgagccgagatcaaaccactactgcactccagcaggattctgtctcaaaaaaaaaaaaaaaaagaaaatcagttggctgtaaatacatggatttagctctgggttctctattctgttctattggtctgtatgtctgtttttacgccaaaaccatagtattactgtagctttgtagtatatttgaagtcagatagtgtgatgcctccagcttttcttttcttcttcttcttcttcttttatttttttttttggctcaggattgctttggttttttggggtcttttgtgattccatacaaattttagaattaatttctgtgaagaatgtcattggtatcatacgaggaattgcattgaatctgtagtagtatggtcattttaacaatattaattcttccagtccaagaatgtgggatgtcttcccacttttttgtatcctcttcaatttctttcatcagtgttttattgttttcattgtacaggtcttttatcaccttggttaaatttattcctagatattcattttttttagctatttcaaatgggattgcttgcttgatttctttttcaggtagtctgttattggtgtatagaaacactagtgattttaaaaattttttcaaagtacttttatttattattttaaaatcttatttttccataagttattggggtacaggtggtatttggttacatgaatacattttttagtggtgatttgtgagattttggtgtacccatcacccaagcagcatacactgcactgtatttgtagtcttctatcccgcgctcccctcccactcttcctcacaagtccccgatgtccattacctaattcttatgcttttgcatcctcatagcttagcccccacatatcagtgagaacatacaatgtttggttttccatttctgagttatttaacttagaataatagtctccagtctcatccaggtcactgcaaatactgttaattcattcctttttatggctgcatagtattccattgtatatataccacagtttctttatctacttgttgattgatgggcatttgggttggttccgcgattgggttggttccataataccaatgacatatagtggcaattgtgaattgtgccactataaacatgcgcgtgcacatatctttttcaaataatgacttcttttcctctgagtagatacccattagtgggattgctggatcaaatggtagttctacttttagttctttaaggaatctccacactgttttccatagcagctgtactactttacattcccaacagcagtgtagaagtgttccctgttcaccacatccacaccaacatctactcttttttgatttttagattatggccattcttgcaggagtgaggtggtatcacattgtggttttgatttgcatttccctgatcattagtgatgttgagcatttttccatatgtttgttggccatttctatatcttcctttgagaattgtctattcgtgtccttagcccactctttgaatgggatggtttgtttttttcttactgatttgtttgagttcattgtagattctggacattagtcctttgtcagatgtatagactgtgaagattttctccaactctgtaggttgtctttttactctgctgactgttccttttgccatgcaaaagctctttagtttaattaggtcccagctgtttatctttgcttttattgcatttgcttttgggttcttggtcatgaaatccttgcctaagccaatgtctagaagggtttatccaatgttatctgctagaatttttttagtttcatatcttaggtttaagtccttaatccattttgagttgatttttgtgtaaggtgagagatggggatccagtttcattctcccacatgtggctagccagttatccccgcacaatttgttgaaaagggtgtcctttccctactttttgattttgtttgctttgttgaagatcagttggctataagtatttgggtttatttgtgcgttctctattttgttccattggtctacgtgcctatttttatactagtaccacgctgttttggttgactatggcctaatggtatagtttgaaatcaggtagtgtggtgcctccagatttgtttctttttgcttagtcttgtttttgctatgcaggctcttttttggttccatatgaatttttatttatttatttattattattatactttttttagggtacatgtgcacaatgtgcaggttagttacatatgtatggttccatatgaattttataattgttttttctaagtctgtgaagaatgatggtggtattttgatggggactgcattgaatttgtagattgcttttggcagtatggtcattttcacaatattgattctacccatccatgagcatgggatgtgtttccatttgtttgtgttgtctatgatttctttcagcagtgtttcgtagttttccttgtagaggtcttttgactcctttgttaggtatattcctgagtattttattttattttttatttatttattttttgcagctattgtaaaaggggttgagttcttcatttgattctctggtcgctgttggtatatagaagagctatatttgtgtacattaatcttgtatctggaaactttgctgaattcttttatcagttccaggagctttctgaaggagtccatagggttttcaaggtaaacgatcgtatcatcagcaaacagtgacaatttgagttcctctttaccaatttgaatgccctatatttctttctcttgtctgattgctctggctaggacctccagtaccatgttgaaaaggagtggtgagagtgggcatcttagtcttgtcccagttctcagagggaatgctttcaactttacctcattcaatattatgttggctgtgggtctgtcatagatggcttttattacattgaggtatgtcccttttatgtcaattttgctgagagtcttaatcataaagcttgctggattttgtcgaatgctttttctgcatctattgagatgatcatgtgatttttgttttctattctgtttatgtggtgtatcacatttatagacttgcctatgttaaaccatccctgcatccctggtgtgaaacccacttgatcatggtagattaactttttgatatattgttggatttggttagctgggattttgttaaggattttagcatctatgttcatcaaggatattgaactgtagttttctttcttggttatgtcctttcctggttttgatattagggtgatgctggcttcataaaatgaattcgtaaaatgaattcggaaaggttccttctttctctatcttgtggaatactgtgaaaaggattggtttcaattcttctttgaatgtctgatagagttctgctgtgaatctgtctggtcctgtactttttttttgttggtaatttttaaattaccatttaaatctcactgcttgtgattggtctgttcagggtatctaattcttcctgatttaagctaggagggttgtatttttccaggaatttatccatctattctaggttttctagtttactcatgtaaaggtgttcatagtcgccttgaatgatcttttgtatttcagtggtatcaattgtaatatctcctcttttgtttcttagtgaggttatttggattttctctcttcttttcttgggttaatcttgctaatggtctatcaattttcttttctttttttgagacggagtctcgcttttgtcacccaggctggagtgcagtggtgtgatctcagctcactgcaatgtccaccacccaggttcaagcttctcctgcctcagcctgagtagctaggattacaggcacccaccaccatgcccagctaatttttgtacttttagtagagacgagatttcaccatgttggtcaggctggtcttgaactcctgacctcaggtggtccacccgcctcagcctcccaaagtgctgggattacaggcgtgagtcactgcgccggcccaattttatcttttcaaagacccatctttttgtttcatttaccttttgtattttgtttgtttgtttgtttcaatttcacttagttctgctctgatattggttatttcctttcttctgctgtgtttgggtttagtttgttcttgtttctttagtttgttgaggtgtgaccttagattgtctgtttgtgctctttcagactttttgatgtaggtgtttagggctatgaactttcctcttagcactgccttagctgtatcccagaggttttgataggttgtgtcattattgtcattcagttcaaagaagtttttaatttccatctggatctcatttttgactcaatgctcatttaggagcaggttatttaatttccatgtatttgcatggttttgaaggttccttttatagttgatttccagttttatttcattgtagtttgagagagtgcttgatataatttcaattttcttaaatttattaaggcttgttttgtggcccatcacgtggtctatcttggagaaagttccatgccctgttgaaaaggatgtgttttctgtggttgttggatgaaatgctctgtatatatgtgttaagtccatttgttccaaggtataggttcaatccattgtttctttgttgactttctgtcttgatgacctgtctagtgctgtcagtggagtattgaagtcccccactattattgtgttgctgtctatctcatttcttaggtctattagtaattgttttataaatttgggagctctagtgttaggtgcatatatctttaggattgtgatattttcctgttggacaaagcctttttaccattgtataatatccctctttgtctcttttaactgctcttgctttgaaatttgttttgtctaatataagaatggctacctctgctcgctttggtgtccatttgcatgaaatgcctttttctacccctttactttaagtttatgtgagtccttatgtattaggtgagtctcctgaaggcagcagatagttggttggttagtccttatcctttttgcggttctctatcttttaagtggagcatttgggccatttacattgaatgaaacactagctatttttaatactgattttgtatcttgcgactttactgaatttatcagctctaaaagctttttatggtttttaggtttttctacgtataagatcatgttgtgtacaagtagagaccatctgacttcctcctttccaatttggatgccctttacatttttctcttgcctgattgctctggctcagacttccagtactattttgaataagagtggtgaaattgggtatgcttgtcttgttctagtgcttagacaaaaagctttccatttttcctcatttggtatgacattagctatgggtttgtcatatatggcctttattgtgtattgagacatgttccttctgtacctagtatgttaagagtttttatcatgaaagaatgttgaattttatcaaatgctttttctgaattgattgtaaagattatatgggttttgtccttcattctgttgatgtgatatatcgtatttttggatttgtgtatgttgaaccccttccttgcatttctaggattaatcccacttgatcatggtatataatctttttatgggctcttgggttcattttgccaacattttattgaggatttttgattatatgttcaactgagatattgtcctgtagttttctttttctgttgtgtccttgttcagttttggtatcagaataatgctggcctcatagaatagtttcaaagaattccccgcctttcaatttttttgcaagtctgaaaagaattggtgttagttcttctttaaaggtttggtagaattcatgggtgaagccctctggtcctgagcatttcttcgttgggagactttttactgttgcttcaatcttgttacttgttattggtgcgttcaggttttctatttctacctggttcaatcttcttaggttttatgtgtccaggaacttatgcatgtcctttaggttttgcaatttgttggcataatagttgttcacaataggctttaatgatcctttgtattttgtggtgtcacttgtaatgtctccttttctgttttttttaattttatttatttgtgtgttctctttttctcagtctagctaaagatttgctattatgtttaccttttcatttcattaatttttgtctcaaatttacttctgctctgatctttattatttctttccttctactaattttggatttggattgtttttgctagagatgtaccattaggttgtttatatgcaaaatttctacctttttttttagtggctgatttattttattttattttattttattattattatttttttgagatggagttctgctcttgttgcccaagctggagtgcaatggtgcgatctcagctcactgcaatgtctgcctcccagattcaagtgattttcctgccttagcctcccaagtagctgggattacaggcacccaccaccatgcttggctaattttttgtatttttagtagagacagggtttcaccacgaaggccaggctggtcgcgaactcctgacctcaggtgatccacccgcctcggcctcccagagtgttaggattacaggcgtgagtcgccgtgcctggtctattttattttatttttaactttcgagatgtagtctcgccctgttgcccaggctggagtgtagtggcacgatcttggctcactgcaacctgcacttcctggactcaagtgattcttgtgcttcagcgtcctgagtagctgggattacaggcatgtgccaccatgcctggctaatttttgtatttttactagagacggggtttcccaatgttggctgtcacacacacacacactcacacacacacacacacacacacacacacacacggccttttcatttctaccacatggctgggcttcaatttttcaaacttgttcactctgcttcccttttaaatataaattccagtttcaggtcatttctttgcttatgcataagagcataggttgttagaagcagccagactacatcttgaatgctttgctgcttagaaatttttttcaccagatatcatcactctcaagttcaaagttccacaggtccccagagcaggggcacaatgcctccagactctttgctaaagcataacaaaagtgacctttactctagttctcaaaaagttttgtattttcatctgagacctctttagctgggacttcattgttcatattattatcagcattttggacacaaccattcaacaagtttcttggaagttccaaactttccctcatcgtcctatcttttttctgagccctccaaactgttccaacctctgccacttacctagttccaaaggtgctttcacattttcaggtatctttatagcaatgccccacttctgataccaattttctgtattaatctgctcttgcactgctataaagaagtatctgagactggataatttatttaaaaaaagaggtttaattggctcacaattttgcaggctgtacaggaagcatggctgggaaagcctcaggaaacttacaagcatggtggaagacaaaggggaaggaggcacgccgtacatggctagagcaggaggacgagagggaggggaagtgctatactcttttaaatgatcagatctcatgagaactctatcatgagaaccacactcaggagattgtgttaagccattagaaaccacctccatgattcaatcaacacccaccaggcttcacttccagcattaggtattacatttcaccatgagatttgggtggggacacagatccaagccatatcatatgggtctaggcattgatccctttcttcttggttttctaatttgttggtatatagttgctcataatagtctctaatgatgccttgactctctgctatcagttataatatctttaaaaaaaattatctgactttatttatttgaatcttctttattttttactttttcttttttgtttgaaatggagtctcgctctgttgcccaggctggagtgcagtggcgctatctcaactcactgcaacctccacctctcagattcaagtgattgtcctgcctcagcctcccgagtagctgggattacaggtgtccacgaccatgcctggataatttttgtatttttagtagagatggggtttcaccctgttggccaggctggtcttgaacgcctggccttgtgatctgcccaccttggcctcccctcccaaagtgctgggattacaggtgtgagccagtgcacctggcctcttttttacttagtgtggctaaaggttttttgatttagtttatgtttgcaaaacaccaacttttaatttcattgatttttttttgtagttttaaatttcaattttacttatttttgctctgatccgaattcttttcctctactaattctgcatttcatttgcttttgcctttctcatttgttaagattcatctttaggttgcttatttgacatatttctacctttttgatgtaggtgtttattgttttaaatgtgcttttttgtactgctctttctgtatcatggagattttgatctgttgtcttttcactcccaattgtttcatgaaatttaaaaatttcttaattttttcattggcccactggtcattcaggagcatattttttactttccaagtgtttgcttagtttccaaagtttttcttcatgtttatttctaattttatttcattatgatcagagaagttacttgatattattttaacttttttgaactttttgagacttgttttgtggtctaacttaagatctatcctggagaatattctgggcactgatgagaagaatgtgtattctggggctgttggatggaatgtttttataaatatccatttgttctatagtgcagattaagtctgatgtttctttgttgattttctccctggataaataccctagggctgaaagtgaggttttgaaatccccagctattattctataggcatctatccttctttttagttttaataatatttgttttacatatctgagtgctccagcattgggtgcacatatatttacaattgttatatcctgttgctgaactgactcctttgacattatataatgaccttcgtctctttttatagtttttatcttgaatcctgtttatttatgcataactactcttgctctcgtttggttttcatttgtatggagtatctttttcttttttaaaaaattttactttaagttctgggatataaatgcagaatgtgtaggtttgatacctaggtatacgtgtgccatggtggtttgctgcacctgtcaacccattgtctaggttttaagccccgcatgcattagctatttgtcctaatgctcttcctccccttcccctccaccccacaattggccctggtgtgtgttccggaatatctttttctattttattttattttttttggtctgcatgtctttattgatgaggttagcttattgtttttgtttttataatccattcatccactttgtcttttattgggaatttagtccatttatattcgatgttatagttataaggtacagacttactactgccattttgttatttattttctggttgttttgttggtcctctcttccttccttcttgtcttcctttgtgtaaaagtgactttttctgacaatgttttaatttattatttaaaactttttttgggctgggcatggtgcctcacgcctgtaatcccagcacgttggcaggtggaggcgggtggatcatggggtcaggagatcgagaccatcatggctaacacggtgaaaccccatctctactaaaaaataaaaaaagatttagctgggcatggtggcgggtgcctgtagtcccagctactcaggaggctgaggcaggagaatggcatgaacccgggaggtggagcgtgcagtgagctgagatcatgccactgcactccagcctgggcgaccgagcaagagtctgtctcaaaaacaaacaaacaaaaaaacccaactttttttgtatctgttacaggtttttgttttgtggttactgtgaggcttgcaaataacataaccaattattttaagcagatgacagcttaactctgattacaatgaaaataaaaaagaaatcagcaaaaagaaaacaaaaaaaccccccaaaactttaccttaaccccatttcttcactttgtcactttttttttttttttttgagatggagtctcactctgtcacccaggctggatacagtggcgtgatctcggctcacttcaacctctgcctcccgggttcaagcgattctcctgcctcagcctcccaagtagctgggactacaggcacctgccaccacacccggctatttttttttttttttttgtatttttagtagagatggggtttcaccatgttagccaggatagtcttgatctcctgacctcgtgatcttcctgccttgtcctcccaaagtgctaggattacaggcttgagccaccatgcccggctgctttgtcacttttgattgtctctgtttatatctttttatgctcagaaagctgtttcagttactatttttgataggtttgtcttttaatcttcctactaagatatgagtgttttaacactatagttacagtgttagagtattctgtattcattcatctgttcatttaccactaccagtgagttctgtaccaccatgtgatatatatttttttacattaatgtgcttttctttcagattgaataactctctttaacattttttgcaagacaggtctggtgttgttgaaacccctcagctgtgtttgtctgggaaagtatttctctttcatgtttgaaggataattttactggaaataatattctagttcaaaagttgtttttcttcaacactttgaatatgtcatccccctctctcttggcctctaagtttcctgcggagttgtctcctactagacatattggagcccctttatatgttctttgcttcttttctttttctgcttttaggatactttctttatccttgacctttgagagtttgattaatatattaactgagttagtcttatttgggttgaatccttttggtgttgtgtgatcttcttataccttaatatttatatcttttcttaggtttggaaagttttctatcagtatttcactgaataaactttctaccctgatctctctatctctacatcctctttaaagccaataactcttagatttgccccttttaggctattttctagatcttgtagagaggcttcattcttttaaaattatttctcttttctctcctctgactgtgtatttttatatagcctgtcttcaggttcactatttatttttcttgatcgattctgctgttgagagactctgagacatttttgagtttgccagttgaatttttcagctgcagaatttctgtttgaaatttcaaaaactattttaatctctttgttaaatttctctggtagaataatgaatttcttccctgtgttatctttaagtttgttgagcttcctcaagacagttcttttgaattctctgtctgaaaggacatacatctccatctttctgggattggtcactggtgtcttctgtagttcatttaatgaggtcatgttttcctggatactcttgatgcttgtggacattcatcacttatgggcattgacaaattagatatttatttgtctgtgtagtctgggcttgtttgtacccttcattcttgagaaggcttttcatgtattcaaatgggattgagtgtgttgtgctctaagcctgtggtccgtatgggcatatcggcacaaggaggtgctctaagcccaggaatgctgcaattcttcctgacatctagaggcactgccttgacgagtttgggtaaggtaaaggagaattccctgggttgtcaggcaaagtcctcttgatatcttccctttactcctcccagtcagaagtagtctgtctccatactgggctgcctagagcacttccatggcttccacagctggcactgtgctaggtcacacctgaagcctgtataatactggatcttgcctggttactgctgatgtttattcaaggcccaagggatctttagtgagcaggtgaatcctgccaagactgggttcttctcttcagggcagtggattccctctgaatgagagtgggtccaggaactaagtcctggaattgacagcttcaggaatctccttggtgctttacttcgactgagctggtacccaaattgcaagacagtcttctgtactcttcccacttctttccttaagctaaaggaatctctccccaaactgcacttcctggagttgggtgcagtgcgatcaggcactcccctggctgccacagctggtgtcacacttggtcacacatcacaagtctactgcctccaaggccggtgcagtaccagggcttgcccgaggactgcagtacttgtggcctgacagccacttaagcttattctgggcactaggccagtttagttagccagaggtgaggttggttgggactcaggttcctcctgctgagattgagaattctgtcttgcccagggctgatctaaatgccccctccttgggtgctagcagagttctgctgttttgtgtttttctgtaacatggctgcactaagttccagtgcaaagacccacactcacttcaccctccctcccccaaacacagtttctctgtccatgctggaagggatcctgtaggcaatgcaagactgtctttcctgtcctcttcaattcctctatccctgatgttatgttaaaaccaggtactgtgattttcaggtactcacctgaattttctgggttcttatgaaggtgtttattgcatagatagttgctcaatttggtgtaagatcatggaagggttctatttggccatcttgctctgcttccctttatttttatttactgttaaaacctggctcatggtcagttttttcctgtatgtaaactttcttgaggtgcttttgttttatatattagcaatgattaaaaaagctttctcttttttctaggagagcatatagattattgtggatattctgttcttcctatggctgtagaacaagatgtgctaatagctgtagaacctgtgaaaacgtacgctctccaactggccaatacaaatcccttgtatccgtgagtatttaaaattgttagtgtgtgtgtatgtatggttctgtttgtacccaaatgaactctttaggagacatcaaatttgtaacaggtcatttaacttattgatattttgtgtctgacattaaaaaaattctaaggccattatttattgttcattttgttcatttgtcaattcatttaaggaatatttatcaaagacttatcatgtgctagacatagtcttagataccaggtgatacaaagataaataactctgtccttgtccgataggtacttatcatctattgatctaattatctccagcaaagtcaggtctgatgttttcctatgttactatggcaccttctaagtatcttgtcatagcatattattatgctgtattattattatctgtttatttacctgtgtcacccagtagactgtaaactctgtgacttcaggcattgttgcctctcttcttcaatgccctagcatataaaacagagtctggtgcctaatagaggtaagtttctagtacatatgctttatcaagttaacaaagtctttaaaaaaaatcttagtttgctaagattaaaaaagtttactaatgggtattgaatttaattaaatgtctatttagaattgaagatcagtttttttaaaaatatggtgaattagtctgacgaattttctaatgttgagccctttttgcatttctgggataaactctacttgcttctaatgtattataatggatttgacttgataattacagaaaaagattttggcttgtatttggcatattatatgtttggcttgttcattggttagtttatctgcaataacattcatgtattcggaaaatatttttgataagactctataccagtttgtgcaagacgtagaagttttttacttttatatggaacttactgtagaagatctttttttccttttcatttcgcatgtttgataatatatcttgtgtgcattttggacccttgaaaagctcacattatgtcaagcatattttcgtgtcattgtgtatgaacatttaaaaatcggtgcatagtattttgtcatcttgatttagtaaaatttacttaatcattcccacaataatgaatatgtggtttcagtttcgtttttcacaaaagtagatcctgagacagacctggatgaaggtagtatatttgagaaatggtcccaggagcagtaggaaagagcatgaagaatgagttgggcaattagaggtgaattatcaagacatatagtccctgctagaggcaggaggcttgattctaccaggacccctaggaagcatgcagtatgcctcctagaattgtccatttgttttagcattcattgtgtaagtatatcttaatttgtttgtttaccaataatggacatttagatcattcccagtttttgcctgtatgaataatactgctacaaatatttatgtacgaatatatgtgtggacatatgtttcatttctgttgggtaaatacctatgattggagtgtctggtttgccatttatttatttattgagacagggtctcaccctgttgctcagcctggagtgtagtggggcgatctcagctcaactcaacctctgcctcccaggttcaagagattctcccacttcagtctccggagtagctgggactacaggcacatgccgtcacacctggctaatttttgtattttttggtagagatgggatttcaccatgttgaccaggctggtcttaagctactgacctcaagtgatccacctgcatcagcctcccaaagtgctgggattgcaggtttgagctactgcatccgtcctggtttgcctttgatatggtttggtggtgtccccacccaaatctcatcttgaattttaactcccacaattcccacgtgtcctgggaggaacctggtaggaggtaattgaatcatgggggcaagtctttcccatgctgttcttgtgataatgaataagtctcatgagatctgatggttttaaaaatgggagtttccctgcacaagctctctttttgcctgacaccattgatataagacgtgacttgctcctccttgccttctgccatgattgtgaggctcccgcagccatgtggaactgtaagttcattaaatctcttgcttttgtaaattgctcagtctcaagtatgtctttatcagcagcatgaaaatgaactaatatagccttttaaagaaattttctggctgggcacggtggttcacgcctgtaatcccagcattttgggaggctgaggtggatggatctcttgagcctgggagttcgagaccagcctgggcagcatggcaaaagcttgtctccactaagaatacaaaaaaattagttgggtattgtggcatgcacctgtaatcccagctactcaggaggctgaggcaggagaatcacttgaacctcggaggtggaggttgcagtgagccaagattgcgccactgcgctccagccagggtgacagagcgagactctgtctcaaaaaaaaagatattttctgcttgccaaagttgtataattttacattttcaccagtggtgttactaacatgtcttaaaattttagctattctcataaatgtgtagtagcatatttcaagtttttaaatttctctgattaatgatgttgaacatcttttcatctacttatttgctacctagatatattctttgttgaagcgtcttctcaaatcatttccctatttttgagtttcttatagatacaagtcttttttttttttttttttttgagacagagtcttgttctgtcatttctgtgttgggacattacaggtcctttcttctaggtattttgaaatatacaatacatggttgataactatagtccccctactctgctatagaccattagaacttattccttctatctaaccgtatgtttttacctatttgccaacctctttttatcccccgttcactgaccattcctcacctctattatctattattctaccctgtaccttcatgagatcagttttttaagttcccacatatgagtgagaatatctgatgtttgtttttctgtacctggcttattccatccacattgctgcaaatgacatgattttattttttttatggctgagtagtattccattgtgtatatatacattttctttatttattcatctgttggtgggcacttaggttgattccctatctttgctattgtgaatggtactggaataaatatggagtgcaggtatccccttgatatactgatttcttttcctttggataaatacgcagtattagggttgctggatcatatggtagttgtgtttttagtgctctgagaaatctccctactgttttgtataatggctgcactaattacattctcaccaacagtgtataagtgtttccttttttctgtgtccttaccagcatctgttttctttagtcttattagtaatagccattctaacttgggtaagatgatgtctcattgtggttttgatttccattttgctgatgattagtgatggtaagcagttttcatatacctatctgccatttgtatgtatgtctttggaaaaatgtctcttcatgttatttgtccacttttaaatgggattattactagtttttactatcgagtgttttgagttccttgtatattttggatattagttccttgttggatgaatagtttgcaaatattttctcccattcaacaggttgtctccccactctgttgattgcttcctatgtgggcagaagctttttagtttaaaatagttttatttatctatttttgttttatttttctgtacttttgagatcttagtcataaaatctttggctatatcctaaagtgtttcccctatatttctttctagtagttttatagttgtgggtgttatgtttaagtctttaacctatcttggattgaattttgtatatggtgagaaataggggttcaattcattcttctgcatatgggtattgagttttcccagcaccatttattcaagagggtgtttgttcctgaatgtattttcttggtacctttgttgaaaatgagtttgctggccgagcgtggtggctcatgcctataatccctgcactttgggaggctgaggcaggcagatcacctgaggtcaggagtttgagaccagcctggccaacatgatgaagccctgtctctattaaaaatacaaaaaattagctgggtgtggtggtgcgtgcctataatcccagctactcaggaggctgaggcaggagaattgcttgagcccaggaggtggaggttgcagtgagccgagatcgtgacactgcactccagcctgggcaacaagagcaaaatctctgtcttgaaaaaaataaaaaaattaaaaaaaaaagaaaatgagtttgctgtacatacatggatgtatttctgggttctcccttctgtcccattattacttgtgtctgttttgataccaataccttgctgtttgggtttttatagccttataatatattttgaggtcagatagcgtgacccctcttgctttgttctttttcctcaggagtgctttggctatttgggctcttttttttggttttatacatattttaggatatttttctatttttgtgaaaatgacagtagtattttcatagggattgcattgaatttgtagactgctttgggcagtatgttcattttaacaatattaattttttccaatccatgaacatgggatgtcttttcatttgtttgtgtcctcttcaatttcattcatcagtgttttctagttttccttagagatctttcatctccttggttaaatttattcttaggtatttttttttgtagctattataaacagcatttctggcttaatttctttctcagctagttcattattgatgtattgaaatgctgcaaatttttgtatgttggttttttatactgcaactttactgaatttatttattaggtgtaagagttttttttagagtctaggtttttctggatataaaatcatgtcacctgtgaaacaggacaatttaacttcctccatttcaacttggatccttctatttttattcttgcctgattattctggctaaaatttctagtattatgttgactaggagtagtgatattggtcatcttttttgggttccaggttttacaggaaaggcttcaacttttctttatttgatatgatgttagctgtgggtttgtcatatgagacttttattgtgttgtggtatatttattctatgcctgataattgagagtttttatcgtgaaaggatgttgaattttattacatgctttctctatgtctattgagatgattatgtggtttctgtcctttattctactgatgcgatgtgtcacatttagtgatttgtgtttcttgaacaatccttgcatccctgggataaatcccgcttgatcatggtgttttatctttttgatgtgctgtgggattcagtttgcggcaattttgttgaagatttttacatatatgtaaatagggatcttggcctgcagttttggtttttgttacacctttctctaattttagcatcagagtgatgcttgccttttgggactaggttaattcccttctcttcaattcattggaattgtttgaagaggattggtatttgttctttgtaagtttggtagaatttttcagtgaagctgtccagtcttgggcttttctttgttggaagccttttcattttactgtttcaatcttggtacttgttactagtctgtttatgttttttgtttcttcctgatttaatcttggtatgttgtgtgtttaggaatttatcaatttcctttaggttttctggtttgtttgtgtatagtatagttgttcataacagtgtctgataagcttttgtatttccatggtatcagttgtaatgtccttttttgattctgattttgtttatttgggtcttctcactttttttcgtggttaatctggctagcagtttatcaattttgttcttcttttcaaataatcaactttccattttcttgattctttgtattttttcagtaaaataatttcaacttttattttagattcaggggttacatgtgcaggtttgttacttggatacattttgtaatggtgatgtttggggtacagatgatcccatcacccaggtagttagcatagcagccaataggcagtttttcagcccacacttcctgcctccctactgcccccgccattgcttactagtcctcagtgtctattgttcccatctttatgtccctgtgtactcatatttagctcccacttataagtgagaacatgcagcagtacttgattttcttcctgtgttaatttgcttaggactatagcctccagctgcatccatgttgtcgcaaaggatatgatttcatcctttttatggctgcatagtattccctggtgtatgtataccacagtttctttatccagcccaccattgatgggcacctgcgttgattccatgtgtttgctatggtaaatagtgcttcaatgaacatatgagtgcatgtgtctttttttttttagaataatttattttcctatgggtatatacccagtaatgggattgctgggttaaatggtagttctgttttaagttctgtgaggaaactccaaactgctttccacagtggctgaactaatttacactcccaccaagagtgtataagcattcctttttctacacagccttgccagcatctgtttcttgttgacatttacataatagccattctgactggagtgagatggtatctcattgtggttttgatttgcatttgtatgtcttcctttgagaagtgtttgttcatatactttgcccatttttaagtgggattatttgttttttgcttgtttatttgtttacaatgtttacagattctgatattagacctttgtcagatgcatagtttgtgaatattttctctcattttgtgagttatctgtttactctgttgatagtttctttcgctgtgcagaacctctttaattaggtctcacttgtcaatttttgtttttatcacagttgcttttggagatttagccataaaatcttggccaaattctaagcatttcctaggttttcttctaggattcatacagcttgaggtcttatatttaaatcttttatccatcttgaataaatttttatatatgctgaaagataggggtccagtttcattctactgcatacggctaaccagttataccagcaccatttattgaatagggagcccttccttcattgcttgtttttgttgactttgtggaagatcagatggatgtaggtgttcagctttatttctgggttttctattctgttctataagtctatgtctgtgtatctgtttttgtaccaatactatgctgttttggttactatagccttgtagtataatttgaagttgggtaatgtgataactccaatttttttccttttactttagttttttcactgattctcctctgagagaagtggtgttcttttaactgtggtttaaatggaggatagtcaattggcttcatttctggttgctttcagagggccaaggctctgtacaggatctttatttgtggctagattcttgcccctggtttcacaagtgatgtatattggcagattatttttggtgttttaatttgggatgtgatccagtaaatggtgcttaagagtggtggccagcagataggctcttaatcagcttcacagctttttttgtatttcagtgcatttgcagtagtggtctatagtggggtagggggagacagatgaccctctcagcaggtctgttcctgagctttgaggaagccgcctctgatcactggcactgatcctgtctttttctttaattaggtcttccgggctgcagggctccctcaggcagaggctatgacctgcagataggccacaccattcttggactggtcctgtagagcagggttccccaatccctgttactgcttcatggcctgttcagaagtgggccacacagcaggaggtgagtggtgggtgagtgagcattattaccacctgagctcggtctcccgtcagatcagcagtggcattagactgtcatggaagcatgaaccctattgtggactgcatgtgggagggatctaggttgcatgctccttatgataatccaatgcttgatgatctgaggtagaacagtttcaacctgaaaccatcccctcctccccaacatacaccatccatggaaaaattgtcttccacaaaactggtccctgtgctaaaaaggttggggactgctgctgtagagggagagatgcccttctctggtgctggcttacaagcctctgtgtttcactcctctctgtcttctgagggtgtgggctccttccctgctctagcactggctacagatcttggctcaagattcccaagctgcatgctgcagccctgagctgttgggactggcccacagctccatcttttggctccctttggcacagcaccaactgtgctgggggattccaactgcttccagacctctgagaaagtactcaggctggccttttgataaagcacccatactgggcagtggaggctgcactgtactcatgttcctgttagagcagctgggcagaggccttggaaggggctggtgggcaggagtgcctgcagaacagacatgccccattcccactggaaagtcagccctgttctcttgacccagtggtcaactggggttagagttactcagaggaagaaggggagcgttgggggatgggcacctatggctgtattctgcttgcggctgtcatgtgtgccaaacctccattccatataggctggagtacttttactgcctactctccaggcagatccccttgccagtttaaatgtttatgggcgtcataggatctcttgtacctaggattggagatctgcagcaagagtgggttgccccactatcccttcactaacccctccctcaggaggctttcagggctgagcatgagccctagcattcagcaaccccacacaaggttcccagcttcttctcttttcagcctcagtgtcagtgttgcttctctatctactcttggtgttttctgtctaagatttgctcaaagtttattagtttacttaatttttagtctcgttcagtgggagtggtgcttcctggctgtgtctagtcagccaccttatctgctatccctccaaaagctttaaccctttatgtttttttttagtagctactttatttacttctattctgatcttcattatttctttccttccactatttttgggttttgtttcttattgcttttctaattccctgagatgcataattaggttgcttatttgaactctttctttctagatgtaggcattcattgctatgatcttctctgttggcagtgtttttagtatattccatagattttggtatgttgtgtttcagttctcatttatttgaataaactttttgatttctatgttaatttcttccttgagctagtggtcattcagaataatgctgttaaatttccttgtatttatacagtatcacaagttcctctttttattactatctaattttaatccattgtatctaagaaggtatttgatacacactgtctagttttattctgttgtatctaagaagatatttgacatgatttccattttaagaaatttgttgaggcttgttatgtgtcctaacatatggtctatcctggagaatgtttcatctgctgatgagaagaatgtatattctgtagctgctggatgaaatgttttgtaaatttctgttaggtctatttggtcagtagtgcagtctaaatccagtgtttctttttaaattttctgttgtgatgatctctgtaatgttgagagtgggctgctgaagtccccaagtattattgtattgtgctgtctttctccctttagtcataataatatttgctttatatatctgggtgctttgttgttgagtgtatatgtgtttagagttgtcatatcctttgctaatttgatccctttgtcattatataatacccctctttgtctatttttacttttttttgacttaaagtctattttatctgatataagcatggctattcctgcttgcttttggtttctgtttgcatggaatatatttttttcattctcttactttcaatatatatgtgtttttttcagatgaaaagaggttttatttttgtagggggcttattatagggtcatgtttttaaatcagttatcctagtttgtatcttttaattggaaaatttaatctttttacattcaatgttattattgatatgggagggcttattcctgtcattttgttaattgacttctggttgttttatatatcttttttcttttttttatttctctcttgtttgttgtggtttggtggtgttctgtagtggtaacatttgagtcctttctctttcttattcatgagtttgctctaccagtgggctttatacttttatgtgttttcctgttggtgtatatattatccctttgcttccaggtatagtactcccttaagtattgcttgtaggttcagcccattcatgataaatgtgctcagcttttgtttttctaggaaagacttcagttctccttcatttatgaaggatgattttgttgagtatagtatccttggctgccagtctttttctatctacactttgaatatatcatcccattttctcagggcctgtatggtttctgctgagaaatccactgttgttttggtggggctcctttgtaagtgtctagatgcttttcttttgctgctttaagaattttcttgttgtctttgacttttgaccactttgctataatgtgccatggagaagaccttttaaagtcatatttgtttggggatctctgagcttcctgtatcagaatatgtaaatctgttactggactggggaagttttcagctattattttgttaagtaggttttctatccttttggttttctctgctttcttgaacaccaaaaattcaaatatttggttgctttatgatgcttcataagttacataaggttttttcattctctcttatcattttttccttatatttgtctgactgtgttatttcaaaagagctatctttaggtactgaaattctttcttctgcttgatctagtttattgttgaggctttcaaatgcatgttttatttcattcagtgaattgttctgttccaatatttttgtttattttatgatatccatttgttaaatttctttttcatattctagaatttttttccgatttctttgtatctgtgttctcttgtctttcactgatatatatatatatatatatatatatattttttttttttttttttttttttgcgatggagtctcaatctgttgcccaggctggagtgcagtggcatgatgttggttcactacagcctctgcatcctgggttcaagtgattctcatgtctcagcctcccgagtagctgaggattacaggcacccaccaccacacctggctgatttttgtatttttagtagagatggtgtttcaccatgttggatgggctggtctcaaactgctgacctcaagtgatctgcctgcttcagccttccaaagtgctgggattacaggtgtgaaccaccacacccagcttcactgagctttttaaatgtcattactttgaattctatttctggaatttaataaatttctttgtcattggaatctgttgctggtgaattgttttgcttcttccaagtttttgaatttgcttttatagacagtgactttttctcaaagatgtacctatgatattggttgggttggcatgttggcattgattcttggcacttgtagtattgtagtctctgtataattcctttggctataaacagtatcactggtctctgatttcctcagtgacttaggatatggttgttgttggagactgtggatcctggcagttgtagcagtgagctgggtgagtggctgggtccttggacccctgggtagttagtgtcacctgtgtgatggcagtagcagtagtagaacaaccctctggctccaaagcattctgcattgttgttggtggctgtattaggctgggtgagttggtcccctgtgccacaggtgttgcatgcaggtggaagctagctgtggtagtagtagtacgttgggtgggctcatctttaggtctctgggagagtattcaggtgccaatggtggtagattggtcacagccattcttagtaccctggattgtatgcttaggcataggggtggagtctggcagggcgggcctatcctcaggcctcctggtggtgtatgcaagtggtaggcagtagtagagtgaaccaagccacctagtggaatgcccaggtggtggtggcagtggctgtgatgtggcccagctgcgggggagagtggggttgcttttactggcagcagtcgtagacaattggctggggagcatgcactttggctccaggtagtggctgcaggtggggtagcgtttcctcggggcacttgaaaatccatggtggctctgctgctgtgaataccagggttctgccagtggctcatggtttggcctcagcagtgcaatggaagttgctgtgagtgagggagtctgtatttagggctcgtgaaaatacacagcagtcccactgctgggagtattgtagttattgccagtggcttacattttggctctgacaacagcagttagcactcgtggtgtctgtgggtaggggacatcagagaggttgcaaggatgtggagacaggagctgttgatccccatggcaggatgcggtctagtagagtctgggatctcaggatagtgatgtgcaagttgcttaagacttgggggtgtgtggaacccagcatgaatttcctctttggagcaatgccatcatgtgatttccaagtagttcctctgtcagtcgcatggtcctaaagggttgaggcgctctcctatggctaggattgcaggagtccttgatagtaatgtggaccacttggggtgtttctcttgccctttacccacgctgaagagcctctccaggctcccagctgattctggctgagcaggctgccctgatttcctctccttccttgccttaggtgttccttgtcacttcttgttgaattcagtgttctctcttacatgatctattctaactatgattgtcaacttgttattttggttcttctttatggaggaggcaagtaccagatgcctacaggcattcttctgtgcctccgacttcatattttttttgatgctactcttattataaatggtctaccccagatccagacacacacaggtgtcttataatggtctacctaccccaggtccagacacacacagggtagacactgggcagatgtttctttgaagaacaagtaaatgaataaaatatgtaagtggaaagtattaatgtaataatgggtcatgtctgctcattttcaggattcttttctcagaattctacaaacatggaagtgggggtagagaaagcaaatggataatgtaatgcagggttgagaattggtgggaaaatgagtggttttgaacctcaggaaaaggctaggtagagaggtgagatagggatgtgggaaagagcaaagatcaataactaatcaaaaagcagtttttttttgtttttttctgacagacttgagccatacttctaattctgtgggagctggcacttttcagtttgtattagtccattcttacactgctataaagaaatacctgagactgggtaatttataaataaaagaggtataaatggctcatgattctctacaggatatacaggaagcatggctgcggaggcctcaggcaaattacaaacatggtggaaagcaaaggagaagcaggcatgtcttacatgagtggagcaggaggcagagggctgggggcagctacacactttttacacaaccaagtcaagtgagaactgtatcacgagaagagtaccaaagggggaaatccacctctgtgatccaatcactttccaccagaccccacttccaaaactggggattataatttgacatgagatttgggcagagacacaaatccaaaccatattattctgtccctggcccctcccaagtctcaggtactcacattccaaaattcagtcatccttctcaacagtcctcagagtcttaactcattccagcattaacttacaagtccacagtccaaaatctcatctgagacaaggcaagtcccttctgcctataagcctgtaaaataaaaaatgggttagttattacttccaacatacagtgagggtacaggcactgggtaaatacttcttttccaaaagggagaaattagccaaaagaaaggggctacaggccccatgtaagtttgaaacccagcaagggagtcattaaatcttaaagctccaaataatctcctttgattccacatctcacttccagggcacactggggcaaggggtgggctcctaaggttgggaagctgcacctctgaggctttgcaaagtaaagcccctgaggctgctttcatgggctagtgttcatgcacctgcggcttttacatgtgcatggtacaagctcctggttgatctaccattctgcagtctcgaagacaatggccctcttctcacagctccactaggtagtgccccagtggggctctgtgtgagggattcaaccccagatttcccttcagtactgccctagtagagattctccatgacggctctgctcctgcagcagggttctgcctagacatttaggcttttctacacatactctgaaatctaggcagaggctcccgaagccttaactcttgcactctgaacattggcaggctaaacacctcatagaaacaccaagttttatggcttgcacattctgaagcagcagcctgagctgtatctgaagtcctttcagccacccctggaggcagaggggtcaggatatggggagcagtgtcttgagcctgtgcagggaagtgggaccctggtccctgttcatgaaaccattcttccttcttagacctacatgcctgtgatggaaggaactgctgcaaaggtttctgaaatgctttgaaagtcttttcccctttgtcttggccatcagcatttgactattctttacttatgcaaatttctgtagctggcttgaactcctcctccaaaaaggccttttcttttctaccacatggccagccttcaaatttttcaaactcgtacactttgcttcccttttaaatataagtttcagtttcaggtcatttctttgctcacgcatatgaacataggttgttagaagcagcaggctatatcttgactgctttgctgcttagaaatttctcctgtcagtaacctaaaccatcactctcaagttcaaagttccacatacccctagatgcctccaggctctttgttaatgcataacaaaaatgacctttacactagttcccaagaagttcctcattttcatctgagaccttcttagctgggatttcattgtccatatcactatcaggattttcaaagcaaccgttcaacaagtctctaggaagttacaaattttcctcatcttcctgtctttttctcagccctccaaattggtccaacctctacctgttacccagttccaaatgcaaattcacattttcaggtatctttataccaatgcccctgtccttgttaccaattttccatattagttcattcttgcactgctataaagaaatacctgagactgagtgatttataaggaaaagaggtttaattgactcacaattctacaggtgtacaggaagcatggctagggaggcctcaggaaacttacaagcatggtggaaggcaaaggggaagcaggcatgtctacatggccagagccaggaggaagagagagaggtgggaagtgccacagactttttaaataaccagatctagtgagagctctatcatgaaaacaataccaaagggggaaatccacccccatgatccagtcacctcccaccaggtcccacctccaacactggggaatcacaacttggcatgagatttgggcagggatgcaaatccaaattatatcacagttctttctggaacgttgctcatgtagcttcctacatatgtgcaactatcctcctctttttctcctcatacctgcctaccccctctgttcatattcccctctcaaaatctctttctgtttttcttttcttagtgactttcaagatgtccttttaactaggaatagaacctgtcagatatgctaacataactgtatctgctttcaaattgtgtgacctcttgttgatggtgagcaacatattttcaacttctgtgagtgacagtagagtaaaattctgatgagctgaagtcagactacgcatttttggaaagcagctaaacctctttgagcctccaggaagacgtcctctctctatcaaatgcggacttttagaaataatactctctcagccacgtatgccacccagtattattatcacgtgccattactgtttggtagttatttatgttcatgtcatcttggctagattgtgaacttttaaaaggcaagccttctgccttttacctttatattcccatgcatgctttgtatgcttaagtggttagccacttaatatattttaaaagagataatgtatccatgttattgagttaaaataatccatggaaggcatctattacaatgattggcatatagtagatatttagtcagttatattagagcactcagtcaatatggggaattttgcttcatttcctcctctttaattgattctcccatttcacatacattgtccttcggctgattttaggagcctatttatttatctgcctatttttcattttgaagtattttttttgactttcaaagaagacacaagaatagcataaggaaatcccacattccatggatgtatgcttagtatattgtatcaaggaggcacaaaacatccctttactggtggtgttaattttgatcatttgattaaggtggcatctgtcagatctttctaccataaagatgctatatttcatgctgttaatagagaaaaaccctaggctgggtaattataaaggaaagaggtttaattgactcacagttccatatggcgggggaagcctcacaatcatggcagaaagcaaatgaggagcaaagtcacatcttacatggcagcgggcaaagagagcatgtgcaggggaactcccctttgtaaaaccagcggatcccatgagacttattcactatcatgacaaaagcacaagaaagatccaccccccatgattcagttacctaccatcaggtccctcccacaacgtgtgagaattatgggagctacaattcaagatgagatttgagtggggacacagccaaaccatatcagatacttttttttttttttgagacggaatcttgctctgtcgcccaggctggggtgcagtggcacgatctcagctcactgcaacctctacctcccgggttcaagcgattcttctgcctcagcctcctgagtagctgggactacaggctcccaccaccacacccagataatttttgtgtttttagtagagacagggtttcaccatattggccaggcttgtctcgaactcctgaacttgtgatccgcctgccttggcctcccaaagtgctgagattagaggtgtgagctgctgcgcctggcccagatactatgtttttccattgtagttcataagtgtctggtggggaaatactgtaaatatcttgcttctcatcacatttttactaagtttagcccagtttagccagtttattaagtttaacagtccattgatgattgtttcctgaaacaaattatcatacagtttaccatgtagtgacttttctattcacatcattccttctatatctattagttagcattttaccataataaagagtttttctttcctcttcatttagctttgtattcatttgttaacttacattagtatagactcatggaatcttattttgttaaattgattatgcatcaaaatcatcattttgtttatttgtttttttttcttaaattgtgcagatggtaaaattggatgggtggcagagatggctttgagtactcttgtttcagtttgggggtgtgccaaacagcaggcccagaggataagcattcatgtggtttacaccagtttaacaaggaccaacatgaaagagaaaatagttgtagattactctgaaatatattgtttcctctgtgtttcaggaaataaaaagggtcagttggaggtagtttagtcactaaggccactgcaacttcctctcttaactcttagcagctggagatgttttgctgtagacacacagtttgaacataaaaggtaaaggagagtcagtatcgctgtgttggcacaagatggcagcagtcatccattgattttgcagctcaaggcctacagattttaaattaatggtgtcttttgtcttcgcagggacttcagtactagtgctaataacatccagattgataaaaccaagcctttgtggcacaactatttcttatgtggacttaaaggaattcaggtaaattggtttataaggcacttactaccagttgagattatcatgtgtattctgtcagatttattttatttactacatctttttcatctccttacagtactaaccgatgcttctgttctattttgctagtttgtgtttcagagagtggggaagatatgactgttttggggtggtgttcacagggggcagtagtggtttttatacagctggctgttcataaataggtgcatctgacaaacatctgtctggttttaaaatctttgtttaaacatacttttgaggatatgttttaatactattatttacatttatacttgggatgtataggggtatactgtaataggatttagagtcagcccaggtttgaatctgggctcttctcagctgtggtaatttaacctcttaagtctcagatttatccataaaatgatgtcattgctatcctgacaaagagttgttaaaagaattacataaagcttgatggtagccatttaataaatggtagctagtattgttattgctacttcagatgggattaaaaaaagatataatgaaatgtattagtataagtattttccaagaaacattgaataattactttgaaaatctctaatgttacatacaagaacaagaaaataaaatgttttcactctcataattgaaaaagtatcaaggaccaaaagaaaattgatatttgctgtttttagagccacttttatattgcaataattattttagatgtagtgacttgcatagaatcatagtaggacaataagaagtaaattttgcctttgtgagctaaaagtaaacaaacaaactgacccatgttttagagagcttgtgttccttactgcctggcagtcctatctgaaactttgtaatgagcagctaggacttagtggcacatccattacagaaatacatcaaatttatttctaatgtgtagtcctatactgtaacagtggtggtttttgttcttaaagttaatgaattcatttctttctttcttttgtgttttcctttctctcagacacatggtaataacttacaggaaaagttattggcaggttttaaatcttcaaatcatctggcttatcatatgcattagtgggaattacagtatttggaagcatttgcctggcaaatgcaattttaatcttccttgtaacaacatgcctttttgcagcatatgggtaaagtggcctaaataatgcatgttgctttgtgttatttttgagcatttcaggttttaaagccttcctgtttggtttgacaatttatgtgcaaaagcaaacttatacaatgaacttttggcagaaaggtaatttaaatgctagcctgttcagaaactttcaaattcaaatactagaaagtttcagagaataattcacttatattacattgaacatgttatccttttggcatagagctattacagaatgtggcatatacccatttgcattttgaatttgttatacattttcatttaaacattgcataatacgttgttttttgtttttgtttttttgtttttgtttttgtttttgttttttgagacggagtcttgctctgtcgcccaggctggagtgtagtggcgtgatctcggctcactgcaacctctgcccccggggttcaagcgattctcctgcctcaccctccttagtagctgggattacaggtgcctgccaccgcgcctggctaatttttgtatttttagtagagacggggtttcactatattggccaggctggtcttgaactcctgacttcgtgacccacccgcctcggcctcccaaagtgctgggattgcaggtgtgagccactgcgcccggctgataagttcttaagtgtgattcccactcaagacacctgtgtttgatcagtttatattaaatatattgtattcttcaatttttttttttaaacaagctgtctgatattctgtatgaaagggcattggcaacagtagagtttcagtttatagtttgtttgtatatctggaaggaaatttttagatgacttgaaatcaggaagagaagtacacccagctaaatttcttcttattgtggtgcgagaattttgctagctaggacagacagacaaaaaattaaggaaaaaggtcttttatttgcagaattttgttgttattttagttattctagctagctgattgaaattctcccttgtataataggtatgatgaaatgcataattaggtaatagtatttcatatgttaatcttcagtcatttgagtaatttgcaaagactatggtactttttcttgagaaggaggtagacttgaatttatttgtaaacttaaaccacaaaggttatgatatgatatcatccaaagtgtcctagtgttagaaagtaatgtaagtatactagagctttccatatttaaatcagaatctgattatttctttgggctttcctatttgtagaaatagagtttcctcaacttgtttagggtctgtattctcatttgtggctgaattctaatttgactatctttaaagctaccatatggctaaactgtatctataaactgtagtaagcatctggattttctcatgtagctggcatattaaatcacaatgacggtttgctggctcaggtttctaactgcagtggaaaagttttcaaacaggattcagagacctgggccctactctcgtctccctatgtgtcatcttgggaaagtttcttcatctcttggtgcctaggttttttcataagtaaaacagaactgagaatgtttggaactcctttttttcagagaaccttctaaagtaaggcactccttagaaacaagtcactgcttgggggctggacttttataataacagaatgctggagttgtgctgcatggagatttaaattacctcacagataattgtatatttcttgtcctgctacttgacaaattggattataattgttttatattttttccatatttgttcaaatcaattaatactcaagaaaaagaacattcaaggcaattttatattttttccatattcaaatcaattaatattcaagaaaaagaacattcaaggcaagaaaattaaaggcatttaagggaattactctgtggctaagagtcattaaataaaatgtcacatatagtctcaactaaattgaattgcataagtagtttctataactattataagtctattgatagacttttgttctctggggaatgaaagaagctttcactactccttgaattcaatactgaattactgttgctgtttttccttatattcttaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtaactacctttgataggaaacctcatagaaccctctcctaataatcattagcatccaaatctcaaatcagaatgccttccttgattgaaaaactgtcttctctaaaaggactgcacatgtgggcaagcattgtaacttaacaagtgataaatcactataaagtagcttataccctccaaacagtgagtgaatagatctgtgaataactgtataaaaatacattgtattaaatatgggatttgaatgtatggatatcattttagatcacctcattcacaagttaaatttagggcaagaaattcttcctctcatggttgagcctgcttattttcacccaaaaccttaaattaaaaatttgacaagtagtgggttacaagggtaaagactaggtaataaaggaactgaatatgccagcagattagtcacagaaataaactttaaaatattgcattacaagacgaaatgcttatttaaaggaaatataaattgtacaagaggtcagaaagcctcaagtttataagttcacataaatctctgactctgcagtttagagcaggtgtgctcagctttaattaatgctttagcattctggttcaaataaaatgttatcataggttctttttaccccatgtacatatactaccaggtttacggatggtttggacagatcaagagaaaggcagccacatgcttagtctcttttaagcatgtttaaactttcagtttgaaaattttatgtataggaggaaggcagaaatgaaggagaaagcaaaggttcagacagaatccttctttttagctgtcctgtgtaagtgtacattaattagcccttagtgagcaatgactggttgggagggaaagggggcttacatattattattattttttgagaagagaagaagcaagggacaggaagtccatgtgtaaaatgtgtttcccctggtacaattttcaatctgatttgtttatttattcatttgtttgttcatcattcaaccattatttatttaatggctattttgtgccagataatgttcaaggcattggagatataataagtatagtctcaactttcactatgcttatagtctaaaagggaaaagagacaagtaaataggcaactgcaatagaatatagtaagtggataagtagttttctatgggagcagatataacccagatttagagagcataggacatctaaatggagacaacaaagattaaaggagttgtagatattgatggcatgataacactgatgacatcagataagcatgtattgggtggagagaacatcatgtggaaatgtccagagtaaaagcaatcatggcttgttggagtaacaaaaaaaatgtctcaatatggttgaagcatacagcaatttggataacagagcaggagatcagttgctgggccttgtaaactttgttaaggaatttaggtatcatcttcatagcagtgggaaaccattgcagggttttaggaagaggtaaggtgatcatatctgtattttagaaagatctccctggctatattacaaagtctgcatttcagggttttagcagtagggaggtgatttggtttagagtagtggcaatgagaatggttagaattagatagattcaagatctcagaatcagtaggacttggtcattgattgggcatgggaatggggaacagcaaagactcaaagattatatcggtgtctggctggtatgattcattggaataagagatatgggggaaaaataggtttgagtggaagctgaaatgttgagtgtgaggaatctgtgggcatactgatggagttatttagtatttagttatgaaaaaaatatgaaggtcaggaggagatctggacttgagatggtacatttgagaatcattagtttatcattgtttttgaagccataggagtggatcaagatacctggtgttggaatataggtggaaagataaggaaaactaggacagagccccaagaaacatgaacatttgaggaatgggcataggaagggatgtccactgaagggattgaggagtagtccagtaagtatgagaaaaaccagaaaggtgaggcaacagcaaagacaaggaagataatgtttcatgaaaggagtggtagtgttgtcatatgcttctgagaggttaccacaagttctgagaagtatccattgaatatcacaacaaagaagttgtacaaaactttgacaagagcagttttagatggaaatgggttgaagggtctataaggggtaagaaagtggtaaagttcagtggatacaaaaagtctggtgatgcatagaaaaagataatttggtatttggaggagggtgtgaagtcaaggaattcatttcacttttaatgggaggattggtgaaacttagtttttctatttttctggtgttttgataatatacctatctaagaaataggaaggaaagaagataaagagaaacacttgaacccttagaattaattctgattgtctgttttcaaagtcggaaatagcaaatacatttttttatcggaactatcttactgcagtgcctaagcaaaaagggaacaatatgtatatcctggctttctcagctagtctaagttgtactaacaatatttacattttctaaggactgagcataattatttggagagtttttttttttctggagtgagacagaatcttgaatgaaaggaagtctgtaatttgttcagtctttaatttaaatgccatgtgattttactcttgtaaaaatcacagaatataagaattcaagggactttagagatgagctagttcaaaatgctccttttactgatgtattagtgttaccataggaaacaaatgacatgttaggtataactgaagagagtttaataaagagacttttacagagatgtgggtaaggtcaagggaactaactaggaagggttctcttgtgaagctggaagccattgtactttaggagctgtggatatagagtaatgttgccagaaatgcagcaaggcagagaaagaatgacacaggtgaaaatggcaatgagtgggaatagttgaggggaatttaccatagaggtcagccttttggggtaggggaagtgtgagaatagaggaacagagggacaaccgaaaataactagcctgtttgataaggacactaagtcccacaacagattggtgactaaagcctttcctattatttcatatccagtaaaccccattcagttgcagacaacaattactgcagatgggatataataagtagatgtggaacttgttaattcattaatatactaaatgttgcatatctgaaaccagaaaacaatatggctaatcacccagagaatctggaagccagaaattatgaatcagaatgttactggtacaagagagtatgatgtggcaaaagatctatgaaaaaggaaaatctagagacttctgatttcagcatgtcagaataagacttacctactctttttctgtgtccctaaattaatcttcttttctcaaaaatcatttccaaacaacagggaaaataagaaaaggaagcacaagctttatctttggtaagccaaggagacataaataaccataaaccacaaaatacaaagatggaaagtggatagaggaatgttacatgacttaggcgaatggagaaaggtcagagccaagtgcctgcggagggagttgcagatggaaaggcagctgactcatcccacagctctctggcaaggcttaggaagaaagcagggtaatatggtgggtggggatttatctgaaagcctttgtgaggactatttagaccctaaaaggcctctcttcacctggaccatttccccctatctttgcaggagtctctggagaaacaaccagagatcatttgtacttggggacactgagcactgagaaaggcaggacgagaaagacttgaaaactgggagattagaggacattctgcatctgaaaaatgaaattcttagctccattcttctggtcattactggcacactggcaacctcaccaccctacactccagcaggaatgttggaggatccttctcaaaggaaacttaaccatcccagagatggttcatacagatactgacatttggtgacccccttctccagctcctctatgaccttgttagaagcccatttacaaagcttctaataagctttttagtgactcactcttaaatatgatagggcatcaaagtatagtaagattttggaagaaaacctacaaaatgaaccaaacaaacaaaaaaaacagagaaaacaggaaactagaggaaacagagacaatgctgagagcagaagaatcaaagacatgatgtcctcagagagataaaagaaaatgttaagtccttgaaaaataatagtgttacttttttaaaaaaggaaccaacggtaagatagagcttttgcatattaaaaatatgacaagacaaaatttagcaaaaagattggaaacagctgggcatggtggctcatgcctgcaatctcagcagtttgggaggctaaggcaggaggatcgcttgaggccaggagttcaagaccagcctgggcaacacagtgagaccttgtctcaaaaaaagagaacagactggaagaactctctgatatagtagggaataaaagagctggacaataagagagaaaaacaggaaaatttatggatcaattccagaaatccatccaactagtaaggaaaaacagaaaaaacagttattagaaattattattattattaaaaatagagttggggcctctctatgttgcccaggctggtctcaaactcctgacctcaagtgatcctccctcatcagcctctcaaagctctgggattataggtgtgagccactgtgtctgtccagaagattttttttttaaaataatatttctccaaagtgaaaatgtgaatttggattggaagggctcactgggtgtttggtataataaatgtaaaaggccaaaccaaagaatatcatctggaaattttgaaacttgagtgttatagaaaagacactaaaagctagttgacagagcaagagaaaagaacggaaagaaatcataatcaaaggatcagaaatgtaaattaatttctcaaaaacagtattggaagataaaggcagttgataaatgtctctaaaatattaataaattttagtttaggctatctgtttaaatgaattaatcaaatgtgagggtatagtaaaacattttcaacatgtaaagtgtaaaagtctagaggatgtaatccaccaaaactagggagtaaaccaagaaagaagatcgcatgggaactaggaaatgagaaatccaatatatgagagaggagttgggtatttatagaacattggtatttgtagaacataaggggaattccaacataacacccataatatccagcagcttagaaagcagtgcagattaaaatgaggagagggaaagatggaacttataatcttatcagtaaaacaaaaaaaaagccaaaaaaactggttaatctgatatgttcaaccatgtggaaaatggattcagagtaatttcacagagctgttgtaggatatgacaaagctcagctagatatacaaatctaagcaaatgaagaaatggggcaattattaaatataggaaaaacaaaaaagtttgtaacagaaatgaaatcaaccatttttttttgctcataagtgaacaataatctcagtaattaacacaacaaatatgaatttaagcaaaattttgggcataactttattgagaaaggtggaggagggtaaaggaaaggtggatgtaagagagctaaaatcctcacttatcataataggaaagcaataaataatgtttaaaatgaaacaacaggcaataacatttaccaatgttatttggaattggaagcaaaagcaaagagccaaaagtatttgccgttgtacacattgcattggggatagggatgacagagtgagctaggggctgcctttgttgttgttataagccttttacctctatttaatcttttagattatatgcaaatatcactttggcgaaagtaaaataaaagatagaagaactgaatagaatgaaaaataagaatggaaatagaatgaaaagtaagatgacctgtatgaccacacctgggggaacctgaaagatgaagagatgagaagggattcaatgagtcaaggctagagattgagaacagatgagctgttggaatgtgaccaaatcaatggcctagggtgaggtctgttgatgggttttgggtggaagaatccaagaaaatacaggcatcttccatttagtggcagtagtccattccaacaaatcagatgttctgcacaaaattattcagcgagggcctatttttttaaaataggaaaaagtataatgcattattcctcaactcaaaacctctaactaatttcctacaatgttacaaaaatacagtaaagctttctttatataagtcacacagaagtagcatgaaaaatgtttaaaccaattttcttgaacattaaacaattaatatggttgttaacaagcagttactttatatagtgataccggtatgtcttctgtattgacacctggtatttcagtactctgcatactattttgttaacaatgttgtgtttaggttttagggtgtaaatatgtatgttttcctatataaacacctttcagaaagtgttgttttgagagatatgaacattctatgaagtttgggtatcaaaaatctttcgccaagaaaatgttagttgctgaggtgttctacaagatatgcctgtattttgtaagaatgggatttgggttgctctgatgtccagtttctgtctgttcttggagttgtccttggaggccaagaagaaaggaccaagtgcctcttaggaatcttagaatagaaatagctggcctacttgggaaacaggttgcaactctaaaagctagtcttgggtagtaaggtgtgttagactagcatctatccacaaattcctccctctgctggtgtggggttgggagtagattttgaattcatgaggttgtagactgagcaggtgatattcagaaaacccactttggaggatctgggaggtacagtagagaagtatagggttgagctgcatcccccatactgaagtctaaggaagagaaaacccatattatcttggttgatgaagactgaaagagccagctgggaatagtggggtaggggagaattcttgtatgtggatatctctggcattttgtcaaaaacacaatttacatgattctgagttacccagaatatgaattggacataaaaccttcctttgagagttatagttcactggggaacctggggaatctcttagatggcatcaagaatcctgtattgggaagcccagaataacatgtataatactggatttgtgaggagtgctttcaagagaagaagacagataaacttcctaacctaccacttgaaagcagtgattcagtggcatttgttgaatacctactatatgccatgcgttgttctaggcactggaaatacaactgtgaataaaaccagtgaagtgcccctgcttttatggagtttccatattggcagaagtgatggtatgagaaagataatgaagagctatacaaataaatatataatatcagctaggccgtagttaagggaaattgtatattttatctagggagttaggagaagttctctccgagaagaggacatttgaacagagaccttagggagtgagcagctgagaaagagtgtcagagggaacagcaagtgcaaaagccctaaggtgaaagagagtttgtcatgtctcaggaataagaggtccctgtggttggggtgtggtgagacagaagcggggagaggtgggaggtgagttgagagagttggtcaagggccatggtgtgtagcatcttctttggctttcattctaagcgtaatggaaaacctttggagggctgtgagctggggatggcaagatgtgatttacatggattaagttcttttacctgggagtattataccatacccctgacagtggcaagagaggaaacaataagaaagaaaagagaagagaaaaaagaaaagaaggaaggaagacaaatggtcaatgcccttatggaacttaaatgcatatagtggaatagtaacagaagatttattaactgaccatctatctcatacaaagtgtaaggtattttatatgtaaatgaataaagaggttgaaataatgtctccttggtgaagttaaacagggacagtttcaagtaattggtgagttctaagaaaatgttaaaggaaggaaaggctgggaaacaaagcactgggaggggcccaagggcatttcaggcagagtgaacccataagtgtattttaacagttctctgagccagacttaaaatatgtgtcagccaaggcctagaaattctcttgcagcctcatgaaattccttttaaaactttttgactacagggatgctttctagttgcttaagtccctgaacagatttacttaacttcatttcaggggcaaattagttatatagacaggggttgatactcttttcaggggagtgtttttgaagtttgaaacctgttctgtactggagacctctaaggttcataaacagagtaagtggaatgttcaaagttctgtgccaaatatgtccacattttcacttttctgagtttacaagtgctgtttccttgagaaagtacaaggctgtatttttcttcacatatagctgcatttcagtgaaatatttcttggccttcagaataagaccttgtgcctaaagaataaagacatgtctatgttataaaatgaaaaggatctcaaaattatataaactatgatttgaatgttttaatagtttgttacatggtataagaaaaatcagaaaccaatttgcactgtcactaattattatgcttagaagtccacataaggacattgtttcagtttgcttagaataacaaaacctcatccatataatggttaaggaaaatagtagtttaaaccattccagccagatgttgagtgctaatgaactgcagcagtatggcctctgaaaagatggtaaatccagaatacaagctttgaaaagaatctcttaattaggtgttgaacatggactgaagccatgtgctcactggtacaaaaaccaggaagctatagtgttagctctgggtggcctgtgtttaaatgtgttctaagttttaggttaataatgtaaatacaaaaccattcacgtagttttgtcaattaaaagagatcctctggttgtatccttttttaggagtaggattggagactgaatcatttctttaatgattttgagtagtttggattcacttgggtgatgtgacactaagctatttgtctttgcagacgttgtttgggtcacttctgggttttttttccgttttctttcctaggctaaatacttgtttacctttagcgtaaacgaaggcaaacaagcataattagggaacagcagatttgaggagtgtgtgtcactgtttgcaagtggtttcaaatgaaaccactgttgctacaaattaatatgtatgcctagttgtgttttgaacttttgttgtgatccttaaatcgttattactcagtgactgtgtttcaaggcctccagattttgacttgcaccctacaataagttaagtgttacacagtattcaaataattaactggaataatgcaagtgatattaagtactacacatatgtgcatagcctttacctactacatcagttgtgtgcattgaacataacttaaagatgaaaatacaaggatagataacccccctaccaaattcagaagtgtttctcatttattttcatgcatttctgtttcacagaggttatggtagccatcttggtcaagagttacctatgctgactcccagactaatatttgatagagtaaggaagacaatgaaagactgacttaactttgtcccctctgtggccaatttgctctgtaacttgtgataacttccctatgcctcagtttctgtttctaaaataagggtgagaatagttcttcctttaacttcacaaggatgactcagttaaactggcttaatacctacagttctctgaccttcctgataggagattttgatgaagttcagggaaagagtttagcaagaaaataggtaaggtaggaaaataaattagtagtcagggaagtttttgtaattgtatgaagttttgttgactgtattggtggtataaaaagtaaagtagaggttccttttcaaagagactctcctccctgtctaattaggaataaatagtacttctcttagaagcaaaatttattcaaagagctgtgctaacattcttaaatatctgctagctctaataaagaaatcaatgtactttatgttcttagctcccacaatttagcctaaatatttgccctggcatgcttatactggtccaagcgggcattaggttatagcctgttcctcttccttatttggaggtgtttttacctttctcagcattccacaagttacttcctccttcctttgttctcgtctgcccgtgcctcttttaaaaagttctaagttgctagccaattgggacaaatacagaatgtgaggtcccgtactagccaatggaaaccggacatagcagtagggtggacgcgtcaggttataaatgactctgtctcctttgtttggtgtactcttgtggtaaaactgctggcgagtgtaccctttctgcagaaagtaaaaatggccttgctgaggaaattaaatttatgttcaagtgctatttctttatggcaccggggaacaagcatttctaacagtggtcatgggaagagtaaggagccaaatcatattgtgtggagaagaaagtgattcaaagagaaaaggttaataaatgagactggttaaagcatgcactgcagtattggagacacaaagatttggaggttattactgcaaaatatgactttaaagttttatgttagaattttcatgagagtaaaagatgtctttttaaaaaaattactgttaagcacctagatgttttatgcacatcaactctaactttgtggtagtcttgtaaataagttttactactatttcaattttgcagaggaaaatatgaggctcagagaatttatataatgtcaccaaagacaaatcacatgtaactggagttgtctggattccagctcacatatttttgatccaaaatggatacttttctattcagccatgctgctacctatggtataatgtaattataccatattgtctgatataatcagtatcatagacatcggaaaaccctggagatgaggtccagccctaacattctgtgatccttctgatgtcctaaaagacagggaagtaaattatacattttcatgtatataattaatgtgaattggattttttaaataagttgacagattttatactctttgtcaaagttataatgatatttttttgaaatcctactatatccaaagcaaacggttggattctcaggatataggaaaacttagatacagtctttgggccttagaagtttataatttcagtagggagattagattaacataaaaatggaaatgtcatgcaaaagtagcatatacaaattcttccaaagaatacgaaaacaaagaacacttcccaacttgtattatgaggccagtaaaacctttctgccaaaccaaatgtgatagcttgataccaaacctgacaaggacatcacaagaaaagagaattacaggtcaatctctctcatgacattggatacaaaaaattctgaacaaaatgttcacaaatttaatctggtaatattataggctaatacattgtggccaagatgagtttattctaagaatttaaggttggtttatcatttaaaaatcagtgttatttaccatattaacagtaaaacatgtcatcttgatatataaaggaaagagtttgataagatttatcatgcattcatgataaaaactcttagcaaattagtagaattcagtataatgactgcctttgggaattagggaagagaaatgattaggtagagacatgaagagaccttctagagtgctggcagaggttcattactttttcttttattgtggcaagaccacttaacatgagatctaccctcttaacaaaattttaaatgtataatacattatcattgactataggtgcaatgttgtagagcagatctctagagcttgtccagcttgtttgactgaagctttatgccagttgattagtaactccccatccacctcaccctgcaccagcaaccatcattccactctgattctaagtgcttcatttcttaaccttgatggtggttacgaggatgtttcctttgtgacaaattattaagctttatttttatgctttatatacttttctctatgttctgtacttcctaaacataaaaaatagcaagactttcttcaaccctaggatcaaccactgttaaaagatttttaatgaatccttccagaaatactctatccaatgtaatatatacatatgtttgccctttttgtaaaacacccaggaaaattttatatataaatatatgtatatattggcccggtgcggtgcctcatgcctgtaatcccagcactttgggaggcaaaggcgggtggatcacttgaggtcaggagtttgagaccaccctggccaacatggtgaaactctgtctctcctaaaaatacaaaaaattagctgggtatgatggtgagcacctgtaatcccagctatcaggaggctgaggcaggaggattgcttgaacccgggaggcagaggttgcagtgaggcgagatcgcaccattgcactccagtctgggtgacagagtaagacttcgtctcaaaaaaaaaattatacacacacacacatacacacacatctttccccttgctttgctttttcacttaaaaccataaattgggaatcattccatgtcagcacatctacatatactgaattctctttaatggctgccttgttttctaatatacggtcatactataatgcccaattatagattttggtgtgatggtaatgttctaaaattggcctgactattggacatttcagttgtttccagggttttgtataatatcagttttaatacttaataatatttctttataaggatatgctatactttatttaactagacctctatgatggaaatgtaggttgttttcaagtttccactattataaagaaggctctgatgaatattcttgtagacaattattttcatacttattcacttttttatttaacataaatcccagaacataaagttactgggttaaaagatatgataactttacttttgaaatacactgcccaatccggaaagattttaccagcaatgcagcaacattgcatgagaggatctattttcctactactgaagttctatcaatcttttaaatctttcctaatctgaaagatgttgtcatggccatttctttaattattagatagtttaattagatagtttaaatgtttaatcttttccatgtcttttattgatcacttgcattttttgatttggctgtatatcaactcagctcattttctcctggagtatttatcaatcatcttattactttataagaactcttcatatgctaaccattcatctattatatgttgcaaatatttatccctgctcaaactaattttctgtttgacttcttttaaactaacaattgtgaagcaaaagtcactttagtcatatttaatcacatatagcataggatcattatatgtgcattcaattttatcttccttgagttgaaaatactctataatctctcatttcattttgaagtacttggacacagggagcctcatagactcagggattttacttagcatctctcaggagatctccactaaatggatcccagggttctcttgtctactacaggtgtgaccttttatctttagacgcttactcagaggaaccaaaactgtgactgatttgcattgtaagcaggaatattttttctttctttctttttttttgtggtgaaagcaagtttattaagcaactaaaggaataaaagaatcactacttcataggcagagcagccagcaggaatattttttccaatagcatttgtgcagtaagacatacacttttgaatcatgaataatgtaacttaccatctgtttagcacttggaaagtttcaaagaactgtaccatgatccatatgataggccatttaactctgttaagtaaggtacaactgccaacttcttagaccagagccctgcctctcagagacttcctggagcctagctataggagtgtttacttaggactctagactttatgttatatcaaagagatatggaagatttcacttttatagtatattaacattgtccccatttcatctttggaccttaaaacaccaagcatcatcatcatcatcatcatcaacaacaactacacaaaactgttgaggggcacagtcattgggtggataggcttaggttcattcagcccttctggatcttgggtcagccactggtattgacaatagggatgaattttcaatcttgaaggacatataaatttgttaagaataaaagaagtgcagttagtctggcaaattgtaaataaccttaaaacttttctccctaaagagagatgattgtatcactttcttatgagcatctttacagtgcctgacataaaggaggcaagtaattggattgggttgaattagtgaactaccttcatctgtaaagcagccattttcccctagtgttagtactatatttggatgaattaacaactggttgttaattttgactgtatttatataaattaaagtgaagcaagaccctgtggaatttatttgtgaccatcaaagaccataaatctcttacattttaagtaagttacagagaaagtaaaattggtgatgagtcctgtggttacaaaggcattcagagattatctgattatttcttcttctgataaaattatgttattgctttgtaaaatataagcaaaaatctaagcaatcaggactctttatgctgtcaagaccttttcattgtaatgaaagtgctcctttttatttttataatttaatttgtatttatatttattttcatgacaaaatattttaattctcatcaggttttataaatagttcttcaaatgtcactatggtttaaatttggtgataaagcagagaatttggataaaagaaaatttggtgataaaggaagaaatttattggaaaaatttaaaagatgtagattttttagggatagttcacagaaacctatgtgttaatgcagggtgcttttatatttagaagttttcattgattttcttcaattatttgggataatattgttacctattgacagcgatgttacatctctcacacacacatgattagatgtattgttaatgtaccacttaaaatttttttccaacttttaattatgagaaaatttcaaaaggatagaagaggcaagaataggcaatgaacatgtatgtctttcacatagatccttggaaacattttgccacatttgctttatctttctctctacttttttttctgagccatttgggaattaattgcggacatcacctctgagtacatcaatattcatcccctcaaagcaaggcattctttaatatgccacactatatcattggaacatttaacattgatataatattattatctaatatgcagttcatattcaaatttcccaattgtctcaatagtaatgtcctttagaacttctttttcttgttctttttctttctttcttttaattttttctgattgagaatttacttattcaagataattgaatacattctggatctgaaaaattaaaaagaaaggaattaaatactactcataataatactcagttttaccaataattggatttaattaatatcatcattgcatttagtttttttttcatttttttagtttactttattttagaacagttccccagcatttttttgtcttttatgacactgacaattttgaagcgtccaggccaaatttttttgttcaaatttcctgaatttggatttgtcagacggttgccttattattagattgagactaaggttttttgccccaagaatactgtataggtgatggatgtccttcttggtgaattgcatcacatggtttctgtttctccaattgtacttaacattatttaatacacagagataggtagagatctgctgtctatcaaaataatgccatagtttaggtatgtcatatgaattcccctttataaaggtggagtttttgttaataaaagttctttaaaagtgtattaaaagtgatgatagagactataacatagtcttctattacatgttttaattaataatgcatgtttgtcaaatgagtgaaaaatagcaatgacttaaaaatcacaaattctcaattttgtcaaggaatttcaattcattattgcactgctatttaagtctgttcatgttcttcattgttttgtttaggaaacaaaatgtactaagcttggaataaactgtttgagatgtctaacataaaaataaccaaagcagatgtaattttatactgccactgtgtatatagggttacattatttcacttgcagtcacttagggtttgtatatatcacatttcagtataatgacatgggcaggctccaaagaaaataccaagcaacgcgaatttggtttgactaacaaatatttacatgtctttgtgtctgtaattattgtaatcttttaaggggtttatgctacacaggcttaattctctagagctctgtgttagattaaaagaggctgatcagtagtatatataactgtaaaaatgatactgtagcccgtctagataaattggtataagccagagcttctgcagggaacaggtggacttaagagagccctgacatgggcagatagctgcctttcatgtgcatgctttcttatgtgttttagccttttctttctttccagatgggtggtgttgatggaaccatcatttgattgttatttgatcttttcaggtttctctagtcatgtagttagcacattggaagcaagaaaagataaacagtacagtcctttcctcatctataggaggcagacagatagttgtattgctggtactgaaccattcacgtatatttgcttactcagtaccatccgtgtcaatttgcaagctttagccagatgtaattggttaaatagattctcccctgttgcccccttgattaaagctccttggcctgtaagatgtcaatatcctattaacttttaacttcactatagcgcttcttagtttgtattgtaaagatgtttccctctagaccatcatggggttttcaagcatagagactatttattttttaaatgtttggatccccatagactcaaatcacaactgatttagatcaggcagtatggtgcctaactgaattaattaaaaaaatgtaatctcatttgcaacataatttcctggtgatgacataaataattatttgagttttaacttgagattctatcaattttacaatttggtttaatccagaggatttattcatttatccacattgactgaggagttattatgttccaggcagggttgatccactggtctctctcctgcctctcttatggctgatgtctattctgagttgttggtgtctctgccacactggctggtgactgtcattattagttttaggcatttgtgctagttgctgggttccgcctagttgctaataggctttgtctgttatatacagacataaatcccataaatttaagcatgtgaattagtaaagttgtcatagtaacagttctagtaaagactgttcctcttggatgtcacacttgaacccgctgaattttgtcacctgcctcttacattctcagatgaaggagttattacacagggaggtggtaaaggagcaacagaggcaaagaaatgggatgcactcatataatataattggctacccaaaatggagatgtttctaaaggcataaatatctctggatgcatgtggaaacctctcttttatccctgattgtattctcctttagtgtaaagaataggcattacatagctattataactagtaaagttagagtttttgtttatcagaaatttaagatcaattaaatattttctaattaaagtgttgtagttaaaaattataaatattgactgaacacaatggcagtgagaatacagttttcaagtgtgagttttagcactgagggctagttcatgagctgggtgttcccaaagccatgggtagaagtaggaaatacagcacaacatcttaaatgggtgaaactatatttcttaataaccctaggtttttcctgatctcattagaaatgattatatgttccttaaaatttttttaactgtaaaagcaatatattctattttataagattatggattattttatttaattttaattataattgtaataaaataacattttatttaattttaattataattataataaaataacattttatttaattagaaattaaagaaaattatccataatcttatacaaccaaatattggactcacagtcaccttaagtattgtgaggaaaataaaatctttgtatctttaaatattacaactcaaagagactacatttagctcatatgttgattcaattaacaatttttaataacatatctattttgtgtcaggcactattcctggcactggggtagagcaattactaaaatgcagtgcctgctctcatggagcttacaattaagtggggaaagaagggtgatggaaaagaaataagtgaaaagataacctaaagtgttaaaagccttgaagaaaaagcagggtttgagatggagagtggcagggggtattagtatattttaaggaagtaagggaagttctgtctgatgaggtaacgtttgagcagagattttgggataagggcattccagactgaaggaatggtggatataaagatcctgaggtggtgggatattgatgcactaactatatgctaggcttttaaaatcctaacagtgacacaatgaagtaggtaattattataatttgtattttgcagagaaggaaacttacatgctttaaccactgtgctatacacccacatgatgtaatagagcagagagttaaagtatgtaactcaggtcccaggaggccaggaaaagttccccagaggagttgctccttgaatttagttgtagtgaaaaagcaagtagaaaatgagaagggtttagaattctggtctgttttctcctgttactatatccccagaagcacatttatttggaagcatatatatatatatatatgtgtgtgtgtgtgtgtgtgtgtgtgtgtgtgtgtgagagagagagagagagagagagagatggtatctcattgtggttttgatttgcatttctctgatggccagtgatggtgagcattttttcatgtgttttttggctgcataaatgtcttcttttgagaagtgtcagttcatgtccttcacccattttttgatggggttgtttttttcttgtaaatttgtttgagttcactgtagattctggatattagccctttgtcagatgagtaggttgtgaaaattttctcctattttgtatacatatatatatatgtatactaaaaattgataagctatagaggagatgatcatagacctcagggaaggataaagtgagtagttccattatttattttattttattattattatactttaagttttagggtacatgtgcacaatgtgcaggttagttacatatgtatacatgtgccatgctgttgtgctgcacccattaactcctcatttagcattaggtatatctcctaaagctatccatcccccctccccccaccccacaacagttccccagagtgtgatgttccccttcctgtgtccatgtgttctcattgttcagttcccacctatgagtgagaatatgtggtgtttggttatttgttcttgtgatagtttactgagaatgatgatttccaatttcatccaggtccctacaaaggacatgaactcatcattttttatggctgcatagtattccatggtgtatatgtgccacattttcttttttttttttaattattattatactttaagttttagggtacatgtgcacaatgtgcaggttagttacatatgtatacatgtgccatgctggtgcgctgcacccactaacttgtcatctagcattaggtatatctcccaatgctatccctcccccctcccccaaccccaccacagtccccagagtgtgatgttccccttcctgtgtccatatgttctcattgttcaattcccacctatgagtgagaatatgtggtgtttggtttttttgttcttgcgatactttactgagaatgatgatttccagtttcatccacgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtgaaatggtatttctagttctagatccctgaggaatcgccacacagacttccacaaggtttgaactagtttacagtcccaccaacagtgtaaaagtgttcctatttctccacatcctctccagcacctgttgtttcctgactttttaatgatcgccattctaactggtgtgagatggtatctcattgtggttttgatttgcattcctctgatggccaatttcatgtgttttttggctgcataaatgtcttcttttgagaagtgtctgttcatgtccttcgcccactttttcatggggttgtttgtttttttcttgtaaatttgtttgagttcattgtagattctggatattagccctttgtcagacgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtatcaggtgtaaggaagggatcgagtttcagctttctacatatggctagccagttttcccagcaccatttattaaatagggaatcctttccccattgcttgtttttctcaggtttgtcaaatatcagatagttgtagatatgtggtgttatttctgagggctctgttctgttccattgatctatatctctgtttcggtaccagtaccatgctgttttggttactgtagccttgtagtatagtttgaagtcaggtagtgtgatgcctccagctttgtacttttggcttaggattggcttggcaatgcaggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacgtcccttgtaagttggattcctaggtattttattctctttgaagcaattgtgaatgggagttcactcatgatttagctgtctgtttgtctgttattggtgtataagaatgcttgtgatttttgtacattgattttgtatcctgagactttgctgaagttgcttatcagcttaaggagattttgggctgagacaatggggttttccagatatacaatcatgtcatccgcaaacagggacaatttgacttcctcttttcctgattgaataccctttatttccttctcctgcctaattgccctggccagaacttccaacactatgttgaataggagtggtgagagagggcatccctgtcttgtgccacttttcaaagggaatgcttccagtttttgcccattcagtatgatattggctgtgggtttgtcatagatagctcttattattttgaaatacatcccatcaatacctaatttattcagagtttttagcatgaagggttgttgaattttgtcaaaggctttttctgcatctattgagataatcatgtggtttttgtctttggttctgtttatatgctggattacatttattgatttgtgtatattgaaccagccttgcatcccagggatgaagcccacttgatcatggtgggtaagctttttgatgtgctgctggattcagtttgccagtattttattgaggatttttgcatcaatgttcttcaaggatattggtctaaaattctcttttttggttgtgtctctgcccggctttgacatcaggatgatgctggcctcataaaatgagttagggaggattccctctttttctattgattggaatattttcagaaggaatggtaccagttcctccttgtacctctggtagaattcggctgtgaatccatctggtcctggactctttttggttggtaagctattgattattgccacaatttcagagcctgttattggtcttttcagagattcaacttcttcctggtttagtcttgggagggtgtatgtgtcgaggaatttatccatttcttctggattttctagtttatttgcatagaggtgtttgtagtattctctgatggtagtttgtatttctgtgggatcggtggtgatatcccctttatcattttttattgcgtctattgattcttctctgttttcttctgtattagtcttgctagcggtctgtcaattttgttgatcctttcaaaaaaaccagctcctggattcattaattttttgaagggttttttgtgtctccatttccttcagttctgctctgattttagttatttcttgccctctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctaccttcatttcattatgtacccagtagtcattcaggagcaggttgttcagtttccatgtagttgagcagttttgagtgagattcttaatcctgagttctagtttgattgcactgtggtctgagagatagtttgttataatttctgttcttttacatctgctgaggagagctttacttccaagtatgtggtcagttttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcacatatatttaggatagttagctcttcttgttgaattgatccctttaccattatgtaatggccttctttgtctcttttgatctttgttggtttaaagtctgttgtatcagagactgggattgcaacccctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatatgtgaatttgatcctgtcattatgatgttagctggttattttgcttgttagttgatgcagtttcttcctagtctcgatggtctttacattttggcatgattttgcagcggctggtactggttgttcctttccatgtttagtgcttccttcaggagctcttgtaaggcaggcctgttggtgagaaaatctctcagcatttgcttgtctgtaaagtattttatttctccttcacttatgaagcttagtttggctggatatgaaattctgggttgaaaattcttttctttcagaatgttgaatattggcccccactctcttctggcttgtagggtttctgccaagagatccactgttagtctgatgggcttccctttgagggtaacccgacctttctctctagctgtccttaacattttttccttcatttcaactttggtgaatctgacaattatgtgtcttggagttgctcttctcgaggagtatctttgtggcgttctctggatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacctcccttctcgcttcatttcattcatttcatcttccatcactgataccctttcttccagttgatcgcatcggctcctgaggcttctgcattcttcacgtagttctcgagccttggctttcagctccatcagctcctttaagcgcttctctgtattgattattctagttatacattcgtctaaatttttttcaaagttttcaacttctttgcctttggtttgaatgtcctcccaacgtagctcagagtaatttgatcgtctgaagccttcttctctcagctcgtcaaagtcattctccatccagctttgttccattgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtgtatgtcctttctgtttgttagttttccttctaacagacaggaccctcagctgcaggtctgttggagtttgctagaggtccactccagaccctgtttgcctgggtaccagcagtggtggctgtagtacagcggattttcgtgaaccgcgaatgctgctgtctgatcgttcctctggtagttttgtctcagaggagtacccagccgtgtgaggtgtcagtctgcccctactggggggtgcctcccagttaggctgcttgggggtcaggggtcagggacccacttgaggaggcagtctgcccattctcagatctccagctgcgtgctgggagaaccactgctctcttcaaagctgtcagacagggacatttaagtctgcagaggttactgctgtctttttgtctgtgcccttcccccagaggtggagcctacagaggcaggcaggcctccttgagctgtggtgggctccacccagttctaggttcctggctgctttatttacctaaggaagcctgggcaatggcgcgcgccctcccccagcctggctgccgccttgcagtttgatcttatactgctgtgctagcaatcagcgaggctccgtgggcataggaccctctgagccaggtgcaggatataatctcctggtgtgccgttttttaagcccgtcggaaaagcgcagtgttgggttgggagtgatgcgattttccaggtgctgtctgtcacccctttctttgactaggaaagggaactccctgacccgttgcgcttcccgagtgaggcaatgcctcgccctgttttggctcgcgcgcagtgcgctgcatccactatcctgtgcccactgtctggcactccctagggagatgaacccagtacctcagatggaaatgcagaaatcacccgtcttctgcgtcgctcacgctgggagctgtagagcggagctgttcctattcggccatctttgctcctgccccagtagttccatgtttttttaactgaatggaacaaaatgtttgaaattgtttgaatgtttgaatattctttgggcttctgtgaagataaaatattccaaaagcgcttgtgagtttttaagattcttgctagcaaggaaaaatagcccactcaagccagcttcattaaaaaaggagtgtttgctttaagtatgtgtcctaaaatgcgaaggagggtatgtcagttagcttttgctgtgtaacaatttttttcgaaatatagtggcttaagactaccaccacttggactgggttcagcttgacagtaattctgtctattttgtctggactcattaagacatctgatctcagctgctggtcaagttggcacttctgcttctggattggctggctgtcagccgacatgataggaggccttgggccacatgtttatcatcctccaggctagtccaggcttgtccaaatggagatctccagcttccaagagcaggtggagggcaagctccaatgtacaagtgcttttcaagtttctgtttatatctcatatgcctctacccaaattgagcaaagcaagttttatcccagatttaatgagtggagaaacagatttcatcttttgatgggtggaactgcaaagtcacattgcaagggaacggaaacagagaggggaagaatttgtggtcattttgcagtctaatataatggagctgggtttcaggaatgcacagaaacctaagtgtcgttaagactgcctctctcacttgtcttgctctctgttttgcttgtctgtttcattcttcttaatcttcagaccagcttcctctacttctctggtctccattttagaaaatatggctgctgacagcttctatgatcatatgagatagacatagatcgcttaaaactgactctttccccattgggaagatttttctgaagaaggaactctagaaggggaatctggttagtgtcttcagccaggtacccactcctggatctatgaatggtgataaagcattttgttgggtggatgggagattgggtgtgtgtgtgaatctggcaattatgagttatattgttataaccttgtggtattaatagttggaggtagagtgctaagaaggaggaaaaagagttcagtgtccccagaaaagtgtagagatgggaagagggtggctagacatctcacatgggtccattacgatgagttttataactactgtattaatttcaggggattgagagtagtggctgggacctgggaggaacgagatgatgaactaaaaaccagtatggaagggaggtacttgagccacgtaaaggggtaaagggtgttaaagaaaaaaatattcaatgatatttgttaaaacatggcaaagcaggctttcttaaggaccattgtgatgagattttgcaatgggagagagaaattgggctcaactctgaatacagcatggccaaatgggaagttatagccaaggagcagggtaggagccagtgaatgggaaattaaacatcaggagtaatgaggattccagctaacctgacctaaaaggattcttgctgaatgcaggccaaggtgatcagtcattacctggaggatgttggaagatgaggaaccttatcagatatcaagggtgatcagatattgagggtggggtgttctcactaaactgatttagcaaggtgaacagatgggcctagtagctggttcaggagcatgactgaagtttgggcaagcaaagaatcgttgtcaaggtcttctgtctccagagtctcagtccaatggggaataccaatcccttcaataatggcagcagtgtttctagtaacagactgggaaatctgtttgggtatgtcttggatggttttatcacttaaaccctttttcttctacacataatgccatttctgtgataacatgttatttctgttttactggaattttctagttctttatttcctccttttcatgttggtcatattatagatgttttgatagttattggcatatttttcttgaataaatcagaaaaatggaaagaagtaaaatccttacttctttcatatttttatcaaagaaggaagttggaaaatattgactataatgaattttctagattttttttctgtatctcagcacataaacatataaagaagaatgagataggtttttctgttataaaactctgaatgaagcaaaagaaagtgatatttcactctccaagatttgccagtgtcatataatgactgcatagttccaggattttaatttggtacatattcatttatcaggggaagatttttgtctctgaatatggtgggttagcagggaaatggggagttgacattgtatattcatttgttcattcattcatttattcagcattcatttatcaacaaatagtttaggtattagagatacaaggtgaacagaatgactcctcccctcatggagcttagactaatggaggaagactaatattaaacaaacatacacaaatatctgtacacagattgtgataaatgttatgaaggaaacagattatgagagagaacagggagaacccaatttaaatggggaagagtagttttgggaaaggctttgtggtgtcagttgagatgtaaaagctgagttgcaggtacaagccaaaaattactcattttttaaagtcactatgtcatatgtcaatgtaaaatgcagagtgttctagattgctttgcagagctaaaacttcagctatagaaattagtaatatatccactgaaagatgtggatagaaagaatcatgaagtaagagagaaagtgagcagagctgcagtctgaggcacaggtggtgtaatgtaaggacagtggctgatgttgcaggctgctgtttggtccagtagcagggagcccattatccaccttgcaaagcagccagccagggttctatccttactggtataccttagaaatgatcagaaatgatcatcttctttttctccccttcttctactgtctctctttagacaatgttagcatcttttgctccatggattggcagtgtgtaaaatggatttattttctagcaaattaccttaccaattgggtacatctcctggtctaggttagtttttgttccattagaaattacttccctctcctttgagcccttctaccaatagtgtgctaaactaaatgacatttttatatttacatccaagatagtgattatgcaacatcatctgcaatattgtttctatttttatctaagttttgttaagcattgtatttataacatttataatttgggggagtgtcaggagtaactatatgtaggtacttaaggaatgaaaatctggagaaagagattacaatcatttatttttcaaaggataggttttctaggtcagctttttgccttatggattagagtgtacttgggctgtgatttgtaattagattgttcatgaaagttattggttgtcagcacttcttttggttctcccatggtgtgtagcatagagccgcaaatatatatttaaaaagtgctgtacaagagatcaaatgaatctgcccctgaggtacttcttccatagggtatattgtgcagtgcaaggtcaggggcctggtagattgcatggagggtgaaggtgagctcttgtggtagtctcaactcagcataggcctcataaacatggggagtagagttgtgcccaagaacccacattttggaagacaggacaaaatggaaattctctactgtttcatgaagttttccttttacttccctctcctattttgcaaagagcaaggaatttaacccttttgtttcagcatttctacatacattttcatcttttgtagaacagaatatttataaatttttaaaatttggaggaggacaaggaagtatagtttttccctaggaattgaagttaagacgctgctgtctctgaaccccagaactcaggggccctctccctatgtgcatttttattccactcacctcccaacttgagatattaataggagatcattttctaccctctgttaccatagtgatctcactgcttcacaaattagcccttttcattcttggaccactctaatcattggaaagattttccttctatttaatcaaactctatcctttctatctatatatccccaattgtctcctccttttgatagtagaatcctttgaagtttgaaggaaccgcttgtgcgtcctcttattctttctctaagccacacatccactgttgtttcaactattccttatggaatatggctactggacctcctcaccattcttgctccctcttcttagaatgtactcttgtttatcatcgctcccctaacgtaactattcctcccatctgctatgtctcagttttttattctatttgtaccaagtgcctattttctttatgtttaaagtgtctaggaattatacaatccaaaatattcagtaaggttaataaattagaagtagaaaactaggacaaaagaaaagaataaaaacataccaactcttaattacttaatgtaattgttttgtttaatcttacttactaagattcctggaggccaaggtgaaagggcaatagtaagttatagaggtctcatgatcagaatagaggaatcattccagttcttcagaagaggcagtattttccctgggggtgctaaattctgaaatgcatttctcacatggattctttagagcacataaaatataatgaaaatcacctctgcaatgtctgaaaacaaatgcaagagtggtgttcacatgactctttcttataatgaccttcagtagatgctctgagcataacatttgagcacagtgcagtaaaatcaatttatttcatgtaacaactcttggaacaccctcagcatttcctgaccctaaagatgcttcccactacatgtcaaagtgtttgcgaattaactattgtatacataaaaccctttccccaaggcaaatgtgtacactgagatatgtatttggttgactcggattatgattcatagaggttctttctttctctttcgtttgcatctatatctgtatgatcagatccatattaggaaaattagcaagtattctcatagttattattatgctagggaaagaaatagtaactagtcatcgaatgcccctctcttcttgtcattctctaggagagtccagattggtttaccactagaaatcctgcagttaggacctcaagagtgggacaggactgttctgctcaaaacacagtataaggaacccttcctccagggaataggagggttcctctatccatgggaaggaacatgcaattccaggacacgcttgccaaaccacagagattgtaagcctgccgcccatccattattatcattatttagcatttttagaaggttagagccaaaataagtattctgccagccaaaggagtgacaccagcctttaccacaggcattggaggccccgctggtatttagtagctgtgacttgggtcatattattgtctgattccatcaggccggccaggctcctgcctcctgttggctttccccaacaacttttttttaggcagttttttctcccctcttctcctcttcccagtagtagttactttggtatgtgtttgctgactattccctccaactcccaccctgtgttttctaagaatttaaacaatgaaagggattcagtcaattgtgctagtgagagataagtatgcagggaaggctttgggggctcctgaattttgggatcctggtctactcctgaaacctttccctgagagataaagtatagtattatgcttaaaagcatagaaccaagactctgagctcaaattctggctttgccacttactagctgaatgatcttgggcagtttatttaacctctctatgcttcagtttcttcattataaaatggatttgaaactccctccctcacggatttgaaactagatagaacacaaaaagtgcttagaacagtgtctgaggcattgtgttagctggcattacaattattgggctacagaaatcataccaagctattagccctatattgagatcactctgggttgcgaaacaattaagaacattgggatctttgggaggaaactatttgggaattgtgtttggaaatggataatggcaaagccctccaagcctcaggccatccagcaacgtacacgttttttaacttgaagagaaaatggaggaacattttgatgaatcagaaatgtctgcctcctagaacttatggtcaacttaattgttcattctaatgaaaaggagtttcagttcagatatgcataaattgtgctccattggctcaccagggcccaattttgggcacagcctgtttcctgaagcagaatgacaaggtagcttggtggacttttgagccaggcctttctggctttgaatcttattttaggtcagcttattgacctttttgagcctcaatttccttctctatgaaatagagaagttacaattctataaaaagttataattctttttctgggttgttttgtaaattaaataagatgtacaaaataccctgcacagtgtctagccctagaagacatttggtatttgtcagctttcttcacttttttgttaatattctttcccaatttgtttaatttatcaagaaagccttgtcatgtaggaaatcatttaaagagctgtttcagatttaatatgcatgcagatcacctggggatcttgttaagttgcagattctgattcagtaggtctgggatggagcatgagattgtgcacgtttaaccagttcccgggtgacatcaatgctgcgtgtgaagactgcacttggagtagcagagtatactgtactcttttctccctttgcatctcattattaccttttagattcatgttaatattttaacagttttaccacacacatttgcacatccagagtcatcatctggagaaatatccaaggttgtacattgttaggtactaataagattcctcctcatgcagtacaggccgtgatggttgaggtctagaagaaacctatcatagacatttccccaggattcccatgggcctaggatcccaaagtgtttgaataaaatactttgctccagcctgattgttgaaggtcccttctcagaatctgggtccctctgtgacttggattgcagatcagttaggttaaggaagtggtctttgtctttctcttgtcgacaagtctggagggagccactggaagactgtgcttctgccctcactgagcacctgagatatttttagagccccatgtcccaactactagctttctccaggttcattagatcacgttctctccactgtacacagatagaagagtgtactgttgtccttttgtgatacacactttctgagcccattgagcttttataggaacatacgaatatccagccctaagaactaaaaacaagctatgtgtgaaaaaagcatgagtgcttaatgcaaactctgagtgcttaatgcaaactctgtggtgtttctacatttttgcagatttcttagattgactttggagaaacctcctcactgttgttgtttttttctagtttctgcttattttgatatttaaactccttcctttctttcctgtattatttacaggaacttttcagcctgaaccatcagggtcatttgcatctgctgtgcccagtttgggaattggctgtctttgtcctcaggcaacttttcttgaagtaaaaaatgcgaaagttgctaattcctttgcattacatctcttaagttagagatgtgaagaagaaataatagcctccttcttgaaaaaaaaatattagaacaggcttttttttttttcccttacaaagtgtctgtaagttagagcttgttcatcagccatgtttcaaaacaaagcaagtctgcttcagtctcttttagagttatcttggtgccatttcatggagaacttctctgtcctggatgggctctacctaatatgtttgccaacttggggaagaatttgaaaatagccccaggtaataacctagaaattttgaaagttagggtggagaaggattatagagggagaaaatagagaaaatatttgaggtaaagtcagaggagccattaatgtttttactttatctagatgaaacagtcagggttgtaacagaaaacagatggcacactcaatgctgaaggacagtttatttcactaggactgtttacaaagatgtgggtttaggggacacccaggactagttgtagctgtgctgttgctgcccttgggcctgaaggtaccctcgacagggagagacatcactttactctccctcccttccccatttcctgccagagtcctctgttagaagaacctgatgggaagcagagagcaccggagcctgttgatgcacaattatgcattgcttaacaatggggtaatggactgagaaatgtgctgttaggtgattttgtcattgtgtcaacatcatagagtgtactaacacaaacctagatggtgtagcctactacacacctagtctatatggtacagcctattgcttctaggctatagaaccagtacagcatattactgtactgaatactataggcagttgtaacacaatggtaagtatttgtgtagctaaacataaaaaaggtaaagtaaaaatatggtttaaaagaaaaaatcatacagttatattgggcatttattatgaatggaccttgcaggactggcagttgctctgggtgagtctgtgagtggtgagtgaatgtgaaggcgcaggacatgactgtacactactgtagactttatcaacactgtccatgtaggctacactaaatttatataaaaatgttttccttcagtaataaactaaccttagcttgctgtaactttcttactttataaacttaaaattaaaaaaaatttttgactcttgtaataacacttagcttgaaacacaaacacattgtatagctgtacaaagtgtttctttatatccttattctgtgagctcttttctatttttaaaattttttaattttttaacgttttaaacttttagtttttttgttaaaaactaaaacagagtcaggatcatcaatatcactgtgttccacctccacctcttgtcctactggaaggtcttcaggggcaataacatggatggagctgtcatctcctgtgataacagtgccttcttctggcatacctcccgaagacctgtcttgagactgttttacagttaacttttttttttaataagtagaagacatatgctctaaaataatgataaaaagtataataaatatgtacaccagtagcatagtcatttattaccaagtattatgtactgtgcataatcatacatactacacttttatatgactggcagtgcagtaggtttgtttacatcaacatcaccacaaatgtaatgtgatgttacaacagctctgagctatggtgtcactaggtgataggaattgttcagttccgttttactcttatgagaccactccaaaatgcttttgtgcagcacatgactgtagttcatcctgggcagccttctggggcagatagcaggatgaaggcaagtggacagatctggagaggcaaacagaagctgtcactccaggtttacattttcttttggaagacttgttcacctaaagacactatcaatattgtgagctccttgagggcagacactggcctattcacttatctgttaggtcactatttaaatgattgttgaatgaatgaatgggtctgtttatttccttcctttctcttgacttgcacttatggcagctgactataacagtataattttgtcttggttagagccttgtgttctgaatagttaggcttcccataggcatggttaactaactcagcgaaacattccttccagtgtaattcagcttttaacaatctcattattaaaactgctaaacaaaaacaggtcactgtattaatatcttgagtcttttgtattattattattgtttttttgtggatatccaggtttagcgaggcataacattcatgaatctttcgcccttctcagtgctaatcagttagatttaattagattctctattaaattgaaccctgttatttcatttctcctcttacctggagttccactggcatgcagatggataaactttaatttaggaagcccacaaggcttttgtttcctacccaggctgcttcaagagaaccacacaaagggctaaagtagcttcattaactatctttagtagctttaaaagaagatctgtaaataatgtcaggtgtctcctaactgtccagagggcagaagtctgaatagacaccagcttattggttacacactttggcaaagtttcccatgcagtcaaattgtcttccctaatgattctcagtcattagggttttgaaagaagggatagagagcaaaatgtcacaagtgactagtttggaagtccctgggtttcttgtggtgctcaagtgtaagagcaaaagaaaatacatggtagagacgggagtgaaccccttcttcattagagctttgctgatctagcttgagggttttcaggttgtgtgtttgtgtttgtggggtacagtggaaaagccttagaatcacttagccatcaggtagaaatatgcctttgtcctttgctaaagagaatggtgttcctgaattcattttgatctatccatgaagttagcttccagtatgcttcttttctttatgcttttgataatgttcttttgatagctactccttattctcatgaaatctattgagattttacataatttaagtaggtatggagtattgattcagtgtctttgcaagtcactctgtctgattataatccttggaggacattttatggttctattttcagtgtcccaaaggacagacagaaaaagcatgaatagactcactcacatgtctccctcacatcatccataatgacagcattctctgcttccttttacagtgtagtgctgttaaggcaccagatcccttcattaatggttctctgagttcaggtcatgctatctctggcttaggccatgggcctagctaatttatttattaattatttattatttctttgatttctgtgggcctaatttttgtttaccatcagaagaatgcaagcttttttcttaatagaatctgaggttttttttttttttttttggtttttgtttttttaaccttttgtttctagtttctttttttcttttctttttttttttttttttgagacagagtctcgctctgtcccgcctgcaggctggagtgcagtggcgcaatctcggctcactgcaagctccgcctcctgggttcacgccattctcctgcctcagccactcgagtagggcgcccgccaacacgcccggctaatttttgtatttttttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggatgacaggcgtgagccaccgcacccagctgtttctagtttctttatatatcataaccatttaggatttgacctttctggccgggcgcggtggctcacgcctgttatcccagcactttgggaggccgaggcgggcggatcacgaggtcaggagattgagaccatcctggctaacacagtgaaaccccgtctctactaaaaatacaaaaattagccgggcgtgttggcgggcgcctgtagtcccagctactcgggtggctgaggcaggagaatggcgtgaacccgggaggcggagcttgcagtgagccgagattgagccactgcactccagcctgcggacagagtgagactccgtctcaaacaaacgaacaaacaaaaaaggatttgacctttctgcttatggtactggggtgaagaggtagggccgctggggaaaccagctggtgggcctgcagttgaatattttactacaggcatgttttattttgtgagtagagactccctgcccctgtaagtagacccaaatgctttaaatcgggcatagggctgggtgcggtggctcacgcctgtaatcccagcactttgggaggccgaggcgggcagatcacgaggtcaggagatcaagaccatcctggctaacacggtgaaaccccgtctctactaaaaatacaaaaattagcctggcgtggtggcgggcgcctgtagtcccagctactggggaggctgaggcaggagaatggcgtgaacccgggaggcggagcttgcagtgagccgagatcgcaccactgtactccagcccgggcgacagagctagacactgactcaaaaaaacaaaaacaaaaataaaacacaattggacatatattttcctgtttgcctcaggcttcattactccttaatgttgaattggctgttttagaggaatccagattctttaaattctctttccctgaacacttaaaaaatggtcttgtattctatagtaattataacttgtctttacatttggcttgggacttggctgcttttttatgtaaatcagatgattccttattcatcatgtaaagataacaccaactgtgtagtactttagagcactataaggtgcttttatttgaagttttaaactttagtttcttggatcattacaataatcctgtggctagggaggtgggtatttttctccttattatggataggaggtaatatatggtggtggttaagattatgggtgctggagtcagatcatttgagtttggattatatctttaataattactagcctagtctcagctaataaacccactcagtttcctaatctgtaagccacagagacctattttataggtgtattagtccgttatcacactgctgtgaagaaatacttgatactgggtaatttttaaaggaaagagatgtaattgactcacagttccacattgctggggcagcctcaggaaacttacaatcatggcagaaggcaaaggagaagcaggtactttcttcacagggcggcagggcggagtgagtgcaggcaggggaaatgccagacacttataaaatcatcagatctcccgagactcactcactatcatgagaacagcatgagggaaaccaaccctgtgatccaattacctccacctggtcctgcccttgacacgtagggattatggggattacaattcaagatgagcttttgggtggggacacagccaaaccatatcagtagggttgtgtgagaaataaataattcaggcaaagcaattagaacactacctagcacataataagtgctcaataaaccttaactactaaaactattagcattgttaatagaatatgaatacatggaaaaaataattaataagcataaatttctcaaacttctcaatgttctggttttttcctcttaagagggaggatacttaaattttggtgaatctcatttgtcttttcatatccctttgaggtagtgaaaaatagattacatcatctccattttgcagggactggttgaagtccagtgagaaaagaatacaggctttggagtcaggtgaggttcaaatcctggcacttccacttctggttatatatctctaaacctcatttttctcatgtctataatggggataagcagaactttgtttggaggtttgaaggagataatgcttacaaaagaaataatgcaaggtacttagtatacttaccacatactgtgactcagtaaatgtggctgttattgctgttgaggggaggggactttttacactggcccagggtcacagttagttgggcacccaggttccatcatctcttacataatgatgaatgtactgcttcatctgggtatgttgtttctctacattttaaatccaagtgttttgatcttttggttactaatttatttttaatgtacatattatggacactggctctgtgtgtcagcagactatgaacaatgcctattgcatcaaaatcctaagtttacctcatgtcacaagacaaaagttaatgttagtgaatccacatgaccaacaaggaatatgacacttgcagaatctgtcagatggtgtttgggcagctattctcagaaattgaaagcagcaggtgtttattaatatttactatgtgttcggcattatgtgaagtaggggacacaaaagaaacaccatactttattcatctctcacaagaaacagatgtgatagaaacatgaaacaattaacaattaaggagcaataataacactgtgattcacagacatgtagataaaaagacaagtagagccacacttaaagcatattcaatacatgataatagagttattaacagggagtgctgaggaggagttatgtggtatgtatgcatatgggtggtggtgcaggttccacggcaaggtgctgcttgaattgttgactagttgggaatgcggtggggagtattgagtgaagagaatggaaaatcatatttgtaaagacaatgagatgtgaaagagcctgcggtagtaaagaacagcatttgtttagtatccctcatggctggagcttaggatttacaggaggagtggtgggagagcaggctggagaagtgcactagggttaagtcattaaagaccttgtgtaccatgctgtagagtatgagcattaaggtgttggcaaccaagcaggcaagagatgattatatcagtttttcagaataattattctagaaacatcatatagtaaaacagaaataagggcccgaataaagtcttacaataaattaaactgaatagatgaatgaatgaatagtagtgtgagtattagacgatactaacttaaatgttttaggagtttagaaaaaggggacaccatgatgggaataatattcgaagaagactccatgatgaagaaagattttttatttttttatttttttttgagaaggggtcttactctgtcaccaggctggagtgcagtggtgcaacctcggctcactgcaacctccgctgcccaggttcaagagactctcctgcctcagcctcctgagtagctgtgactacgggcatgcaccacaatgcccagctaatttttgtatttttagtagagatggggtttcgccatgttggccaggatggtcttgatctcttgacctcgtgatccgcccacctcggcctcccaaagtgctgggattacaggcgtaagccacagtgctgggccatgaagaaagatttgagtggtcagcccagggatttatctatagtagctagccaataaactggatattggacaaaagtacaatttatacaggacagaagacaggaagtaataccaagttgcataaacatgtgtgaagtggtcaaagagacaaatctaactggataagaatggtaaatgatacaatttcgtatgcataatggtcccagattttggaagccttcgaaatgcctggttgaggcgtttagatttatttcttaatcaataggaagccattaaagattcttaaacagatatttcaagattttcagtttgggttagaacatcttggttggaggaagatgagcctgatgagatgacaccagttctgattcttacatttaatggaaatgccagagagacttcattacttttggacaggaaaataaagtttaatgaccccactttggttatgggtagactgtggaatagtagttcactgttgggagacaaaggaagctgaggcaaaaatgaatgattgcccatatgagattttcagtgataccagtctagggaaggatagagtaaatagaaagatggtagaaactgcttgctctgtggagactattagggatggcgaaaacatagtgtgcacggtcaatatcttattccatacccatagcagacattgttaattgattttggtatattttcctatagtctggagccctttttaatgcagtgctccaggcaggctactattagttgatcagagttggtgctggaattcaaacctgtttgtcatgcctgtagtaagaaatgaatgagaaatgggttatgactactcacagtacaaatcagtttttacctttccaggtggaacttgcagaaatctgtgccaagagtgagcgttacattggcactgaaggaggaggcatggaccagtctatatcatttcttgcagaagaaggaactgtaggtagcattccaagtaggaaccattcagaaattcctagtgggaaaatttacatggagaagaaggccctgagagccccaggatgcttggttatggacagcctactatattaggctctattgtaggatattatttcccaactgcttgtaactcaaggctgccaccagttaatctactctatttcatgttgattgcctttctcttacgcttccagaatgatactcaggtctgtttttctcatgtgtctagctttttcccctcttctatttttcttcattgttaagatgagctttctcaattccctagttattggaacctcatttcctgctcctatcctaaatcacttcatctcatgcatttttataatctcttgttggttttaaacccaaatcatagttctcttaccacatatattcacagtccctctttttataatttactctttggtatcatttttcctgtcaacatttttggggcttcagtggtgggaaaaagaatgttgccagtaagccaggaatgaattccttagctggataccgcttccccttggctatcaactcctttaggcagagcagaggttttagttgttgctcataagctgctcatttccaaaatagagcaaacatttctttaaaacattttcttagtttttcatcagattcctacaggcttggctattttccaagaacacctggattccttcttagtaagaatatttgttattgattcccctaagccaaagacatgaggcatgaggaaatttgttttaatactaagaaaatactttgggtgttttggatgagacgcaacaggcagacatgagggccagagtcctgatgttaatgtaagttagctatagagtctgaacacagtctaagttctttgggcttacaaaacacttcaccatctgacccctgctttacccttctatcctaacctctcaccacttctcacccctcaaactgtaagctctaaccaaatttccatgcccgtagctccattaacattccatgttgttttttgcccctggacttgcctaagttcttccctcttcttgacatgctttttgaggaaagaaaccctctgtctgccctacttttttcatcttttagaactcagtttagatttctctttttcaactgagtggaacctacagtaggctgtactgatgagatgcttcagctatgtatccatatagcatctgtgctttgctaccattgtaacacaacttggaaaggtatttgtctgtctactagactgtctttcccacttgattgcgggctctatgagaggaatgacagtgtctttcctgttcactgttgtatttccagtgcctagtacagcgcctggaggtcaataagtaatatttgaatgaatgaatgcatttttgacaaaacactttaagataaatacataaacacttgaacattttctgcattctaataaattatatttctcctttcatttttcttctaacaggccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaaggtatgaacttggcaggctagtgaaacttgaagtagggtttttcttgtctttattttcattgttctctattactttatctctttccccaaattttagggcaacattctgactgcacagcattccaactgaaggtctttgggtacagagaaatctgatttctaactcagaagacagatgaaccagttgagtcttctggggtggcactgggaagaaaagggcagcttatatatgtgaagcagaattataggttaggtctatgggtggagaaagatagttggggacaattgatgggaatgaccacagctggtcttgtttcctcaacaaaagtgatggcagcctcacccctcctggtcctctaagatgcagtttttttattgggttatcattcgttactccaaaaatacaggattggtgaagtccccccagaccccgtacccagaaagaagatttttacatgtctactagggaaacacaaaccagcagggagtcttggaagtctctctttagaaaactgccacagttaaaccttaaatctatttaggtagtattcattgactagctattgtagttctagcggcatgaagatatacaaagggacataggacatgggactagagagagtggacagtagagttaagagttcaagttaagggattatgaaacaggaaatggttaatatgtgatcagatagtaagtaatccagtgatccaacaagtgacacagtaattaaatattataaataatccagaatagctcataatacgactagaaagttggagagaggactgaggctggaggctaggaagtggattctgggtcaggagctccactgtgctttcttccactcttgctttgatctcctgatggatactgatggatatcacctaagacttatgatcaacctttaccaggtcttaaatacagcctgaaatctattttctcagtagtaataatttcataccttctttacttctctcaaatacccattacttgattcagcctaacttccaaaagtgattttctcccatatttcatgttggaaatagatgtggtcacatagactttggcttcctgtcatcatatctgtatgtctctctatatctgcatctcctgtcaaagccagcccttccatgtgtggctgcagggaactcactccatctttaacttgttcctcgcctctatttctctactaaatcctttctatcagactccacctattctagtattttgtattagaaaagtctaccctaagcctcacaactctctccatctactatttctatttctactttttcattctcttcacagctaaacttctcaaaaattgctttatatatgttatctttactcctctacctccctcttattccttaatttactaaaatctcacttctgcgttctccacaatgttgaatttgctctttcttaggccaccaaaggttttttcattggtaaatccagtggatgcttttcagtcttcatcttatttctcattgttatttcttatctttcaacagagttaaccagtctttccctcttgaaatattctcttccttaggtttccagtatacttcacttcctgttttttcttttcccccttatatttttgttgctatttctttttagttttagccattccctccaccgacccaccctgggcagggatgaagggatggcaggaattcactcctcctcccacagatgtttaaatgttggtgttcttcaaggccttggccttggtcgtcttcttctttctagtggtctttcttctgttggtctcatgccctcagcttcaacttccatctctatgatgatgacttcctaataaacatcttcaactaaggctttcttggttgagctccaaacctctatatcccatgccttattgaccatctttacttgaatgaatcatagacctctcaaactgagcatgttgaaattgaactcagtctttcacagaccttatatttttccatcggtcccatcatcacttattgactatcacattagccttctcactgttccttaaattcatgctcatctctttcccaatcattctttaaataacagcatgacggcttagaaatttaaatctgagcaatttaaattcccctgcttaatacctttcaaaagcttcctatttcgttggaataaagtaaaaggtccatatcacgacctggagagccaccatatctgagacctgtgcacctcatcctcttcatctcttagcatcacctgctttccttacactccagccatgagactcattctcatctcagagactttgcacctgcccaggacattcttccttcagccctctttgaagtcttagtctaaatgtccctcaaggaagccttccctgacttccttactcctagactaagttagagccccctttatattttgaagcacttcatttttcagttatggcacttatcacaatcatttatttaatgtctgtctcttctttcagattcagttttacctgagagctgaggctgtgtttgtcttgttaactcttatatccctaatgcttgatgtgatgcttaagctgaagagacacaggataaacatttgttcaatagatgaatgacaactccctgtatcacctgctctgtagtttattttgcacaatttcacagttttttacaagtacctattgtatgcttagcactggcctagatcctgtggaggtgtgtaaagtatagttttcccttgttactgacttagcacttctcctcttacttctatcctctgaggttgggaaattcaggaaattagagatatactgaacgaggaaaataaaagctttttgtttctggaatatttggggggcatacattttttgaaaaattatgatttaaatgttttgaatttttaatttacttattaagatagtgtctaaaaataatgtaatagaagtgctttaacattgaactcttcatagtatttgatcagtgcatatgtgcagagaaacagttctgtaaactttttaatatcaagggttcaatgaactttttttcttttacgacacacttcctttttcaggagatggaagaaattagtgtcttatttgtttgagggcttagtcttgttgaccttttatcttgaggttgatgagtaagtgttgccttcctaaggagacctcaaacatacacaacattgttttcaaagttttatcacgaaattagatatcctctaccagatccataggtgagctgaaacaagtattagacatgtaaaatcagttcatgttgtgactactctcccaaagatacaagaagaaaatgatggataaaattgtagtgctgagtctctgtagtaaaagttattgggatgtgggaatgttttttgagagttaactagaaaaagggcatctcctttggaagcagtagtagctgaagatcttaatccactgcagaacctcctgttcttgaggatgttttctcagtttaactgcgtaaccccatatgcattttagaggtactttggtcagcaaaattggcatctgaatttggctttttgctacacactcctcccaattgacgtagataaacacactgttttaaatactctgaatttttctcttttaaaatgtggaagaaagaaaaatgaaagactttatcaagatggaaaatgttttctaaatcatgttgctgcaaatcactaaaatcccaggttttatacaaaagggaaatgaagataaaactgctaatgtgcactttactcagagatattgatattaggaatatgcttttgcttaggaatataggctggaattctactaagcatattttctttgcaatatggttctattcttccatttttggcaacatgtgaatgaatataattattgtttgaagatggtctcattaaataaataacctctcatgtaaaaagtttaaaaaaaagcttatctcaatctgaccaaactttctgttttccaacaacaataatgaagtgtcagttgaagaatggctaatcaagatagttttgaaaatgagactgagactgatcagctagggctccacatggcaaagttgtaatgaagaacatttatttttcctttcttcctatttttctcagatccttttttgaaaatgagtacctttttttaatcaagttaacacagagaagtacactaaaccagtaaagacaatttttctttgttttgcattaatgctagcaatttcttctattctcaacttctttctcatcttgtttctctgtctctgtctctttctctccatcagctttcaaaagctaattcatgcaaattcataaaaagtcagagccttgtagagcatttgactaaaattaaaaatttttcaaagcaaactcgagatttataattactacttgtataaatgatatcttaatgaagcacatttttatgataaagtagccaaggatctttagtaggtacaacatttttcatattttacacacatttggggcttaaatgtttccagaagtgcttttcttatacagtatcccttagttatgttgaagaataaaatgtgtgatacccatgataagtattatgggaagtcaggtagggaagagaaattatactgttgctttttgcataccctgagctccttgtggcaacatgagaagcagtgaaagagagagtttcatatgttcctttgacacttcaaggaaaatttacagtgattctttacagggcctgtctggtcaggggccatcagtcacccagtttttcagctcctttcatttagtagttggtatgaaacttattctttgtctggtgatagaatgggaggagaagttggcataatagtctcagggttttggcagtttccttgaatttgagcagagaaaaaccaaatactcaagaatgtagccaatttcacgcagccagttgattcaatagtgcatactctgccaagactctggcatggagtattcaggcaatggtgagtccgagctgcatggcagaggacatacatactggggaataggggtaatgtgtttagtggaaccagattgtggcaggaccttcagtgctatgctcagccttacccaggcttggctttgaaagcagtggttgttagcaaggtattttagaaatattaatatgacagcaggagcttttgccttggttgaagagaagtaggtactagagtatcagtgaggatgggataaaaagggagagatgtgagagaagctctgactggacctagtaagggttgggtacaggctctctgtgattggatttttgttttccttctggcatatacttcattactttgaggaagttttccttgactacctcctgacctcagttaggtgaaacactcttttatgtgctcttaccatgtcctgtatttttctattatagcagtttatcataattggattaagttctttatgataaatgtagttttaatttaacctctgtcttttctggtgggctgtgagctgcacgtggtcaggagccatgtgtgccttactcactgctgtctgcctggagcctgggaagtaataggcactcagtagacactcactgtgagcagatgcacatgaatgaaggaaatgaagaaaaggtgttgagtcaataagggctgcagcttcaaggtgcaatggttggtgaaaagcatagtgctgccattgataggttttgagaaggcaggatggactagaagttgactaaaaagtaggagatgatgagaattcttcatgaatatcttaacactttctctaccataccctcttaccagaagacccagggagtctcagaccaagaacagagggcttagtatttttgtttgtgtctgggacaacctgaaagtgctagggagttaatatccttgagagccacctcaatcagtggtaactgggagttattgggtaaatactttggctttcttgcccatggtgggacatgactgagctttacacatacaggttcctgagaacctgtgatttgaagctcagcgggcccagactcacctgccaatatcagtacacctcatattggcgtcttttcctgtttcactttccattcctctcttaatgcttcttaggatcaccttcccctcaaattcttaccctcaaatttttgtcacagggcctgcgtctgagagaaaccaacctaaaacagagttttagcaccatttatcagtgcctctttccatgactgtggacaaagcacttgttgcctgcttttttgtccacagagcatggaacagagctcaggaacctctcagaagtggtatctgataggaatacttaatgtttgccatggtgaaaagaaagtggtgaatgtggacaaagaactgccttctcttatttccccaccctactactgagtgagaaagttgtgacaaaataacctatagccctgacttatagccctgcttcacaaatgtgaaggaggccagtcacctgggccacaagtgcctccatgaagctctgtctttgaacaatggtgatcttatccacccatttccttcatctgaaagtcatctttctgtttttcaagccaaatttcaaagggcttaagaggcttttctatttgactccctcaatgtagtgtaattcaacagctcacgggctgtgcagctgtcattgagggcatatggtagatttcatccttaattgaaatacacaccaaattggctgtgtggattctccagctgagggctcactggacaactggtgtcacagtaaagtgggatattgctggagtgaatgtgaactctatgttagtgcctcaatctgcagaagagcacatcaggaggctgcctttgaaaactgaatcttgtgggctgtagccatcccttgcagactttctccccacacatcactggcccagttttcttggatcaagtgcctggggcaatgtgactggttcaagagagaatgggaatgggaacttggagattactgtggactgaaagcttcttaggaagagcccactgtcatctcttgggggcagttctgtgatgtttttctttttttgtttggaaggaacccatttatcaaagtgtttttaaattactggaatgttcacttctagcacagatctaggtttgtgttttgaaatgcgtttctaagacttgatcggtgattttaattcatgtgggtaacatgatatagttatcatgcatacctcattgagaacgtggcctaggggcagcaagaaagagttataagacctggattcagtttccaactctgttattaactagttgagttactttgtttttttgttttgttttgtttttttgagaccgagtctcacttcatcacccaggccggagcacagtggcatgacttccgctcactgcaacctctgcctcctgggttcaagcaattttcattcctcagcctcctgagtagctgggatgtcaggcacatgccaccacgcccagctaatttttgtatttttagtagagacaaggtttcgccattttttttttttgctttttgttttttgttttaaatgacaccatgttccatgaaataattgaaccgaaaatcatagttctattgttttgtttcccagtttggccttaaaatcattaactcatttcaaatatacgagccagggttttaaaaagaggattaaattaatataagaacttctgttattaacattcttcagaagtcagtggctgtaaccagagtacaatagtcttttggtaaaccccgcttcctgtcaaaaagagaaaatcatcaacataatggaagagtaaatcagatgcacattttcttgaagactgatttccccttctcttgtttctttttgctgcttaaaatgcccctctgtcttcacacccaggcaatgaatattgtagacctcaggataagagaaatcctcactgttttgattgccacctactctgatattgcttggggagaatgacagaaatatattctggattggggttcccatgggtggttacagatttggtttgtacttaacccgcactgtcagattgaggaggtacctcaggatgcagttagaagccaaactctttttcttgagggtagaggaacatatagctctactaccaccagtgacctaatgaagtgcttcccataaagtcaccaatgaggttttcatttcaaatttaggactttaccccaaatgcccatataatgccattttcaaagagacatatagtaaacaggaagtaccctaattggatgtacagtatcctctcaggacccaggtcacatgagatttaagtagttttctcttgacttcctagggaggaatgcagtaggcatgaactgaataaggataaaagagtaaaattattcaaagaaacagccctgagggaaagtggtgacaggccaaaaaaaaaatcagtgagagattagttgtgtgtgtttgcgtgtgtgtgtgtgtgtttcaggacaaatacctacctagtctgtgagtgtaatacagacatgtttaattccaggcatctgaagccagtatgcatttccaagtaatggtgggaaagttggataggttgaaaggaaaacaacaacaaaacaaaaaacagcttaacgttgaatctggctaattaaaatagtacacatcaaattctgaatcaaaactgaccattatcttgatttgaatttgcagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatggtgagttggctggagaaagtatgatatatgttattccctcacttacagctggaaggtttcaatttctccactggttttagagaatacttgagggaatttggagactgtgttttggcaagcttaattatttagaatcttagcttcataaatgtattcattcattctttcattcaccactatgctgggtaggcaagggtgaatgagacatgattcctgtcttccaggggcttataattcagtaagcttctcttttttatcttttttttcccttatccatttttttctggttattatgctacttgtataaaaaatggactaagttagagaactgctctaactctgtgaaacaatactcggaacactataaagtgttcacgtcttaggttgaaacttgtggcctactttagtgtggaagcttatttctatttgtggtctgctttcaattaactttatttttataccaataacatcagaaactgagatgaagcccaggtaaatgttgcaggcacaggatggagtcttgggctggcttgttcctcttagactagaggttatctatttgtgacaaatcagtactgggggcaaggacatctagttaagatccagttgcccttagcggatggttatgggggatgagtaggagattaatacaaacatcagcctcagggacccatttctgtctcattcagttcagttctacaactggttgttgagttgctactgtagatttacccacaaagtaatgtcttaaaggctggaagtactgaaaactttgggatgagataagggaatcatttggaagtagggattgggttttagtttctaacactgtcgatccaatttaatttgatgaagcttgattgagtctttagaaccagaataagcaaactatggcctactggccaaatcaggcctgccatctgtttttataaaataaacttttactacaacacggccatgtattagctatggctgcctttgcactataagagttgagtagttgtgatagagattaaatagtccacaaaacctaaaatatttactatatggttctttgcagaaaatgtttgctggctctcgttccagaaaggcagtagactaaagtttaccttagttttgccatgaaaataggcgtaacaggaatgcctctaagaataatctgtataatgtgctaagaataatgcttggtagcagaggtactaatagagtgatgagtgtggtgatggagttgtacttgggtctagggagaccagaaaacaaagaagtcaaagccagcttaaggccgggtgcaggggctcatgcctgtaattccagcactttgggaagccgaggtgggtggatcacttgaggccaggagttcgagaccagcctggccaacatagtaaaaccctgcctctaccagaaacacaaaaataagccaggcatggtggcaagcacctgtaatcccagctagtcaggtggctgaggcatgagaattttttgaatccaggagacagaggttgcagtaagctgacattgtgccactgcactccagggggagaccctgtctcaaataaataaataaataaataaataaataaataaataaataagaccctgtctcaaataaataaataaataaataaataaataaataaataaataaataagcaagcaagcaagctagccagcttaactaaggagttagcaaccagccaaaagttaaataataaataggtatttcctaggtaggcaaacagtcagaaagaattccagtctgacaaaacagtagatacagaggcagaaagaagtgagagaagattatatgtccagggaactacagatagttgagtgtttcttgaaaataatgtacatagtagagaatgatacagtatcaggccaaggttgtggacagacccagatcaccaaaggccttattaaataatttgtgtgtgtgtgttgtataggtaatgtgggaggtaatcaatatttattgaatgaagaagttgggtaaggtattggatagggagaggttcaggggaattgcctttctcctttgacctgagatattgatttctttaacaaatcgtattgacttctgtggactggaaattgtgctagatgctgggatacaaagataatcaggacacagtctctactttatagtgacttagtgtctaattgggggagagtgccatacaacaatcacaataaataatacctgctataataaaggtatttatcaagaaccctaagagtatggagggaaaagtggctcaggtcctgtagatggtggttcaattttgagctggatccttagagaaagttatgaatttcctagacttagagagattaccagcctttccaggtggagagtagagcttgaatgaagacaaagtagcacaaggagtcgagtactggagaacatgcaccaagaggtattgtgtgcagtatgagttagaagacaaaaagactgcctaaaaggatgccaattaggaaactattgctctatactctatactgaatgagaagagcctgaagtaggatagatggctcaactggtagattctcaagactgtaaaatagaattcagttgcaattggcaattgctggtatctaggagtgaaggaaagaagaaagagaagaaggaggggaaggagggagaggaagaaggaagaaaggaagggaagaagaaaagaaatataaggtaaataaatccaaggtatggataactgggaaagttaggaaattatagtattgaagtgattttggcagtaagatgacaagctcatttctctctctctctctctctctatctatatatatatatagatagatagatagattcatctatctatcattgaatttgtctggtgtgatagcaagatatctaaatagagatgtaaaacaggtaaagatccaaatgatataataattagatttgggggttattgttgaaaaggtgagaaagtcttaatagacattgaaaatgttgactatgaaatgattttaaaagagtcatttcatggtgtcacttagttcagaagccttcagaggcttaccattacctaattgcctgagctcttctagtcctgtcttaactaagttctgtcctgtgtcccttttgagcccatacttgcctgtgtggacagtgttaccttggttggaccattccacttactaattggaagcttggtcttccctctgggcttttaatcctaaataccactgtgcttttataaatgaattttctcccttttctgaaatgcagtttctacctgtcttaaaagcttaatataattcttatcttctgcttatgcttcttaatccacaacctattctcttgctctgtatccatcttcctttctttctgcatctgcctgtcttcctttcttttagattttttttgaataagtaaatttcccagaatgctttggaaaatacaaagagcaatttgcttatcaaacaacatgtattgctctctctctgcctctctatgtatatattcataagcttttcctcctgaagaataatgacttcatggtttttgtaaaaatgaggcatgcttcatcttatttctttttttccagaacttttatttattttctttttcaacttaattttaggttcagggcatacacactaggtttcttacatgtgtaaattgcatgtttctggggtttggtgtacacatgattttatcacccaggtagtgagcatagtatccaaagggtagtgttttgactctcactctcctaccactggccatcctcaagtaggccctggtgtgtacttttcctttctttgtcaccatatgtactcagtgtttacctcccacttacaattgagaacatatggtattttgttttctgttcctgcattaatttgtttaggataatgtccctcagctgcatccatgttgctacacaggacattatttcattcctttttatggcagcatagtattccacagtgtatttgcaccacgttttctttatccagtcaactgttgggcatctagtttgattccatatctttgctattgtgaatagtgctgcagtgaatatataagtgcatgtgtctttttctttttttttttttaagacagagtttcactctgtagcctaggctggagtgcagtgatgcgatcttggctcactgaaacctctgcctccctggttcaagagattctcctgccacagcctcccgagtagctggggttataggcacctgccactacgcccagctaattttttgtatttttagtagagacagggtttcaccatgttggccaggctggtctcgaactcctgacctcgtgattcacccgccttggcctctcaaagtgttgggattacaggcgtgagccactgcacctgtccacatgtgtctttttggtagaatgatttatattcatttgggtatatacccagtaatgggattgctgagttgaatggtagttctgttttaagttctttgagaaatctccaaactgttttccacaatggctgaattaatttacgttctcactagcagtgtataaacattcccttttcttggcaaacttggcaacatctgttgttttatgactttttagtaatagccattctgactggtgtgagatgatatctcattatggttttaatatgcatttctgtaatgattagatattgagcattttttatatgcttgttggccatgtgtatgtctttttttgagaagtatctgtccatgtcctttgcccattttttaatggagttatttgtttcttgcttgttgatttgtttacctttttcatagattctggatattagacatttgtaagatgcatagtttgcaaaaattttatcctatctctgtaggttgtctgtttactctgttgacagtttcttttgctgtacagaagctctttagtttatgtctcacttgtcaatttttgtttttgttgcaattgcttttagagatttcatcatgaaatctttgtcaagttctatgttcagaactgcatatactggctgttttttctagaatttttatagttttaagtcacacatttaagtttttaatctaccttgagttgatttttgtatatggtaaaaggaaggggtccagtttccattttctgtgtatgaatagccacctatcccagtaccatttattgaatagggagtcatttctccattggttatttttgttgacttcgtcaaagatcagatggctgtaggtgtatggatttatttctgagttttctattctgttgcatcagtctatgtgtctgttgttttatgctgttttggttactgtagccttgtagtatagtttaaagttgggtggtataatggctccagctctgttctttttccttaggattgctttggctatttgggcccattttttatttgaatttttgaatttttttttttctaattctgtgagaaatgacattggtagtttgataggaaaagcattgaatctgtaaattgccttgggcagtatggccattttgataatattgattcttcaaacccatgagcatggaaagttttcccatttgtttgtgttgtctctgatttctttcagccatgttttgtaattcttattgtagagatctttcacctccttggttaactatattcctaagtatttcattctttttgtggctattgtgaatggtattgtgtttttgatttggctcttagcttggacattactggtgtataaaaatactactgatttttgtacatggattttgtatcctgaaactttactgaagttatttgtcagttccacgagcctttgggcagagactatggggttttctaggtatagtatcatattgtcagtgtagagagatagtttgacttcctattttcctacttggatgcattttatttctttctcttgcctgattgctgtggctaggacctccaatactatgttgaataggtgagaatgggaatccttgttttgttctggttctcaggggaatgcctctagcttttgcctgtttagtatgatgttgactgtgggtttgttatagatggctcttattattttgaggtatgttcctttgatgcccagtttgttggtagtttttaacataaggagttcttgaattttattgaaagtctttatttctattgagatgatcatatggtttttgtttaattctgtttatgttgtgaatcacacctattgatttgcctatgttgaactaacctttgcatccaaggaatgaaggctgcttgatagtggtggactagctttgtgatgtactgctggattcaatttcctagtttttgctgaatagttttgcatctatattcatcagggatattggcctgaagttttctttttttgttgtgtctttgccaggttttggtattggaatcatgctggccttatagaatgagttaggcaggtgtccctcttcttcaatttttggaataattccagtaggattgctaacaggtcttctttatatgtttggtagaatttggctgtgaatccatctgctccagggctttttctggttggtagattttttattattgattcaattttagaactttttatttgtctgttcaggaattcagtttcttcctggttcagttcctggagtttattcatttcttttaggttttctagtttgagtgcacagaggtgtccacaatagtgtctgagggttttttgtatttctctgaggtcagtggtgatatcacctttgtcatttctgattatgtttatgtggatcttctcccttttttctttattaactaggcagcagtctgtcaatcttatttattcattcaaagaactagttttggtttcgttgatcttttgtatggatttttatgtctcaatttcatttggttcagctctgattttggttgtttcctttcttctgctagctttgtggttggtttgctattgttttcctagttcctttaggtgtgatgtttggttattaatttgagatctttctaatgttttgatgtaggtgttcagtgctataaatttcctcttaacactactttagctgtgccctacaaattctgatatatatttgttttcattagttttacagaattaatttcattgccttaatatccttctttacctaaaagttattcaggagcaagttgtttagttttcatgggattgtatggttttgagagatcttcttggtattgctttctttctttctttctttctttcttttctttctttctttctttctttctttctttctttctttctttctttctttctttctttcgtgctgtagtctgagagcgtgattggtatgattttttttttaatttgttgagaattactttatggctgggcatgtggtcagtcttataatacgtgccatgtgcagatgagaagaatgtatattctgttgttgttgggtggagtattctatagatatctgttaggtccatttggtcaagtgctgagtttaagtccctaatatctttgttagttttctgcctggatgatctgtcagtagggtgttaatgtctcccactattattgtttggttatctaagtctctttgtgggtctctaagaacttggttttataaatctgggtgctctaatgttgggtgaatatatatttaggacagttaagtcatcttgctgaattgaaccctttatcattatgtaatgcccatttttgacctttttgatcattgttagctttaaatctgttttgtctgaaataagaatagcaacccctgctctttttgtcttctgtttgcttgatagatctttctccatccctttactttgagcctacatgtgtcattgcatgtgagatgagtctcttcaagacagcatgcagttgattcttgcttctttatcccactcatcactctgtgtcttttaagtggggcatttaacctgtttaaattccaagctaatattgacatttgagggtttgatcttgtcattgctttgttagctggttgttttgtagcattgattatataattgctttatagttgatatggtttggctgtgtccccacccaaatcttatcttgaattgtagttcccataatcccgacatgtcatgggagagatcctgggaggtaattgaatcacggtgccagttatccccatgctgctgttttcatgattgtgagtgagttctcttgagaactgatggttttataaggggcttttccaaccttcacttggcacttctccttgctgccaccatgtgaagaaggatatgtttgcttctcattccgccatgattataagttcctgaggcctccccagccatgctgaactttgtcaattaaacctctttcctttataaattactcagtctcaggtatgtccttattggcagcaagagaacggactaatacagtagtgttggtgggctatgtacttaaatgtgttttgtggtggcaggtaccagttttttgtttccatgtttaacacttccttaaggatcttttgtaaggcaggtccgatggtaatgaattcccttaggctttgcttgtctgaaaaggattttatttcctcttcacttacaaaacttgtttgtctggatatgaaactcttggttggaatttcttttttttaaggatgttaaccttgaggtgacagtgtagggagagatgttcaaatcaagcagtggcttgaagcttctgttaaactagccagacttccaaaggcccatgcgcagttcttattttctgtttccaaatttctaataattagatttagaaatgctcagtggccattcaaattaaacacacacaaagcaaaatccttcaatcctttagatgttgtttagaaacttttaggaatagtttcaggcttatttgccaggccttacccacaggtaggaattgtctaagggtgtggtagagtggtctggagtcttggagcctcaggggccagacttaattgggagggatgtttcccatggtgtgacccaagaagaaaatttgaagctgtggtcagggtaaggagagataggcagatgtatcaagcgtataactcaagaacacacattggaggacagaagaatttctgagaaggtaaatgggcagtgaagtagagagaatgggtcagttggtttagattctagcttaaaaaaaaaaaggaatttgttgggagcatttcttttgggagtgtccaaactgctctgggttggggtggcccagctgcttagccacactgtgctggggtagacccaaatttcattacttcagttatcaactttgcctgtgaccacatgctgacaaagtgctggtcagttcctgactcatttgtttgccttgtatgatctccagagtcatgggtgataatcatgacttttaataaagaacaaagccctgatgtagattgctttttaggaagacacctagagtcaatggtaaagaaaaaaagaacaaaacaacttgttatacactttatagttcccacgtgaccatttacacacaccttctaatttgaatctcacaacaaccctggggcacagggttatctgcatttcacagatgaagaaacagaggtgagagaatttagtgatttgtcaagaccacataggtggtacgagctggagccggactccaaatcctagtcttctaacttaatccagtactttttctgccatcactttttaaatcttggcacacttataagctgcccttagcaatcctgcaccaattacgggaggtgatatcagtattttgactttgcttggctctaattttttcttgagactaaggagtaatgataaagataggtagctttatgtccaaagagtttcctttatggctatttcccattctagtgttttggccttagaagagataagactgtgtggcatctagaagcttgctttatttaaggaacaactcaacttggccataatatgcataagctgttgtgttctagaagagccatgagaagtgctatggaattttcacgtttaataaaaatgcagttctcatagattatcttggttaagtctaagaagattagtttgtttttatctaataaaaagtataaaggtgctttacaatgtaaaaagggtcagttgtttagtaatttaaatgtccagttgagggttctcaattatgaaggaaattgatttaaatgtagcttataagatatcaagcactaaactctgtgatctcaacagattccattgttcttcttgtaaatgttttggaagaaaagttttccatagaaagctagacgaaactccaaaggaagttttagacccttctagagtttacagatgttggttgaacagaaatccttaaaatctgtgagatggacttctaatgagaaagccaataaaatgggtcctttggttttgtctattgtttttgtttttatgagaaaaataatagactgttgtaaaacaaagtataaaagaataaatcaaataataatgatttttctttcacacaaaagatattattctttaagttgttttggaagtcaagtttgcagaaaatttgctttcattagtccttttttctttctctctctgcctggtcacttccttttgcccatcagcttctattgacttctcagttgtctggctgtggaggacaggttcatgccaggaataaaggttcctaccttgtttcctagggaaaaaaaatgggcttacctgatatcgcagataaccaggaaattccacttcctctttcagatgtgtgcgtgatatgtccctattcattggttcaccttcccccttcaaaactaaaaatgaatgtgaacataccttattaagtaggatttttaaaggcacggcatcataaaacttgcaacttctgtaggaagagcctaggacatgtgttggaatcacaccagtgatttgtgttgtgtgttggtcagcttctcagccgctggtaggtaggtcagtactcacagtgtgactcttgtcccacaaggctaatggtgaccatggttctggcttctgaggccagcagagaagtaacaatgtgcatgaactgccgtggcaccagctgctcctatgtagacctttgaagcatgaaaaatacatgtctctcatcattcttagtatatttacttatttgctcattttccctgtatgtacctggtttcctgaccctgccaactatcttcttcactccagctgcctccttggccttggcatcactggcctccttggtctcctcagctctgaccaccaccttggtccagccttgcaggcctctttgtttctgaccctgtagttcctgtacatctcctcagccccagctgcttctttggctctagccttgctggtcttctcatttgtggctgcctcaaggggaaggaagggaagaaaaggaaaggaaaatgtataatttctaaacttgtaaatatatgtatttaagtctaaggaaatgttactcagtattccctttgcttaaatttatcatggatgtatctctgtctttcaggagtgaaattatcaaaggatcagctgtgaagttattagatactatgttttgagtagaatgaggcttctgcagatataaggacatctcattgtctcctctgtcactcctctgctggtttggaaacatctataggaaagcatcttctatagtcatcatcaacctaagaggccaacatcttgccatcctattttccttttttgctacttatgctttcatttttacattttgtaggtttccacataagtaagtgttctctttgtatacaaagcagcttttcttatggtgaaattcatttattttggtcaaagtgattgtcctgtactggtaagctcaaactgattgtgcttcagtaacaaacaatttcaaagtctcagtggcttgaccaagcaaaagtttatttcttactcactctttatatctaacataagtcagcaaaagagtttgttcatctaagacacttatggagctgggctcagagggctccatctcaacacgtttgtccacaatcatggcaggaggaaggtaatgttgttaattgctctctggctcttaacatctgccagagtgactggcatcacccctatgctcattcgattggccaaagccagtcagatggatgtgatgaacttcagtgagggtgaggtagtacagtcttaatatgtgtgaggatagctggaatatttggaagcagcctaatgacaactgtactttcccatgttgagtggctatgagtctcatcccatcaaatcttggtgataccaatgagaaccaatttactttctcatatacaaatacgaagttgacattttttccaaacatctgggacaatgaatattgctcttgatcaaatttcaagttattttcatttaagaattagacagacatactgtgatctctttttatgttacacatttctctcatactggcattttatctgcacatgatctggtgaaagcttacttggtaatgatggcttgtcactttcttccctgtcttgcagagttcatggtctcttttcaggagccagtcattctaatatcctagttcaagaaaacatcttcttctgtttattagttgttcaatttctgtagtcctttttcaaagtacttagcttcaggtggaagaaagtttcctaataatttctaaattagaaattgtatgctattttctacctactgtgccatttgtttccaggagagtcagctgaggcgagtaactgtggatggatctagtgcctttttgcaggttattgccaaatattaatagtaatgacaacaaaaataatgacctattgtatgtgtatagacactaacagtttaaccatatgagatctcatttgatcatcattcatgtggcaggtttcagacgaaaatatgacaggccaccactctatattcagggtagagacgctccatagttttttagaaaatgtttgaggaagatggtttcttgttttgtctttagaaaggattagaatgggagagaccacaaagattaacacccttagtccattaggacttctctaatattgggaaacccttattctgtcaagggccactgatggaacagtaaaaaagaccagagaccacctacataggaaagcaatataatttagtcttttaatgagaagttataaaatgttccaagaagaagcaatataaaagtctacttaattaacacaagaaatagcaagatacatgcttcatttctctattttagcctaaaaagggaagggggacagagaggatgaagatcacaagggaaagagtcatatgaataaagaaaacaggaaagagaatctgataaaggggggaaggttgcttatggaaaagcacataaacacaaatgcagagaaaccacaaacaaacacacctgtgtgcattcacttcccaactggcttccggagaactacataagcacatttgtaatcatggagtgctgtgaaatagcagcatcttgatttattctttcagggtattgccagttatagtgtaaacaccttgagaataggaacatctctagatgtttgtgaaagtgaaagatttttatcttcttaatgctgcactgcattttggaaagttcaggtatagtgtaggtgtattgtccttcaataggaagttcggagaagggccacatttggcacatgattcagagctccctcactttcagtcaccccaggtcactcttcctgttctgctccagtacctaccttccaaaagcaaactccggacaacagcctatgtaatctagtagggccattttacatgccagatagcatagtttcatacttgcttaaactgttgacgtaatctgttcactgactactttttcatcattttgggaaataaataacataagtagagatagatttttattcctttatcaacaaatgtttgagaaccagctatttaagcactgtgctaggtactgtgtattagaagtcagtaaggccagcataatccttattattatttaattttgtgggaagacaacaataaaataataactaaagtgttctaatagaaatatgcttatttcacaggtaagcactaatttttcttttgcctctctttcacccctttttattcccttatgtatttttcctgtaattcaattaatagaagaaatctaggataagagcttattccctttcatgtaaaaataccaggccaggccagccctaggcaagcatgaccatgtttctcatagtccttcttgcagctctgcattgaccacgattccttcttaactctctaggttcctttttaaatggcttgaaattgtttcctcttttcacattttgcaagaatgaagttttagggaagttctggaaaattaatgggaaagtaattccctcaagagagtgagacacaaaaatgtggctcatccagggagcagcttcagattcttcccttgctaataagatgagagcaagatgatgtgtattgagaacctgccatattcaagacactctattaggttccaagggggctataaagataaagagggcacagtccctgccctccagaagcagtatatggtaactataattagaaaggaacacaaagtaattaaagaagtgtgccgagatgggaggtatggatgcctctgactgttatgtttttggagagttttgtgaaagaggtggcatccaggctgatactgaaagagatgtggggattgcagaatcggactgggtaggatgctgatgcagcatcttcattctggtactctgcatgctgccagtggacaggcaatgatggtgcggggcaggtatctcaagtcaacggggagaggatagtgtcacaaccataccatttgggggactgttgatgtttcttgatgaattgaaatacgggggctttcatttgttgggcaatggaaaaatacgctagatttcgatgcaatgaaatattcacaaatgccacaatcaaaatggcaatttgggaagtttgttatggtatgtatgagcaggttgattagaggggagagggataccagttagaaggtagtgcaatggtacagacatgggatgataagaatccaaactacaaaggtagagggtagaatggaaagaagagagtgatgggctctgtcttgtaatgtgtatgaccctggagttatttacagaagcttagcatatgccagcgtgtaaaatgcaggtgagggtgactacagtggagtgaggcaaaggttttgatcagcggagtaaaatgtactatggaacagaccttgaaggctcttgctactttggaaatctgagaaagggaagccataaacatgaggagcactgttactctccataaaacagcattatgctgttgattttcaaatattcacaaatgcttcttggaatgtacttttccatggattagtgtgttttatgttgaaagtgcattttttttcatcagcgagtttgcttttaaaatcaggtaaagatattttccctttaaatgtaaaatgctaatttaatttagtctttgcagcatgggaatgggatactaatgtggctgaaaacagcagtttattttttgtgggtttgaccatttcagaagtttaacatttttaaaaaatattatcactaggaaaataaatttgaaaccacattccagcttcaatgaggattattcaagtgtttttcaattatattgcttaaatgctccaaagagtctttgcctcagagcacggactttttattatgacttcactgcaaagggaaacagaggactctgttctgggttctgaagtggttttcctcatccatctctggattgctcttcttggaaaccaacttttggtttagcctagtggagctttctatttgttagagaaattgaccagtaatgtgtagttatatgattgtgcatagccagctacagccacaactacttttagcccctcactcaaacagtgggaaaatattctagggtatgaaagtctcagaaagattaattatacacgtacatgataaagatttccagttatctcagaccagcatatttattctttatgattaattatcctgagatagtcttcattcaaggtaatgaaatattcttaaaatacttattgctttttagcttgatagctgaaaaccaatgctctgcattcttctgtatttataaacctttatgcagtttggtgatatgaggctacgtggagaaactcgctgcataaagaatgagggagatgatggtccagctctcccttgcagtcatcagctgacgtccagaactgcattcaggcctgggaaccacccttcaagaagggcatacacagactaaagtgtatttggaagaataaacaggtgaaggagactggaaatttgatcatgttggaacttggaaggttgctctggagagaagactcaaatagttgtggtatttcactgctgcagtgggcagatggcagcagccatagttttggctacctagcatctgggccccttttccatctcagggaaatctgctgtgtgtatgttggtgatggagaaggtcttgcattctatggtagaagctgaagggtcagatttgtctcttttgagtcacttgacatctgcatgtggacaagggtactaggcttcttctggtgtccgggcacttgtttatggctggggctttgagtctaacaggcataggtcagttgataaagtgtctagattccaatgtcatatccagactgctcttgtggaatgattttggcagtgttcttcactggctgcttcccttagcttctaaccacttcccacctggtttcacgttctaatagagaatggaaatatataatcctaaaagattttgtgagcttctcaatatcttcaaaacaagtttcttttttgcttaaggtagttggtgtaggtttctgttgtttacaaacaagaatgctgactgatataattactaaaaacataatgatttcttatttctaactggaattattttattttttactatttagtgaattttttctttaatttttagttaacatatgacaattgtgcatatttatagggtacagagtgatatttcaatataggtatacaaatgtgtaatgatcaagtcaagataattaggctatacatgacctcaaacatttagcatgtctttgtgttgggaacattcagaatcctcttttctagttgcttgggttttttttttgtttttttttgagatggagtttcattcttgttgcccaggctggagtgcaatggcatgatcttggctccctgcaacctctgcttcccgggttcaagcaattctcatgcctcggcctcctgagtagctgggattacaggcatgccccacgacgcccggctaattttgtatttttagtagagacaggtttctccatgttggtcaggctggtctcgaactcccgacctcaggtgatccacccaaagtgctgggattacaggcatgagccactgtgctggacctcttctagtttttttgaacatgtataataaattcttgttaactgtagtcactctacagtgctataggacactagaacttattcctcctatctagctacaattttgtaatcattctcttcctacttgccttcccccactacccttcctggcctctagtaactataattctattctttacttccatgagctcagttatttttagctcctgcagatgggtaggatcatgtggtttttaatctctctgtgcctgatttatctcacataacataatgccttctaggtttatccatatttctgctaatgacaggatttcattcttttttattgttcaatagtactctattatgtgtacatgccacattttctttattcattcatctgttggtgaacatttaggttgatcctatatcttggctattgtgaatagtgctgcaataaacatggggtacagatagccctttgatatactgattttctttcttttggataaatacccagtaatgagattgatgaatcatatggtagttctatttttagtttttttagaaacctctatactgttttccataatggctgtactaatttacattcgcaccaacagtgtagaagagttcccttttctctgcatcctcaccatcacttgttatttttttgtctttttgatagtagccattctaactgggtgagacgatacctcatggtggttttgatttgcatttccctgatgattagtgatgttaagcattttttcatattcctgttggccatttatatgtcttcttttgagaaatctctattcagaccctttgcctattttttaattggattttttgttgttgttgttgttgagttgtttgagttctttgtatattctggatattagttccttgttagatgaatagtttgcaggtattctctcccattctgcaagttgtctcttcactctattgataggtttcctttgctgtgtagaatctttttagtttcatgttgtcctatttgtctatttttgttgttgtcactggtgatttttgttgtcttacgcataagttctttgcctataccagtgtcctgaagcatttcccctgtgttctcttctagtagttttatagttttgggttttacatttaagtctttaatccatcttaagttgatttttttatatggtgagagacaggagtctatttgtcttcttctgcatataaatatccagttttctcagcaccatttattgacaagcgtatcctttcctcaatctaactggaatttttaaccaggattcaacaatagctttatggaatctgtgtgtatgttgtgttatatgcagtattttggttatttgttcattcacatgggggagagagtccattgttttatttacttctcaaaaggttctgtaatccctaaagggccaagaaccacttatctgcaggatacaatttaaacatcttagcatgacatacaaagtcctcattatctggctggcctcagcccattgctttgattttctctcctgttacattctctgttgcttctatttctttatcctcttttcatgctccagtagtcaaagtactttgtttctctaaaagcacctaatggtttataatctcgacgtctttgctcttaacgttctttctgcccaacccttttctttgcttcttatcccaccatttcattggtttgctgaacacctactcatctatttagacttcactggtttaattcctatgtggatgtaatgattactgtgctatatcctcttggatatatccgtattgtactttatattctgatttcagcattgctggcagcccatgttaagctagcagcttgtatgagtgcctcttctttgtagccattgtgcgttctccaaagtcactaaggcagatgtgttacccaggcacatctttgtggagaagttaacccttctagggggaaacactcaaacaatgagaatgtgaatgggtcaatgccccaggcttcccattgcctgtgggccaatggtaggcacattcgacatgactcttcagagagatccctgagagattgggccgggggctgtccacacagttaatctgctcattaagccccctttattggcttgctttctttcctgaatcacttttcttcctctttcactcctgctttctagattactgctccctgcatccaagtctttatctcaagctctactctcaggtgcatctagatccagacaccctcttgactgtgtgcatctattttagctgtgagatgctgctttagcatctcttgccctttgttgatctcatttaatgatttctttctagtagactattacttgtggggcgtaaacagcttatcttattgtgatgtgagtgggcaccatccaactggctgccagtatgggtagaacaaagcaggtagaagaagggagataggttttgctgagtcttcttgctctctttctcttcctgtgtcagatgcttgtttcctctcctcaggaaggacatcagattctatgttcttcagccttggaatctgggacttaaaccagcagccttctgggggccctagggcctttggcttcagactgagggctgcactgttggcttctctggttttgaggttctcagacttggactgagtcatactactgtcctctctccctccccagcttagagacagcctatcaaggagacttctccttgtgattatatcagccaattctccctcttttgtatacctatatatcctgttgtttgtgtctcactggagaaccctgattagtacacttattcattattggtccctaagcaggtacatagtggaccctcaacaatgtgtaaaaggcacagtgcatgagagctgtcttcagatatctgaagggttaccttgtgtttacatatgtctggggaacagaaccaagaccaaagagtagaagttacaggaagacagattataattcaatacattgtttatcagtgcacctatgggaggtgatatttgatagcaacagtaacagtggctcattatggcatgatgacccactcagggaagatatttgcccactcttctgctgagaagtcctattatagaaagttttatagaacaaggaccacaagcacatacctgcaaggaccaggctggcatataaactagtgaggcaggctaagtgtcacatagttgggaatggtgagaactgtgtggaataaagtgtgtgtaccctgactcaaaggggtaggtactccttagctccagccaacagttgctagacagtaatgcagatccagcactgtcagaccttccagttttccaaaagtaagtagaaatccagattcttaggtaaatcttccaatataaagacatttgagtcaagaaggcatcaccgtggctggctatggcacatgggttgtttgtaatctttgtgtagtggatgtagctgaggatgctaaagcctcagatgtgaggatagctttctagagagccagattctggtcagcttgctctcttcaggcccatgaacacactctgcctgttcccaccttgggcctttggccatcctctcttcacagaagggacactgtgtggctcaggcccctctcctgtgacatctcccactactggtccttccccagcaagccctgtcttcttggtgcaccttcagcatttccagcactcagatgtctgctgcaattgctcactgtctagtagtgtcatagtttgtcttatctgtgtaactaagttataagttcccttaatgcagaggttctacttcatgtggctttcctgtcatttggagcacagtattgggtgcatagcaggtgctcaataagaactgttggttaacttttgctagatgactatcatactcagtgcttatggcatccctcttagtagaagatgaggtaataaagaagaggccaccagctcttgcatggagaacttaaaattaaatcagtgaagctctttcagatgactcagtgcttttggcattgctcttagcagaagatgaggtaataaagaagaggccactagcccttgcatgcataggttaaatttaaatcagtgggactctttcagagatgaaatagacatgtcctctatctactgttgacctgctgtcctcagagcttaaagtggcgctcagtgtgcctcacctgtcaaaggctttccctcaccatttcccaccagagatccaataaaataaccaattatgtgtgccctgatttagattccttgattagagatgggttctgatcataaactatgtaaccatcttttaaaggaaaacgttaataggcaactctttgttacaaagattgcctaaaagaaaaactaattttaactgtttacaattatccatttttatattctttctcttttatttgaaacagattttgttttagaaatctcttttctctcacatctgtaaagcaaaatacaatataaacaattctcagtcatctgtgataatgaatattagggtatactttgggcactgaagtttactaattgtttccaaactttattttagcaaactttccccactttttggtgaggatgctagtgagtataaattgttaaaatagtatgtctcctttatattccatattgtacttgtctcactactgtttatttagcctagtttcagtgcagttttgttacaaggagaaggatttgaattatgcattcaacaaacatttattgaacccctactaagtgccagatcctattttagctgctagagatagttatgaagaaactagacaaggcccttgctttcttggagctgagcttccattggtgggagacaaccacaaaccaatgaacaaatgaacacacaggaaaatattggatggtgataggtgttgggagcataaaatagaatggagaaaatatgtatgtgtgtgggctactccagattggagttgagtctcttcaaagctgtgacatctgagtgttgaaccacaagaaggaaccagccatgtgaagatcttggggaagagcatttcaggacaacaaaacagctactgccaagggcctgtcacaggagccacatggtgtgctggaagcacagctcggaggctgggcagaaggaatttagccaatataatttattatacaagccaaaattattagcaacaaaatgaaatatttattttgcagtttaagtatatatagccatgaacatttagatttcagaatttgtgccatgatttcatgactagattcagtaattatttaagattcacattggagaaaatcagtgttctgaagactatgacgtatatcccgctttgaagttttggatttttcttgaataggataggccattaacaatattggaggaaaatatcatctagtgttatattcttaaattgaatttgccttggaagtaatcatgcatgcaatgaacatagtaagaaacagcttctttcatcctttaatgtaataattgctcccaaggattacaagagcttatagacagctggaacatccagctataatgttagctggacagggaagaaagttgttatggataaagcttcagattttcttggattttttggtatctgtataacagagacctgatgagttgccagcacataacaagccagaaccctggatccagagagcatttgtgacattcagccaacacagaactgctttcccacccaaagggtggtctccaaatctgttgtagcttttggcaagatttttatatcacaattgaaaacagatgccctttctgccctttcccttgttgtctgagttactaccgttcaagagattgcaagccatggcaatctctcatgcaccttcagaatgcccagcaagagtcctcgttagacattcctattcagaagtcctgctgtgacacacttcctctgcaagaagagaacagattcaggaaggtgccaggattgtgaggttctggtagtctgcagggtgtactgtgaatgctttttgtcaaaatcaaagcaccagtcctgggtttaatagaaaacatctctctggatagtttctattttaaaatatttaatcctaaaataaaatatttaatcctaaagaaatatgtaatcctaaaggaaaaccaaagtgtactctccctgatggactatattgagttttattacaggatatggccctaaaatgtgcttggatgggatattgaaaatccagagtatcaaaaatcactaaactactaaattcttgattgactaaaagagacttattagacataacaactgaatataatgtgtggaatttgtttggatcttggtgtaaaccagttgaaatgtaaactggtggacaattgggaaaatttaaatatggactgaatatcaggcaatattaaggaaccactggtaattttgttaggtgtgataatgatatagtggttatctacgaaagtaagagttataaggacagtgctgtggaggggaaaaatgaaacctgaaactttaataagatttattggttcaaacaccacatgttctcactcgtagctgggaattgaacaatgagaacacatggacacagggaggggaacatcacacatgggggcctgtagtggggtgggggtaggggggagggatagcattaggagatatacctaatgtaaatgacgagttaatgggtacagcacaccaacatggcacatgtatacatatgtaacaaacctgcacgttgtgcacatgtaccctagagctcaaagtataatacaaataaataaataaataaacaagaaaaatcaagggcaaaaaaaaaattattggctcattagtagaaatgtaaaagtgcttcagaaaaagtaatcatagtttaggggagaggaacctaggggcagacccaggaggagagaaagtcatgtagaaaaggagattttgaaggatgttcagtgtccttcagtggaaagacactgccagctctaaatggctctgcaagggaggagccggggaataaatcctctgacatcactctcttccctcccatctattgctgatcttttcctgctctcaaatctagatggcaagggactcactggtgtagtctatacaggtcagcctttggggctgatagtagggtggaaaagggcagagagtaggactggggtgtaaacaaaagctaccagtaacagcatcttctttacaaagtataacaatatggggggaatgttgaaggatagatacttttggaagaagcccttcatagaattataaaatgttagggctgggagtatcctgagaagtgattctcaacctcattttagaggtgaggaaataaagggagcattatacaggtagcaatttgtgtacagctagttgtcacagatctgttaagaaattacagactttttgatatgaacagacacttctcagaagaagacatttatgcggccaaaaaacgtgaaaaaaagtgcatcatcactggtcattagagaaatgcaaatcaaaaccacaatgagataccatctcacaccagttagaaaggcggttattaaaaagtcaggaagcaatagatgctggagaggatgtggagaaataggaatgcttttacactgttgttgggaatgtaaattagttcaaccattgtggaagacagtgtggcgattcctcaaggatcttgaactagaaagaccatttgacccagcaatcccattactgggtatatacccaaaggactataaatcattctactataaagacacatgcacacatatgtttattgcagcactattcacaatagcaaagacttggaaccaacccaaatgcccatcaatgatagattggataaagaaaatgtggcacatatacaccatggaataatatgcagccataaaaaaggatgagttcgtgtcctttacagggacatggatgaagctggaaactatcattctcagcaaactaacacaggagcagaaaaccaaacaccacatgttctcactcataagtgggagttgaacaatggacacatggacacagggaaaggggaacaacacatactggggcctgtcagtgggttgggagctaggggagggatagcattaggagaaatacctaatagagatgacgggttgatgggtgcagcaaaccaccatggcatggtatatctatgtaacaaacctgcacattctgcacatgtatcccagaatttaaagtaaaattaaaaaaaaaaattatagactttttgattttcagccctgtctctttcccctaggcctgggaattttcataaattttccaaaattttcccagacccaccacaccagctcagcaactgttcagcatgggtgaaaatggtaaggaagtctcagttgttattcacaggaatgtgtaagcattatagacatagccattgcaatataccatgtttctgtagctgaaattacagtgtcactgtgggtaatctggaaaatacatatatgtgtcaaaaggaaaataaaatcacccataatggaccacagagataactaatattaacattttcgtgctttcctatcagttttttaaattaaaatatacataaatatgtgtatgcaaaattagtatcagttgtacatatagttttgtaggttgttttttcacttaataatgaataatttcctatatatcaaattgccttagaatctgagttttgatagcagtaatatttcaaaaatgaatatagcataatttttaaaagtcctctgttattagatatttgtttcttattttcttctatgataaataatgctgcaatatatatatataggtacatatataaacattatatatcccatataaataattgtgtttatctgggacatataatatttttatttaaaaaattgccaccataagaatttccagtggtcctttctgttggggcagagtggaaagaacatggctctagggccaggcatccctgatctgtttggcttccgccacattctggatgtgtgtccttaagcatgtcacttcactctattgagcctccttctcttttctgttaacagggatcatactgcacatccctcagtgctgtgatgagaactttatgaggtagtacttttctttctttcttttttttttttttgagacggagtcgtgctctatcgcccaggctggagtgcaacggcgtgatctcagctcactgcaacctctgcctcccaggttcaagcaattctcccacttcagtctctcaaatagctgggattacatgcacccaccatcatcatgcccaggtaatttttgtacttttagtagagatgggttttcaccatgttggtcaggctggtcttgaactcctgacctcagatgatccacctgcctcggcctcccaaagtgctgggattacggatgtgagctaccgcgcctggcctacacaaagtagtattttaaagtgtttggcatgtagggtgtactcattacatgttaggtctgtcttcatttgggatggattagattgcacacaagtatatgcacatgtgtgttgagtgaagtgaaggaaatatagttacaagattttattcagtatcaagaaaaaagtaaacctgacttgccgatagacacatttcaattgaaagaatcctttcagcaagagagacctattgaagtttaagatactgataatgaaaacagaaatgaaagtctttaaaagtgtatttttctttatactgggttgtccagtaactattcctaacctccttccccatcctcttccttcctcagtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggtgaggcagcctggtgggggccaagggatgccatcaaataatattgtttaaattaatggaaaaaaatgcaacatttcataatctacgggaatgaagatcattccccacttcctatatgaggagtctctgatgatacagagctacacttgttcccttctaaatacctgtaggatgaaagatttgctacctggctccatgattttatgaggctctgggtttggagtcagtttggagtcagctctttacatcatgagaaagacctttccgtctttggatgattaggcctttcaggatggtaactttgctcagagctgggccctgttaactttcttatgatatgttttattatactgctgctctgccagaaactcctgtccagtgtcctaattaagtttagtagttctactcagaagaagggagaaaactgacagaggatctcaagcttgatgggagcatgtggggagatttgctgaaggaatcacccagaaagccagcatttcctgccttctaggtttagtttaggcagtttgaggaaataaaggctgaagaaagcccaggtgatacatggttaatagaggcagaaatgtaaagaggacaactctttcacaaagcctaaaatcagctttcctaaaattgtgaaagaatggagataacagagttagtcctcttacccaggaaggagctcagtgaccctgggagaactgaaactgggaaagttctcaaacgctagatgttacttcactgtgagaacacaatgctacactacaattagtaatggaaatgtaattaaccacttggcacttgtggcttgcctcagtcattgccacactcccagcctgaaaagtttaaaccaagtaactccagtgatcacaaatggcctgggtaatccagcttgtcaaaagacttgaacacagcattgatgaagatcactctgctgacatgtttgctcactcatttccaaaagccttccccagcttgtttcattttaagtacccttttctgaaaatatcaagggcctagtatatggaagggacaaatattgttcagttctggaaataagaggaagtggaattatttctgcagagatcaggaagaaatgtctttgcctggaaggaagtgggatggttggaatcccacctgaaaagctgcggaagggcatttgccagcttcctggaattctctaataaactttctcttcctagagtggtcaacctgtacttgttttcatggagcttacattctcgtggggaaagagagaaatgacaattaaaaataatttgaatggtagtgataagtgctatggaaaaaaatgagaaggaatagagactacaggtttgggtgggtactctttctgtggagtggttgaagaaggtcactctgacgaagagatctttgagcagaggcctgaaggaggtgaataaatgagaacagcaaatgcataggccctgaggtggatacttggctgtcaggtgtgaggctcagcaggatcagcatggcagagggccaggaaggaaggagaggtagtagatgaagtaaggaaggaagtggggagccacaccatataggccgtgtaggccatcggaaggcttctggctttgagaagagaaagggggcaatggaaatgctaggcaattctatgccaaatatgcctgcaaggaagacttagataattgctgtgtgggtataagagagaaatcaagacgactcctgggtttttgtcctgagaaactttccttgtgcctctaaaagccacatttttgaaaagcacacttcaccactgtaggtaagagttatcttagagtaccataaaatattagatcaggaaggggtcttagagatccaggaaggcactaagagatgaaataatttgagtaagtttcacatatgagttcattggaaagcctggctcccaatccaatgattttgccacacgtgcctctccccttgggttatactaagatgtgattacacttaaatgtgggtcatacatacgtgtgtgtacgtgtgtgtttgtaacctattttcatctcctagctttgaagctttatgatggaggcctttgttgtcatagtttccagcatttgaacattaagcaaagtcatgttgagcaggaacgtaatgtgtagagtaggatgaaaagtgggctggaagtgaggaagcttggattccgactctcttttcattctgagctctgtgagctggaactgttgcttcgctttgtgttctccattggctttttctgttctagcagtctacagacctatacatttaaaaaatatggttctagtgaaaaagcttatggctatgtcttaaatgggtttggaagagtaccttttatttatcttttcattttgtttgtttttggaaaatcctttcttaatggcagctaaagtgtttcattttcatttgctgtatttattttctgagaaaaattcagttctgtgaaaaattcaggagctccatcactttttcatgattgttttgtttggaaagccaattgctaagtatcaaagttattttctacttattcgataaccatatagggtccaagttttccatattgaaagattatcttctggcttgttggccagaatagttgtctggtccttaaagcttcttatataattaattttttctttgctgtcactgtgaccagcagataatattcttcaaatgtttcagttggctgcaagttactgaaaggtcctaagtggcagagcaacctcagaggaggatagccccaggggaattaagttgatgcaggcattatgtccttccctccttcaatcaatacatattttcacatgggtatctttgtaccgtgtgaaattgcagtctattctctactttcaaaagctgtgactttctcttgccgggcccaattgctcacacctgtaatcccagcactttgggaggccaaggcgggcagatcatgaggtcaggagatcgagatcatcctggctaacacggtgaaaccccatctctattaaaaatacaaaaaattagccgagcgtggcggcatgcgcctgtagtcccagctactcgggaggctgaggcgggagaatggcgtgaacccgggaggcagagcttgcagtgagccgagatcgcaacactgccctccagcctgtgggacagagcaagactccatctcaggtaaaaaaaaaaaaaaaagaaaaaaaaaaaaagatgtctggaaagtaatgaggcaagaaggaggggttcagaagaatgcagaaattagtgggaataagataaaggatggataaaggatggggaagacagacggtacaagagtagcaggtagtaacatggggaaaggttcgaatgaacagtggagctacttgtaagccctagttccttctgaagccttgtgactgtctcactgggtcaggcagagaaggtgttggacatactggaaggggtcctggcaaggcctggtgtgagccactggtgccacagacacaacctctagcaaagtattgctttgtttaaaaaccaccaccacctccacaattaccctgccaccattaaaaatgttaacatcagtagggaaggtgtgactaagactgggcagcctgagcaggttgcttgttttccccaaaagagggaggaggagggaagctgaaatgggttcaaggaggagcactgccaaaaataatctttacatcaccctccctggtccacttatggcacttcaaaattcctttagtgtttctgaagggcttcttggaaactatttgtatgaaaagacaactaattgagtgagtaaattaacggcttgaatacctagaatacctaagttgctatacacaagcagaaaatcttacagtgatctgagctagactgaattaaaaaggcatctcctacttagcatataggacaatgtatagaacaactttgtgacccaagtggagagaaggggggttgggaaagagcaccactgctagctgtctttttcagttgaaccttttcctgctcttcaagagaaaatcagtttagaatctaaagaaaggagcagggaggatgaaggaaactatacttacagagtgaggcttttttaaaaaattaaattaatgttagaacttaaattatatgaaacaaagtaaataatgaaggaaaaagataatgtttgctgaattataaagtatcttttgtagccaaacaaaatgtaaacagaaagaaatgactaaattttaagtagaatttactggagaacacaaaacaattttgaaaccaagtcagttatatgtgagacagctcattcactattggttccctcgttttacttaagacaaaatggttaatgccttttgtttttgttttgacacttgttgaagttagagaggattaattgctgcattatcgcccaagctattaagggagatgaatgacaaattttagtggatcaactatgattacaaaagttaatttactttgtcttcctcagaagtctttctgcaatgtattccatggtgaggctgctcagcctctcgcatccattcttcaacaaggtcataatggggaagaatgaagtgcaaatccattgttgcatgctctttccccatgaccttaagtgctaacatgcataccctgtcaaaaaaaaaaaaagagggagggagccatttcacctccccttaggggttcacttctctttgggcctctttgacttatgaatatacatgccatttgcaggacccaaacccactgctcttcaatggcctttaagtggcttacatttctaaagtagacatgtgggcatattttcttatcctttctcatttgaacactgaaggctgtggtttcttgactgtaaagcaatttgaaggcacggtgtctaacctggctgtaaaaatcatagaaactgctagaagttcccttacctgtgactcttgccatttcccagagagcagaagctagaagtcttctcaagtaaaaaaatacactgctgactgcttatattatatataatttttaaaatattttaagggaaatatcgtagtccagcagccatttattagaacctagaatttctagaattgtgctgggctggggtcagagagatggatgtgacctgttcctaaattctagatttcctgaaataatttatttcatatccatttgtataatatatatttacttatttagaaagaaatgacacagaatttaaatacaaggcataatttcttaccttccctctttttcaagtgtgtagtgcagttgggtctcctggatctcctccccaccctctccattgctctgtatcttgcaacttagtaagtgctttatggtcgaattagttcacttaaaagtaggaaatttgactttggctatattgggtgcctggatagttaattctgtgaatacacaaggatcaaagagtaacattcctcataatctccatccctcatctgccctagcctttgccatcgtgctttataaagtagaggctgcctttgttgctttaacaaacccttctacattattcccaatctagtcatcacaatcatcaaagtgggatccgagggattttagggttttggtttttgtaattcttgtattgcctctctgatgtgcaatagctcaggagatatatttttaatgttttattgttcttccagaaaaaggcgcaaacatgaaaagttcactaaacacccttggttcacttacttttctttcttaatttaaagggtatatcggtctcctaactttcggtcttctcagaatttctatggcatatgccaaagggcctattaagtaccagcagggaacactgcagacagacctttctgcctttataagtgtatacagctgcgcaggctgctgaccagctgctggggcagccctgacttgtgatcagatgtgccactgacttgggggcagaaggctatttctaatagcacttatcattctttatttgggaaatttgagccctgatttcagaccatgtgattgatgcaattcagtccattttcatctgtagcaggcagggtggtgacagagcagctctggagactcagtagcaaatatctttacctacaaagacttccagcttctgctccctggaaactagtaaaagtctcaggaaaatagacctctggcccagttcctataggttttacagccagattaaaaataatactctgtttgctttaggttcaattttgaaaaaccacagctttcaaaaactgttcaaatgagaaagtataataaaatatgccttttagaagttggattgaggacccttaaagacttgataacttgagtccagcaaaacggcatattttagatcttagaaaatcaagtaagaaggcacagtattcttctctagaccatgtcatggctggctttaatgcccatattttagggtcttccagagacacttcagtgacacctcagttttccccagcatcttccacagtaagagtttgatacgactgcatatgacaaccatttttttttttttttttttttttgagatggagtctcactgtgtcacgcaggctggagtgcagcggtgcaatctcggctcactgcaacctccacctcctgggttcaagcagttctctgcttcagcctcctgagtagctgggattacaggtgtgcacccggctaatttttgtatttttagtagagacggggtttcaccatgttggtcaggctggtctcaaactcctgacttcatgatctgcctgccttggcctcccaaagtgctgggattacaggcgtgagccactgcacccggcatgacaaccattttttaaatccaacaaactgcaaacaggccctttgccaacctagaaatttagaataatccaaggatcccaaggtcagagaaattttttagcctggatgatgggatttcaggcttagtcactgggccataaattgaatgttaaagggataggaggagatcagtgatgtttatttgtttgtaagcattttttttctttcttaaatacctatgttcatttgaaaagcgtattttaatatatataataaagcagatgataaaaagaaatcaactgagaagaatcactgacaggaaaatcaattactgacatgcagtaattctgatgttctagagtagaggtagtattctattgatatgtccaggaagtaaaatatctcatttagattgaaaaaaagagacaaaattgtgctaaattaatcatagagcctttaatccactagtaatttggagtgaattttattaagaagaattaattgtaagtacatgttaactttcgtgtcaggataaattgcatcttttaaagctaagtgatctgtgtacattgtgatagggcctttcactttggttgaaatcttaggtttgaaactgtgcctggtttacagtaactaaaattaactctagctgtgtggtcctttatatagttgttgtcatcccaatcagatatatctcatctgatgtcaacttctgagtccaataatcagactagctccagaaggcacagggaaggtggtgtggacctctagggactgccctctgctttgtggaaaggcttggttaattttccattagagattcaaccaaccaccgacccaacctggagtttaataacacgctttttgttgataagtttattcagtgaactaggctatctgttctaggggactgattcttctttgaaacagcccggccttaagaatgcagctgaaatagccattggggaaaacttgtataagactgtacattttaaattttgatttgtcctcatttggagtgaccttctgattcagggttgcctacatttcttttaccattgcctgttttatcttaacgcctccttcctgatttacgtgtaagcttgctatacaactcttcaagtggctactttatggaatcaatattacagtgggttattgccagtcatgaaatgggaggagtactgttgacttaccacttggagtcaaaaccagggactagatttagatacaatgaaaaaattccaaatcactctctgaaacagtataaatgtcttaatgtcctaaaatgtttgatgacacctaaaaaccccgcatgtattttcttcttagaacttagataggctatgtgttctacaaacaccaagcaaatcccttgtattttcatttataggttctaatatttttttcctcactgttttaggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaattgtatgcattattcttgaatagagttcatttctggtttctcttagtattcttcttcctcaaagttgtagttgtctgttgatgatggtgatgatgatgatgatgacgatagtgatgccacacattctctctcaatttcagcttcggaacgctatgaaaataatacatgattaaagtttcacagatcttcttggacattgtataattgaatttgaatgtgagatttctccagttatcaagagactaaggatttttttttttttttgacaaaaggaggatacaggaagaaaattcagactcatttgaatatttgtaaaccatgtaatatataaataaccactttcaattcttttggccctgagctatctccattacttaatagaaaaacttagataaaaaacactttaagactcttctattcacattgaaataaagaattatctagatgataattcagataattcagtttgttcatagaattactttcttatcactctttttctactactttttctcaaatacctctctaatccaagaggcacttccaagaaattccacacattccttatatcccttttttgcttgtctagcaaagcttgtttgtatatatgcaccccattgtaaagcaggtatgcaggtatgtgggtgaaagtgactatgaaaagacttaatgaattctgggatttgtaatggtattgatgggtatctctgtatgtatatcaagagtgggcagaaatgtttggctggtgatggcaaatgactggctttctcttgtggatggactataggaagcactttctgaattatgtaatgatttggaccaaaaagtattttgctgaaatactcaggtaattgagatagcaatggttttatggcatgaattatccaaaaaaatatcagaattacttattattctgtgatttcattagctcattaatgtttaactcacagattgggcatcaccatctagaatttcagtttaagggaggcctgcgcaaagctagttttatttcttaaaggataacagtcatacatagaatactaggaaagccaatattctatttaaaaataaacttctgatgcattttcattcttagcagaaaggtaaatgcttgagaaagcttgagtcaaatttgttaaaagaattttgagttctataaatccaaaaatctgaaacctgaatttatttaaatttataatcctttattttttaataccgtgccattttccacaaaggatttgtggttggtatataattctttaaagatacctggatcagtg

SEQ ID NO: 36723 - DNA, 54107 bp, Homo sapiens
tagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaaggtaagaaaccatctgacaagtttgctatggcttcttcagccaaaatttatggaagtttctgagaacttcagggtatcagagttggaaaagacttagagaggccctggttcaaacccctgtgttcagaggcttccctgtggtgtctgtgggcacagctggagctgaagaacaagggaaaggtgataaaggaaagaaatgaagctcttattggtcatcccttgcctttgttcatttcaattattgtcttggaaatctgtagacatcctaagagctcccctccactacggacatgcacgtttctctctatgtctttttcccaacccctgctctgacaccttcccattgctgcagcctcatggaccacttccggtgaccagttagatatgcttgatctatttagttaattaaggctctgaatcagcccttggccagaagaagcacctcctctaggaaatcattccttctttttagtaatacgcaattgaaaagtatgtgtgggttatgtgctgttaggtgctaagcattttagctatgaattaactcataatcctcaaaataaatctggggtatagagagaggttcttgtttcaattagaaaagtaatgcttggagagactatgatttgcccaaggtcactgccaatagatgacttgattagaagcagggtatgtttgaatgcgaagtccaggctcaaaaaggggccttagtggctcctactagactggtatcttaaggcaaggaaaacagaatatgtccctaatatctaaaaccatgcctagtgcccaggccaggcttgaatcaatgctcaacgcatgcatgtgtaactgaacagaactgcccagaaccttggctcaggccaagtaggccagaccaccccacaacagacatcttccctgaatgcagggtttgagaagtgccctaatgccctctaactgatgctgagtttgaagaatccatcagttaaggggaggtgtttctgagtttgaagaatcaaacaccttcctaattggtaggaatcctgaaaacactccacaccggagtaaaagactttggttttttatctttatgcctgactaaaagttaactctcattctttcattcagcaaatattttgtgctagtgcatgacactgcagattaatatcgtagatgaactgagtctgggctaggtagagtcaaaaaaaaatttcctaaaggagcctgtacctaaactgagtcttcagagagaagttggaactggcaaagtgaggaaggacggggtctggagggaagagtgagtgcaaaggcacagcacatacagaatgcctgcatgctctagaatccaaaactgtgtcagccaaatttgagttgatggagggacagccaaactgagatacccaggcggtggttggatttatggatctggatttcaggggagtgggcagggctaggggaatagaactgagggtcatgatgtcagtggtaggagttgaagtcttggaagaaagagtagatagaaactttgttttctgatgaacattctatgaggaagttcagcagaggttggaaacatctttaccatttataaataaattttatgtaaaatcctatcctgctgtcatgtttaagcaacttattatgcacagcaccaggacatcaatgtaaattgcatgccagtctttgctctcagtttcaaaggcattcttccctgcctgctgtctaatctttacaaagaaaggttaactccagaggtcaggaatctgaacacagaaaaccagattgcatcatattcattctaatcaataaacattatataatttttaaaactgtttctcatcttttatttcttcattttaatgaatatgtcaacacaaagccgtaaatgaaatcacatttacacaaaagtacaactggggtaagaaaattcaaaagataaagtaataaaattaaatttaaaatgaaataccctatgtatttgagtaagttgcttagcttctcccaaccttggtttcctcatttctaaaacgaagaacttgcttaatattcaggctctgggccccaccaccaaatccttgattcactggctctgggtctgtatgtaacaagcttctggagtgattctaatgattagccagagacaggacctactattctacgtaactgatttcctcttgctgctgtaaaaaattaccacaaatttattggcttaaaacaacacaaatgtattatcttgaagttgtggaggtcagaagtctgaaatcggtttcactgggctaaagtcgaggtgtcagtgtggctgtttcttctggagactctatgagagattgtgttttcctgccttttccatggattctgtttcctcttctagaggctacccacattccttggtttgtagcctcttcctcgatcttcaaaaaaatgtatctctgcttttgtaatcacgtcacattttctcctcttataagtcaaatctccctttgcctccctcttataatgacacttgtgattacatttaggatacacccaaataattaggatatctccccatcccaagatccttaattatatatgcaaaagtctgtttggctagaaaagataatactcacaggtttcaggggttaagccatacatatctttcagagtgagccattagccattattcagcctactgcgataatgtgcaagttccctttacaatctatgttctatgttcccatcaaggttaattagaaatattagactctttttccacagaaaaaaaaaatgtagcagtagtttcatctctaccctgacttctctctctttccttcatgcccagtaagaggaagtgaggtgcaccatctgttcatctcatcaggtgttacctagaatcagagtcaggagaaagcacctcataaaactactctgacaagtaaaccatatcctggggaccaggtgagaattaaaaagctgtatactcataagctgccaaagagctgatggtactgaagtcacatggagctcaggaatttattcttgcatttagaaagtatgcatataattctctcgaaaagaaatgaaatcatatttttctgtcggatcaaattattcagaaatccgaactgtagaaaacatacaaacacacttgcttaatgttagctttttaatcttatttttgtacacagtatacttttacataggcactgaaccagctggaaatgaatgcttggattttcgcagctgataaaagcagagttcagattctgtccttgagctcaatgtctggagaaagcagctgtgaatactgcttccttaattcagatgcctttggccgtgaggggcatggcattttaaagctgcaataaactctgtactttttctctcaggggattagaaaaaccaattgatttgatagtgactcagcagttttcaccttcctctttagccaatgccctgcagctaagattgagaaacggattcagaactcacacctcttggtgcttggtggctcccttccaaaccatcagctgttctttctactttctttcctattttttaaagcacagtctgaatcaagtgcttcagaaccatttatactaactcgtgttccaaacacataaccctgaaccctcttctaaggccaccagttacaaagaatggggaaggttaatgagtaactccaccagtgcctgccagaaagctcagctgtactccagccttccttcctctcttgcagagagaaacaatgcggcagttgaacaaagcgaaggcactgtaatgcccagtggcttcagtcacaggctggtctaaaattccatttcacagaattgaagataatttggggttattaccaattctcagcagctcaaattcaatcccgttgatggtgagcatggggttcattttgagagtagaaaattggatgcagtggagaatcagaatgttggatggtctctgccatttccccaaagatatcatcctaactgcatgctgctgcttttaacaaatcagtatacaacttagtattttttgtgttgacaaattttcaaatatacaaaatattgagtctgaaggcaaaaagaataatttttcacttccattgcttcctaggtcataacattcacatctgatatttcttccaaatacagactgttgttggcctgatcatcactcacacatccaggcttgttacatctccacgccactgagtatcagggaacctgccccaatattcacgtaggttcttttctattttccctaagcgtcggccaactttagaaataaagggacagagtacaaaagagagaaattttaaagccgggcatccgggggaggcatcacatttcggtaggttccgtgatgccccacaagccacaaaaaccagcaagtttgtattagggattttcaaatggggaggcagtgtgcaaataggtgtgggtcacagacatcaagtactttacaaggtaatagaatatcacaaggcaagtggaggcagggtgagatcacaggaccacaggaccgaggcgaaattaaaattgctaatgaagtttcgggcaccattgtcattgataacatcttatcaggagacagggtttttaggatcaactggtctgaccaaaatttattaggcgggaatttcctcttcctaataagcctgggagcgctgtgggagactggggtctatttcacccctgcagtctcgaccataagagacaggcgcacctggaggggggctgtttataagcctatacctcctggctcgtattctctttctcagggatgttccatgctgagaaaaagaattcagcgatatttctcccatttgcttttgaaagaagagaaatatggctctgttctgcctggctcaccagcagtcagagtttaaggttatctctcttattccctgaacaattgctgttatcctgttcttttttcaaggtgtccacatttcatgttgctcaaacacacatgctgtacaatttgtgcagttaatgcaattattacagggtcctgaggcaatatacatcctcctcagctgacaggattaagagattaaagtaaagacaggcataaatcacaaggatattgactggggaagtgataagtgtccatgaaatctttacaatttatgtttagagattgcagtaaagacaggcataagaaattacaaaagtattaatttggggaactaataaatgtccatgaaatcttcacaatccacgaacttctgccatggcttcagctgatccctccgtttggagtcccagacttcccgcaacaactgagaactctggagggcctacccttcacccacttccacccttcttatatctcttaaggagctgtgttcagatggttacatttcgcttgctgagcaagactgcattttcattatcctgggctaaaatcaattggtatttaagttagagcaaaaagggttctaaccctatttacagcagcacacatacacttacattagaattggctttaagggaaaaattcaatcaatcgacaaatttccactgattaccttctatgagccaagactgccatagtctcagccttcatgcagcttataggctagcaaaaaagccagacagtgcacaagaactcacaagtgtgttgagtgttgcaagagtaagtttcaggggctctccatgacttacctggttgagaaaccctttaactttttttttcctctgggtgtaaagtgaagagatggcaatcagagtaggttccattgtgtcattgtgaaaagatgctgggctggcgtgtctcctgaaggccacccatatctttaaactttattttcatgcattcgcacaaatatagatgtgttccatagatgaggcagatagcagaggcttctgcctacagcaaggctagtttggagagggttttgctgtcagggttggacccacacacctcttcatagatgctttttcttttttttcccagagtttgaaagggaaatggagtctcaagttcagggaggttacagtgtagacccacaaatcagctaagtacagctaagggtggagaagtctatgcaatatccagcactcttctgattaattagaagtctttaaaattcacagaaaccatattgtcttccctaaatgattcatatgtcaagacacagtaaagatattatatgtggaacatcatacacaaacataggtccatatagaaattcttaccttagtaaactgccaattttctgaaatgctctttaaatcctgctaatggtggcatttgtgtctttgtcacctacagtacatttctggatttgggaatgagtgttcttcagaggatcctcgctgcccaggttccctgccagaaggacaggtatgagcaaataaagtgcttagaagagctctgaatcctattcctggatgactagctttcaggccaaagtgcctccacccaccgtggctcttccaatctagcctgtgaactgtctagaggtttcccaagtcataggggcaatgaagatacagagcaatgacaacacaaagattaaaattggattggtggcacagcagccaatccaaactagtgaaattaactgtagggtttccagtaggatccccaaaaatccagagttaaagagaatccctcatattccccttgaacaccatggatgtgagcattatgataaaataacaaggtgctttcacatgtatgcacaaagatgttcatactagtgctggttagaaaagcaacaacacgggaaacaaaaatattttcaaaactttttgcaggccgtatcatagcataaaaaaatcctcatttcttaaaaaaaaaaaggaaaaaatgcctgattattacagggttacaggtatgatagggtcacaattttggaggataagaatgcaaggaaaaataccaacatgtgaacgcttggttatttctggttgtgagataatgggtgttatcatatagtttatacattttctacaataaatatatattacttttataatcggggggcaagtcacatcaaaagttgttacaagaaacatatcgggttgcagatggtcatgtgcagtcgcccagagcatccccatccccctactgagttggttggtgggaaggtgggatgcttttcggatgggagtaatattgtttattgcatcctttgtttcagaataatcctcaggtctgcccctacaatctctatgctgagcagctctcaggatcggctttcacttgtccacggagcaccaataagagaaggtacaaggattagatgaattctgacctgcagactgtgggtactatgacagggactttgtgctgcctccttcccctgggccacagcctcccagagctgcccaagatcctgcttcttataggctatggtctgggtcatggtcagaagagaatgaacttcctgccagctagcaccaagtgactggtggaagaaggtgaaggaaagctgcacagagctgggaaaatacacatgtccagttccatttacaaattacctcctatattcagaaggaaatattcctaatagtttggtcttcttctaaagactgtcctgttgagttttggcttggggtttacctgttttgttttgttttataatgactaagtcacaattatggaagattcagagcaatatctttctcagctgactagaggtatgttctttgcaagaaaatgttgggtaaacgaagtttggatagttaaaaagtcacatattatggcccactgtggtttgaattaataaggtttttactctggtattcgcctttgctagaaaccagcatattcatttacatactgtgccatgttccatgtttgctctaatcctacatccaggtcaatgaacgtaatcccttgattaactcatatcaggcaggttggatgcagtatgtgttatagttttgggaggcagtaagtgttatgatttaaacaaatagtgtctaattataaaaattttaggctgaggtatttgtgaagaggaatgctgctggtattagagactcggggagaagggcatgtggtcttgtactgcttagtagggcagcctgggtttatctccacaggtccttctgagaagcaaatgagatagtaagtaaaaaactataatggaccacacaaatgataaagattgcaaggtttaatcatggccaccctggaggcaggccccctaagtataaatcctggctccttttccagctgtgtggccttgggtaaatcatctgccctcttggatcctctagttcttcattcgtaaaacaaagataattatggtacctatttcatagctgtggtgaggattaaaagaaaggatgtgtgtaaagcacattagcttagcttagcacattggcacaggcacatggttagtgctcagttaatgctagttattgtcatgataactatcattaagtattgccatcatagcagagtttctgcctcatttccagggtatctctaggaggctgtcaagagaactgggcatgatatgtggcaagtgctatgttacaatgtcagtatcaacagtacttttctctcaatagatatatgcgtgggaagaggaagagatagagaaagatttctatacatgtcaaaaatcaggggataattccttcactatttaatcatctctctctctctctctgtaagcccaaatagggtaagataagcacgcagataattctgtccattctaatttatgacaacctgtcctctatgactatgttcttgactttatggcccattccctaacaggccacctggtctccggattctgcagcctgtccccattattcagcaatatcttcagccagcaggagctgagctttgttccagcaggctgaaaaggagctgttggcatttcattaagaagctggcactgttccctgaatcagaattaaatctctgttcagggcaatgtagtactgcctggggagttttataaactcagctaaaaaataagggacactaggtatggctcacccatctatttagaagaactctccaaagatatccacaagaattttgtggaaatgcttcccacccaaaatctccagtgggaaaatgggaccagtcttatccataagtaggccagcctgaaattcttagttactactcatctgaaccatagcatacagggccaccacaaaactattaaagagtctatctacctacctacgtacctacctacctacctatcagggattaatttttatcagattagctagctgattgatcccttgggtcttgaaaaggcaaaagtctggagagataatttggaaaatgtggactgtgataaaaattcagaagattaagagaagaaaggcaatttaacaaacacatgataagccagcagctactgtatgccaggcatttttggtacacaaactctctgagttctcacaacaatcttaggtgacaaggatgaagaacataaggttcaggaagtctagtaactctcccaggatcacacaggtggttccaagacatacacacatgctctgaacttcatatactgggagctggagaggcttagtaagaccaaggtctgaggtcacgtcatcaagagatggagaaatcaaatggaaactaaacagatctagccctttttcccccagatggctcaatgttgggccaggccaactcaactcactgaggtagactgtccttggtcttgaaagggccagagcctgttgattcaggtctggtcttccgttgtccttctgtattttgtcagggcagtaccctctgaaaggacttgggtccctcttagtgagcttcaatgtcccttccagcttctggaaggtcttatcctggtgtcctttcagattcctttatcagagtcttcttcccttcctgaagcctgagatctggtcctggtagagaggacacactttaaaaagaaaagaaagaaagacaaataaaggcataaatgtactacaataaaacatggacatacactcttataattttagagtacagaagtgttaatttatttttattttattttaagttccagggtataggtgcaggatgcacaggtttgttacataggtaaatgtgtgccatggtggtttgctgcacttatcaacctatcacctaagtattaagcccagcatacattagccatttttttaatgctctccctcccccaactcccaccccccaacaggccccagtgtgtgttattcccctcactgtgtccatgtgttctcattgttcagctcccacttatgagtgagaacatgcagtgtttggttttctgttcctgctttagttcgctgagaatattggcttccagttccatccatgtccctgcaaaggtcatgatctcattcctttttatggctgcatagtattccatggtgtatatgtaccacattttctttatccagtctatcattgatgggcatttgggttgattctatgtctttgcattgtgaatagtgctgcaataaacatacgtgtgcatgtatcttcataacagattgatttatattcctttgggtatacacccagtaatgggattgctgggtcaaatggtatttctcattgtaggtctttgaggaatcaccacactgccttccacaatggttgaactaatttacattcccaccaacagtgtaaaagcattcttatctctccacagcctttccagaatctttttctcttataaattaatatcaaaaagacaaacccaatagaaaatgataaaggacttctacaagtaattcacagaaaaactataaagagccaataaacaaatagacttgttttttggaaatattttgtattttctaattcataataaaggaaatacaaaataaaatgagatactatttttcacctaaaacactaaaatttttaataatactccagatttgtgaagatgtgggtgaccaggcactctcacacgttgttagtatgataataaagagttaaaatgatctgataattttgtttagaaatgcactggacgtatctgaaagaatatataagaaatatataagaaaatcactaagctctgatgcctctgaggaatagccctgaagaaactggaggacgaaggtgccatttacctttcaggactttttaattacttgaattatttttacctttggcatgtattacttttgtaattttaaaggagaaaattgatttactatttcaaaaataacaaagataccacccatattctctcaagctgcgtagaactcattgttcttgccttccagagcaaggactagcatcctatgatacacacataagctaatgtttttctatggattttcctacacagatatccctcaaggtacttccccttcccttatagtttttagaaaagacaattcttcattttttggcagcatggaaataaccatgagtcagagtccatttgaagcatgatgggtggaatgaaaaagtgagaagaggccagggctgtgggcagcagatggccatgaaaagtgatgctgtatcattgcttcactgcttcacacattagagcctacaggtcgttgttgacttgagtgtcttcctgatggtactgcctgagccattctgtgtatcactcagaacattactctaaggcttgtatatcttgtatgtttttccctctagctggctgtataggattctaccttcagtttctcacaagccctttgaatccattgacgaaggccaagtcactcacaactgggatgaagttgatcctgatcctaaccaggtaacctggtcctgtgaattgaagcttatcatatacccaaagccttgactagaaatacctaaatagaataccatggtcattggaaaaaatagatagttttttaaagtattattttaataaatgctaaagtgtgtctgttttctgctcaaacttgggtggtgtattagtccattctcatgctgctatgaaaaaataaccaagactgggtaatttataaaggacatatttttaattgactcacagttctgcatggctgaggaggcctcaagaaacttacaatcatggcggaaagggaagcaaacacatccttcttcatatggcggcaggagagagaagtgttaagtgaaagggggaaaatccccttataaaactatcatatcttgtgagaactcactatcatgagggtaaccatccccatgattcaattacctcccaccatgaatgtccctcccacaaaacgtgaggattatgggaactataattcaagatgagatttgggtgagacacagacaaatgatatgaggtgggaattttggaaatgatggattgattatgtatatacatattgttaaaagaaaaacctttgacaaatctaatttaacagagtttaattgggcaaaggacaattcacaaattattctacctgagccaggataggttctgagagattccagtgcagacactagtagaagacgatttatggacagaaaaaggaaagtgatgtacagaaaacagaaatgaggtacagaaatagccagattggttgcagctcggcatatgacttacttgaacacagttttaatagtgtgtcaccatgattggcacaagagtaggttacacatccaattaggttatggttcactatgtatggagaaacctttaggcagaacttaaaatatgtaaggaggcaactttaggacaaacttgattaacagtctgcgtgtgtgtgtgtgtgtgtgtgtgtgtgtgtgtgtgtgtgcacatgcgcacataagcttgtatttttctagcctaatggcatatagatggacacaggagtagttcggacttactagaactgctcaggtgaattggatgagcggaaattttataggttggtcaaaatattttatattttataggttggtcaaaatatctacatgctcatggttttttttttgtttttaatctaaacttaccacaaaatatagaaaatacattcaatacagacatctttgaagagaggcctttgaaatctggcataggggtgagagtcttgctatctgggctgaattatgcaagtctattgtggtcacagatcactatcacagtctcttcagacctaggacttccattctttttctaggagtttcctccttttggtctagtaatagtgggcgttttctctaattatcgttattacttacgtactctgcttgcagagtatataagataaaatgagacagaaccagtactatagcaatgagatagacccagtgctataaacgactgagctctttttttaaccttctgagaaccccagtgtattgcctttgtccctgagtttaggtacatgttgctgataataggtatgtagggcaggaagaaaaacagacctgggtttgcatccctgcccatctacttactagctgtgtcttaagctatgatgtttcaattgtaaaatgggatgataacatttgcctcacagtgctattgtgaagattatgagagaataggtgtgaacctgcttcatacaatgcctggcatgtgataggcaagaaccatgattctgatacagctatttatatttacctgaatttacattattcaggtaactttatttcttcattttatattattttttactctgaaggcttcttctgccctctttccctccctcctactctctctctcctccctctctccccaccccgccactttccacaacccaaggaaatctcctgcttcccctttgtttaccatgacattttgtctatacctgccaatctccctcccctaagtgcttagactttttataagacaaaagtcaaaataatttatagacacctttggtttcctgcccagttctctctcttgtcttaattatggaaatctcagcgaaataagcatctgcttgaatgttaccacccctctctaccagggacaggaagggagggaggcatttagggtggaaaaatgtgaattggtatttaaaatactatctacctcatagccactttgaaactaagatattttgtctaaataattgacccttaaactcgtatgaagtttaatgcataaagcagacatcctccctggtccccagctggcctatatattgcctttaagcacattgcaaaatgcagcccctattctaacccccaaccccttagactcagtcccccacacaaagggacacagacgaggcattcagctcctccctttccccttcagtgggacaaggcccttgcacagggcacagcttgcacaaccaacctggggaccctgacttcacctcattcctgagtctcatgtggattcaagtaatatgggtatagtaattatgtatatgaagttaactaaatgagggattataagaaaagtccatgggcagatttggataatttaaattattgtttatttataatgaaaaataattatttattattattttgcttcaagatagcaatcaaatcagtagtggttaacagggtaggctggggagttccagggctcctgcctgctcatgtcgatcacaacaattttctaagcctctcaaccttaataaatcttcatagatctgtttatagttgtgtggacaacagtggagccatacttcttttacatagttttattcggggtgggaggttaggttttaaacctaacctttaaagaaaatatgtgatgtgactctactttgagtgtgatgtgtaatatgctcagtaatatacctttattatatattattatttccttgactatcattgctacattttatttaacatgaatacaccctttcataggaactattttggagttcgtgtgacatatccatggaagacaatcttgttctaatagaatttttctagctttgtctttttttttttttttttttttttttgagacaagagtctcaccctgttgctcaggcgggagtacagtggtgtgatcacagctcactgcagccttgacttcccaggctcagatgatcctcctacctcagtcccctgagtagctgggaatacaggtgtgcaccacaatggccagctaattttttgtatttttggtagagaaagggttttaccatattgctcaggctggtctcgaactcctgggctcaagcaatctgcctgcctgagcctcccaaagtgctggaattacaggcatgcaccactgcacccagcttagctttgtctgattgtatgagtaaaatatacttataaaaacccaaaagtattgtagaaattaataaaatattactggacgtctcccatcattaagtgagagtcaagtatataagttgtacatgttaattcattatttcataaatagttgacatacattttgaccaggaagtttgaagcaactggattaaaaagcttgagttaatacagaggcatcaaaatagctgtatcagggtgggcatggtggctcatgcctgtaatcccagcactttgggaggccaaggcaggcagatgacctgagactgggagtttgagaccagccttacctgaggtcaggagatcgagaacagcttgaccaacatggagaaacaccatctctactaaaaatacaaaattagccaggtgtggtggtgcatgcctgaattcccaactactcgggaggctgaggcaggaaaattgcttgaacccaggaggcggaggttgtggtgagccaagattgcaccattggactacagcctgggcaacaagagcaaaactccatctcaaaataataatgacaataataataatagctgcattggaagtttctgcttgttttctagcagaccctcagcccatatttgttccccttctccccgcttcccatgtctcccattctaacctatggttagaatggctttgcttttgtccttgaacttgttgcctttcttctgttttgaattccctgaacactttctatatggtagccaccaaatgaatttcttctccaatatcttccctgctcctttgagaccttgtcttcacacacactgggagagatgtgcctcagaattcaatagcgtctcagtgtctctgtgaacaccggctccaaccaggtagcagtttattatctttctgacttgtgacctctgtcacctgccaactacttctctctccatgataaaccctggctgatcttgcaaaatctacccttttgtcttttcttttacaccttctttacaagttaatatctctttccaattttatacttcattatttaaccacagcattttgcattcatcactttctccctcataacctcctccaaatatgtactccagactctcagcaagaaaggctgagaaaattatatttaggcaccctctgacagtccttcccagctgaagcctgtgtgataggtatgtcttcacctgtcatagaccaaatccaatacttcatcagcttcaccaactatccacattagtcatctctgggaatttgaagacctgaggactgcctgatgattcctccagtgtaacatttagtcccaaaggcagcatcttgcaatatgtgatcatcactgtcatccttgataccctctcaggaagactgggggctgctccccctaaagccttcattttctttagtgtatatttaatcagttatccaagaattaatgcaacctctttttgagtgtatttaaattcagcctgaggacataaattcaattaattaatacctcacataagaagtatacctaattttatgtgtctgcctctaatttctgaagtctcagaatttaatgaactaatctacatccaatttaaccatgattttacagatttcagctagaattcctgaattagcacttctctttaagagtcctttaaaatttatttttcttattatttcattctaacctcttgattgttgaaaaatcagattcttgactcagttaagactcagctgagaaaattacctcttggttcttaaccagtataatttggatcaagtgagaaatacctcaaagctaattaaagaacatatcataaaatgccttctgtctctagtacatgcaaattataaaaaaaagtttcaaaacaatatacccttacagggtatttgctgtctaatttgtcaaactttccaggttttgccatcctgaaatccccttccctccacaaatgtcttggattttcctgcctctcttgcccaagtctgtcctagtcacagccagactccttgagaaataatctaaacccactttatcaccctcattcactctttaaccctatgcaattcagcctgcccagatgactctattgaaaatatttataccctctttacacaatagtgcatcactctctaattaatacatatttttatttaaaacttacattaaagtgtcaatgcccagtaattccactaacacagagttaacaacttctaatgttttgggttctttccagtcctttctttttgtacatatatgtaaataaataattcctagggtcccatgtagccagtaaccaagagtaatttaaaataatatctggccaggcacagtggctcatgcctgtaatcccagcactttgggaggccaagatgagaggttcacttgagtccaggagtttgagaccagccctggcaacatagcaagaccctggctctacacaaatgtgaaaaaaaattagctgagcatggtggcaagcaccggtagtcccaggcactcaggaggctgaggtgggaagactgctcgagcctgggaggtcagggctgtggtgagccctgttcatgccactgcactccagcctgggcaacagtgtgaaaccctatctcagaaaaaaaaaaaaaaaaaggaagaaaaaagaaagaaggaaagaaagaaagaaaagaaagagaaaagaaaagttaatctttacttgtttttcctgaagacattaaacagtatccaatatatgacccacagcaacactttttaaaatcccctttttccagtttttcccagactccaaccctctcacatctgtcttctctcacctcacctctcaccttccccaagctcttcatgccttgtcaccattgattgttggcttctctcttcctccctgtacattctgcctctagaaaatgatacctgcactgtagatcccctaccccatttggctgggatcacacatggtgttatgtgggataacacacacataacagtgacctccatggcaatactggagttcaaaggactccagtgagaataggcaaatctgaattttccgcagagatcagggaagggaagaggaagaggctatgaatacacttataatagtgcttttaaaaaaaaaatcagttacatatatatttactataattaagctgatggtgtaatgcagtcttagattatttttatttaaatatcatattttgcgcctttttccatgtctttttaaacttcttgagtgtagatatttttgatattatattataatccaataaatgtttataaaaattcctaatattgtgagatatttgaattttttccatttttgctattatgtagtaaatccacgctaaatataatccttttctcctctacatcccagcctggaacaacagacctccttcttttcttcctgaatccccttttttccctgggttccatgacattgcatgattcccaaacctgcaaaataagtattcttcaaggtcctgaactagaatcttgatatagtttgactgtgtccccacccaaatctcatcttgaattcccacgtgttacgggagggacctggtgggaggtagtctatctgcacaagctctttctttgcctgctgccacccaaatgagatgtgactttctcctccttgccttctgctatcattgtgaggctttcctagccacgtggaactgtaagtccaattaaacctttttcctttataaattactccttctcgggaatgtctttatcagcagcataaaaatggactaacacaactctcacctcccccttgtcatcatctcccctctgagagaaggggaagtacttactctctctcttcccctcctcttccttactgtctttcttatcctcctcttttcttctccttctcttcaccccaaccttccccttcccctctgtattgttctgctagagctatcataacaaaaagatactgggtggcttaagcaaaagagatttactttctaacagttctggattccaagattgaggtatcggcagggttgctttcttctgaggcctctctcattgacttgtatcttctccttggctcctcacatcatcttccctctgtgtctatagccaaatttcctcttcttataaggacaacaatcatatcagattagggtccactctagtaacctcatttaagtttaattattcctgtaaagactccatctccaaatatagtcacattctgaaatacagggggttaggagttcaacatatgaatttggaggaggaacacaatctagcccataattctctccttctgcttgtttttccctctaaatatctactaaggattcccactcttttggattctctttgccttagagatgaagggatagttgttgataagaaataatcaagtgggacaaactaacaggaggaactccttgagcaatagaggattttcctagctcactacactgaatcaggtgccaagtccatagaatggtgatgcctgagtatacataagagttaccaggggacttgttgaaaatgtagattcctcagtcttgctccccagagatcccagttcagtaggtctgaggtggtactcaggagtctccccagatgactcccatgcaggttggtgctggactgcactttatgaaattctgctgtagagtgtgctttcaggatctctctggttccttttttccttttcctacctccacctggttcagacctcatttcttcttacctagactattttaatgaccttctacctgattcctatgtcttcccctccctatcccacaccgtgctgccagaatcagcgtgctaaattatcatctcaaaaatctttaaatctaaccatcacccgccccctccactgcccagccaatccagtgcaggcttccagataagagatcaagagctctgattcactatcacagcctttcagactctccactcacttccatgtcccctacctatcagtcacactagaaccatcgtcattttatctacctgggatttcctgttcttccatcacaaatactcacccatctaaatctcactcacgatttatgattcattttaaataatactttcttcattatgccctttcaatatttctcagagtatttaaggttctatgtctctatcatcttcatctgatctgcagtatccagtacatgccttcttccaaatagaatcgcaagtatttgttgaatttactccctgatagttcagatcctatcattctataaataaattagattgcatttctctaaatgcattcagtggtgtgtgccaacattacagtgcacattcccctgctcagcccttttggacagcttgctagctctttttacatttcatctccatcaacttacatttcacttcttgcaaagatattggcgctgtctgcaaaccagatgatttcattgcttatatctcttattttccatatataagaatgttaaataggccctgtgccaggacttattcctgagagaacatttctatttacatttctcttccaaagttatttgcactgatccacttccttgtttttctatcatgaggttttcacatttccaggatcttctgtaatggattacctgagggaagagacaatgtcatgttcacctccagcatctagcataaaatctggcacacagagaggttcaataaatactgtttgaaataattaatataaggggattagacaagaaacattaaccctgaaggacctaagcagggttagtgtcccaggaatcagactggccagggtgattcagcactggaggaacagtaaacaaaggtcaatttggaagaccaggtacaagaccattaaaaggagggaaagcttgggtttaggagccaaggagatcaggaataatttgggaaacaggtcaagacaggctaagatcaaagggctcagggtgtaggttagtaagagggtctgagaaagtgttggcatcagttcttagtagagaaaatttaactgttctaaaccatcagttttttcacttctaaaatagagatgataataataatcatagggagcctcagagagttgttgtgagaattaaatgtcatccaacaaatatttattgagtgactattatgttctatacttcgtgctaggtgctaggtaatggatttaaagctcttagctttacattcaaggacaaggtcaaatgagaatccaagttttcatccttgatggctcatcttcatttgtagcctcatgaaagacttttgttatgttttgttttgttttttgagtacaggctggagtacagtgttgtgatatcagctcactgcaatctcctcctcttgggttcaagcgattctcctgcctcagcctcccaagtagctgggattacaggtgcccaccaccatgcccggctaatttttgtatttttagtagagacatggtttcaccatgttggccaggctggtctcgaactcctcatctcaggtgatctggccgcctcggcctcccaaagtgctgggattacaggcgtgaaccacctcgcttggcctgaaagacttttagaaatctaaattacagtgacttggatcctcattatctatattcttgcctatcacctcaaagaactccaacggatcaaccaaagcctgatttctctccacataattcatgctacctttttttcctcaaacttccaaagtttctgaagaattcaagtgagccactgttttattttaatccttcctatctttcttagtctggactgaaactcaccaccacaaattaccctggatctctctgctaacaactatttatacattgtattagtccattcttgcactgctataaagaaattcctgagactgggtaacttacaaagaaaggaggctcatagttccacagggtgtacaggaagcatagtggcttctgcttctgggaggggcctcaggatgcttccaatcatggtggaaggcaaagggggagcaaggtatctcagatggcaggagcaggagcaagagagagaggagggaggtgctacacgcttttaaagaccagatctcatgagaactcactgtcatgagaacagcaccaagagggtagtgctaagccattcgtgagaaatccacccccattatgcaaccaccccccactctctcttgctcctgctcccatcatatgagatgctcccatcatatctttgccttctgccatgattgaaaactttctgagcctctccagaagcagaagctgctatgtttcctgtgcagcctgcagaactgtgagccaatcaaacctcttttctttataaattactcaatcttaggtctttgtttatagcagtgcaagaacgaactaacaaagaaaattggtaccaaggagtgggacattgctataaagataacctgaaaatgtggaagtgactttggaactggataactggcagaggttggaagagtgtggagggctcagaagacaggaagatgagggttagtttcaaacttcctagagacttgttaaattgttgtgacaaaaatgccaatagtgacatgaacaataaagtccaggctgaggagatctcaaatgaaaatgaggaacttactgggaactagatcaaaggtcaaacttgttatgccttagcaaagaacttgactgcattgtgctcctgccctagggatctgtggaactctgaacttgagaatgatgatttaaggtgtctggtacaagaaatttctaagcagcaaagcattcaacatgtgaccaggctgcttctaaccgcctatgcccacatgcatgagcaaataaatgacctgaagttggaacttaaatttaaaaataagtttagatttaaacctatatttaaattttaacttgtatttaaagggaagtagagtgtaaaagttaggaaattttgcagcctggccatgtggtagaaaagaaaagcccattttcaggagaagaattcaaactggctgcagaaatttgcataaataaaaaggagccaaatgctgatagccaagacaatgtgggaaaggcctcaaaggcatttcacagacctttggggcagttcatcccatcacaggcccagaggcctaggagggaagaatgattttgtgggccaggcccagggccttgctaccctgcacagcctcaggacactgttttctgcatcccagctgctccagctcctcctgtggctcaaagggatccaagcaccgcttcaaagggtgcaagccataagccttggtagcttccatgtggtgttaagactgcaggtgcacaggatacaagagttaaggcctgggagcccccacctagattttagaggatgtatagaaaacttaaatgttcaggcagaagccagctgcaggggcggagtgctcacagagaacctctactagggcagtatggaggggaaatgtggggttggagctcccacacagagtccccgctggggcattgcctagtggagctatgagaagagggctaccattctctagactccagaaaggtagatccatccacagattgcaccgtgcacctgaaaaagccacaggcactcaatggcagcccatgagagcagccgcaggtgctgaatcctgcaaagccacctgagtggggctgaccaagaccttggtagcccacccctcacaccagtgtaccctggatgtgggacattaggtcaaaggagatttttttggagctttaaaatttaatgacttccctgctgtgtttcagacatgcacggggcctatagaccctttgttctggccaatttctcccttttgaaatggaagtatttacctaatgtctatacccccattgtatcttggaagtaactaacttattttatattttacaggctcataggtggaagggacttaacttgtctcagatgagactttggacatttgagttaatactagaatgagttaagacttttgggcactgctgggaaggcatggttatattttgacatgtgagaaggacaggagatttggaaggagccaagggcagaataatatggtttggatctgtgtccctacccaaatttcatatcaaattataatccctaatgttggaggtggggcctggcaggaggtgattggatcttggggacagtttctcatgaatggtttagcaccatccctgttggtactgtcctcatgatagtgagtgagttctcatgagatctggtcattgaaaagtgtgtggcacctcccacctctctctctctctttctttctctctctctttctctctctctctctctctcactcctgttcctgcaatgtaagccatgccttctcctgcttcaccttctgtcatgattgtacatttcttgacgcctcctcagaaactgagcagatgccagcatcatgcttcctgtacagtctgaagaactgtgagccagttaaacctcttttctttataaattacccagtatcaggtaattctttatagcaatgtgagaacagactaatatgtacactatgatgactatttcaccgagaaattacttcaaaattcttggataggtggtactcacttctaatgatatgtctgtctatcctcagccagtgttgttgagagtactcaagtcatccaatctagttgagtccatgggaaatttggagggaatctcagtaaattaaagaatttcagttttgaaagggatacttggatcatctagttcaactcccagtattctaactggaaatatttaggccaattatctaatattttcttttcatctctgagcatgaattttgaatcttgataatcaaatgttgataccaattctgtcttcctcctttggtaatcttaagtaatttttaattctaactttggacacccttaaagatgctttcaaattatttttgaccacctcatttctagcaagtaaaagtttatcttccaatagaactcatagaatacagttgtaaaatatgtgaagcaataatacaactaaaaggataaatagacaaatccacaattttagttggagacttcaacacccctctctcaacagttgatagaacaactgaacagaaagtcagaaaagatacagaagtgatctacagaaggagcaggattggaaaaaaagttttttaaaaaagaaaggatatggaagtgacgattttacacgtgtgaagaactgacattttacctttggacttttagaaatatttgattttctagacatcgcctgaatgttattttgacttccaaaagatctcacggtccaggcacagtggctcatgcctgtaatcccagcactttgggagggcgaggcaagtggatcacctgaggtcagaagttcgagaccagcctggccaacatggtgaaacctcatctctactaaaaatacaaaaactacccgggcatgggggcatgcacctgcagtcccagctactcaggaggctgaggcagtagaatcgcttgaacccaggaggtggaggttgcagtgagccaatatcgcgccactgcactccagcctgggtaacagagcgcgactccaacccccccccaaaaaaaagatctcaaaaatttactttattcttgttcttagcaatgttgttagtgccttagatttattcatctattcagtcattcaacaaatattaatgcctactatagtcaagccattgcattgggcattacaattgattttattatttttgaaatgtttaataagtaaattctatagagaagaagctatttaacaatagcatatagtataaataaaataaactatttttaaaagttgtaggactatattagtctgatcaagctgccataacaaaataccacagactgggtagtttaaacaacagaaatgtatcttcttacagttctgaaaactgagagtccaagtccgaggtgttagcagggttgatgtcttgtgaggctcctctttggtttaaagacagtccttcttactgtatcctcacatagcctatcctctgagtgcaagcagagagagagatctcttcttcttataaggccatcaatcctatcagattagggccccacatttatgatctcttttaactttaaaacccatctctaaacatagtcacattgaaggttagggcttcaacacacaaatttggaagaggacacaatttagtgcatatcaaggactaaatcagtcagcaagcatcctttacttctttcagagtttctcctctggagagaattatggaattatagttctcaccagcacctgttgttatatgtaagaaaaaaacaaaatttgggagagaaaatggctttcctgaagatcacagagaaaacgggaacagagacagtagcaaaaaccaagtcttcagtgcactctccttttggtctggccttggctcagagagttactgctccacagcatacaataaagctgcagctggctttagtagatgtttgtaccatgcactccatggactcttcctattaatcctctgctcaaatctccctcctcacacttatcaaaatatcacatcagcgctcctgaccaaaatctctgctttctcttgtgagtactgagtttatcagaaccaccttggggattttcttatccttcatgatacaggcccagtatgatctgaatatagattctgtataatcttctgccatcagggccaacagataaatgactcctctccctatactatctctgtcatttggtggggatcattttttgcattagagaaggttcgtcaaggtcgttgcttcttccggattgtgggccctattgaaggtatgttctcttcactatgaaatgtagttgcattttcttccaccacctcaggctctctgttctcatgacttgagggctaatgtgctacagaagaccttgaaaaatgaccagctgacctggtcaacccatcagtctctctggctcaaccttttccactcaaagaagacaaaccccttctctgagggccaggactttattaccactcacagcaaggtttttgtttgtttgtttgttttgttgttgttgtttttgttgttttttgttttttagacagagtctcactctgtcacccaagctggagtgcaatggtgaggtcttggctcactgcaacctccacctcccaggttcagaagattcttctgcctcagcttcctgagtagctgggactacaggtgcatgccaccacacccagctaatttttgtatttttagtagagatggggtttcactatgttggccaggcttgtctcgaactcctgacctcatgatccacccaccttggcctccaaaggtgctggaattacaggcgtgagccaccgcccctggccttaccacaggtattttaacatcaggcagatgtacaaagatattgtcccagtacaacaaaccaggcagaaaatcccctgctactgggatttctccctctctctcttctttctttccccttgctctttcttcttttttcttgatcacttttttccttagatttgtaaatccttagacttgtactaattaatcactcctgctatttagtaactggcattgtcactgccacgtatggcccaagatgccagaatttagttgattgatcagttggtgggttggttggtttgttgactggatggacttttctgagtatgatgcttggttcatcaatacaagaatcacagaacctctggattgggttcttaaaccctagctgcacattagaagaacttttataaaataccgatgtctgggccctaccttcacagattctgatttaatttggtcttggtctcaaaggctctccatgtgattctcatgagtggccaggattgagaatctctggatagagctaaaagattacgcaggcaaccattgatctgatacttaaatcccttctactgggaaatccagaaagatgactctttctggattttctttctgaaactaagattctaggtagtattgtcttcctaacaatcttcctgggtataaatactctgctctgttactatagaaggaagcagcaggtaatgtttagtggtagaccagaacttcccctaaaaaatccagcagtgcttagctgtggcacttcctgatgttagggaaatatcctcccaggtcagtggttctcaactgggagaaaatttcccccaagtgatgtttggcaatttctggagacatttttggttgttacagcttggtggaatgtcactggaacctggtggaggcaggccatggatgatgctaagcatcccacaatgcacagaacacctccccacaacaaagaattatttcgtgtaaactgtcaatagtgccaagattgagaaaccatttcctagatccttgccctcaggtccccctattatacccctaagagataccatccttaatgaaattagtcctaaagcatttccttctttctgaagcatgatttcagcactgtttcccaaatcaacattttacatcctttttaagtatcttttaatgtgaccatcctgctttgcttttaagaaatgaaggctgctgcctgactgtgtgtgtcagagaggcagaataatcccaaggctgccttttccacttgctgcttcctttcccatctggctgcctccctgaaatacagaatgagctgagccctatgacctgatggaggccctgccaagcccaccttgaccaggtgctgcagccagtggagctagtcttcagggtgcgggtcgctccatgaaacgtggcagctgggcttatcagctgccagcctggataagtcaggcctgctgccaagttgattaataagcgctgggctgacacttcaagaagggcctaaacctgctgattttcctcccctcttccttagatcatttcattattaaattaaagattgttgtgatttaaactgaactgtcaggcagcctagggacaaacgtggggtttggtgaagcagctgaacctggtactgcatttaccaaatcagatctcagctgggtgctctttctttctcttaaaaaaacaatttagaactctaagggcttgaagtagaagtagaaccttcccctgcagtgtcaggagcccacacagggaggctggcatgccaggaaagggacctgattataaatagcatgaaaagcagcatcagtcaaaactcactgatgtgcctgggcaaaatgttaaaagaaacaaatagcttctaaaaaaggaagcaatggttttatttttataatctaaagtgctaaggaacaaaagcagtttatattcacatagttttaaacacacaaacatgtgtgtgcacgtgcacaaataacacacactaacagagtccctttaaggaaatgatggataatcattttaatataacaaaatcacaagtagagcctcacagagggggtagctgtcctttcttttctatgtaattgatgctatttatttagaaggtctatggtttacccttgtgaagtaatttttctgtatgtgtattttttttccagcttagatggaaaccatttgagattccaaaagcatctcagaagaaagtagactttgtgagtgtaagtcagtcccatccacaccctccctactgctctcctctcttctgtggtgagtgagccaaccatttgcagcctgaatgccaagcagaagcagccctatcaggaggcagcagagacaaaaccacctgcgtatgctttgggggctggcggagggatgtcttacttacagaaaccatatggcccctgacaccagagggtattcatgaactatttatatctcagaaaggccaatgacaattgaacattttcttacttaagttcctttcttttggctagaacgggggcttttaacctttttctcactttgatgtctgatgtctgatgatgtctttgtttataaatatataaaataaattatataaaattacaaagaagctaatgatattgaaatataacgataaaaatactattaaaaacaaatttgatttggtttatagtcattcatgtgctttcttgttaatgtgctaaatcataatatctatggaaaacatctaataattctggtatgagcataaatatactttgaggtatctataacaactataatgtgatatccatgatttttatcattgataaagttacaggcacctctaatactgctgtggttttttgcctacattcatattagttgaaagaaatgataaatttcactcagagattagcaaaagtaaatataaaatatttcccatccaagttcataaatctccctgaagtagatgcttgggctagaatggcgtcaattcaacatggcaactctagttagtacaatgctgattggaagctctgtttggtagttataggtcccaggagtactggaataactgcacagagcaaggagtatctgggggagaggagaaaggagctctaaggaagtggggctcaaagagaccagtggagggttctgcagaccagcctcagctcatggcttacgtagggacactccaagtgccgagccataggataaattgttggaaacatcttgaagttctcatctttattaagtgctccaaactctttgtagactcacttaaatataccctaaacttacaaattgagttaaaatacaaaatgatatccccatctcctttcttgtgtgaattgtagatatctggaggcgcagagctctctccttttggctctccatctgcaggtttggggctgagggctattttgagaagacccatgtgttaaggtttcttgcactatggatcatctggtcacacagcagagagaattacagtccatctgaatacagtcctctgccctgttccagagagattaggctgaccctatccataagcagagggctgcccatagtggagtgtacttgagaggcattaactggtccctgatgctgcaaccttcctccccaagcctcctagatgcctgatggtacctccaacagaatctcttcttccagttgatgtcaagcatcaaattgataaaataccaagtaatgaactgatactctgtaagttcttctgatatagccactaagacaacccagatttaggccatggctggagactagggtaaaccacaaactaccaaacatgagtcagtaaattcaggctccttagaggctgcctggattccaaacgtcccaccggtcccaaagggaagaccctagtagaaatgtgcctcatgaccctcagggaccagtggaagggctgcctcttgggcaccgttcacattaacctttccctcttctgtgggtctctcccagggcctgcataccttgtgtggagctggagacataaagtctaacaatgggcttgctatccacattttcctctgcaatacctccatggagaacaggtaagtggctcagttctagggaaggacatgcccatcttctaagggattttggccagaagtcaaactccaggtttcactcttgtgaagtcacatatgcacatacatagttgtttttgttattggttttctcctcaaggcaatattcatatatatttattgacaatgataatgaatgagacaaaaggcatttatcttgactgaacatcagtgatataaacaagcacatcacataacaatgtaaacagaaaagggaggatggagccctggaatgcaggagtagatcgaaaggcattttgactttaagtctgagtccaaatatgcttttgttgttgtttgatatttcaaggatttttctgagccaaatatgagtgaccaatggcctgcgacacagccatcaggagatcctgagaacatgtgcccaaggtgattgggctacagcttggttttatacattttagggaggcataagacatcagtcaacacatataaggtgtacattagatccaaactgtggtttttatctcagtagaaaagtaacagcagatttaaagcaggcagaaaagaaaacagagaaatagagaacttagaaactctgtagttgcaggttgacctttgggctctgaatgatacaattttcccattggtttaaaatgtgcacaacagactgtaatatgtaaccagctggagtactagaaactctggcatacccttgaacttttccattttacacaaacacttgcaagtagaggcacctttctccttgtctttcctcattcttagattatttgtttcccacgttttttttcttaaaaggaggaactgagctgtgacctaggggttttgtgggtggtggattggtgtactgaatgtaggcaggactccacagtgtttcaccaccgagtcgtttccaccctcttacctgtctcagtttctctctccagagatctagcacctctgagaggcctcaaaatgccaagtgatcagctcttatatgtatttccgggacaaaactatttttgggggggttccctgtagcgccactgcacatcacaggggatgaatccctcagacactgcaactcagcccctagtcacccagggtgcctttcagttgggaagaacaaaatgccctttctcttcagagctgaggagctcagtctctcatttatgcacaaaaatgacagtcacacgaatgcgcaggcaagccaactgagctaaatttggggagaaaaaacaatggagtagaccatttagaatacacctccaaactggaaaccaaacagggtacccaaaagggagtcattcttgttgtctttagaaaaagacaacggaggccgggcacagtggatcacgcctgtaatcccagtactttgagaggccgaggtgggcggatcacgaggtcaggagctcgagaccagcctagccaacatagtgaaaccccatctctactaaaaaatacaaaaaattagccgggcgtggtggtgggcgcctgtaatcccagctactcaggaggctgaaaaaggagaattgcttgaacccgggaggcggaggttgcagtgaaccgagatcatgccattgcactccagcccggacaaccgtgtgagactccatctcaaaaaaaaaaaaaaaaaaaaagaaaaagaagaaaaagacaatggagaaatcctttagaatggacctgtgaactagaattaggaacctaaacaagagcttcctaggagggaaaaatcaagaactgtcaaccaaacagggctcaggaggacttaacagttccatcagaggagaagcccaaagttgaaggcgctttcaataggtccctgctgataccttagctctgagttcaggcaactccttcagggttctgagtcttctctgaggcccaatgtgtccaggtgccaaattattgttgacaaaaatagtcaaactattaatatgtaaaatatttgaattgatgtattctgagccaaatatgagtgaccagtgacccatgacccagccctcaggagatcctgagaacatgtgcctttgaatatccttaatttctaaggttccccagggctgttcttgagtcccaggtcacagtgtgtgagtttccattaggaccacccattagtagcaggctacccgactttggcttcagctaacagctctgtgtaagcttaaaattcttaagtagaggagcttatatactggctttgcaaaacaaagtatgcaaatggcattcctgccttattatacactacctctggaactggaccatttgtgtccaaagcccaactctacatttcctggctgagcgaccttgtgagccatgaatcagggacaagatcacagccctatgacaaggctctggaggcctctctttgggtcaaatctcatatcaggccacctcccctctctccacttgagccgcattggccttcattcacttctttcaagctgccgcgtgccctccttctaagcacttgcacttgctgttccttctgcctggaacattctttcctttctccaaaccctcacctagataacaccttcagatatccggtcaaatgtgtcccttctttgaagaagcctttgctgattcttcaaactaaccaagtcgctattctttcattccctcaaacttgattttcacagggtcattacagtctgcaaagatattgttctgtaattatttgattgctctctgactccccactagactctaagttccacaagggcagagcctgggtcattttgctccccattttatacccagctctgagcttgctacataggcactaaacaatgatttgtgttatgacgtaatttgtctagacaatgttaaaactgaaaatcacaagaattactctatatgtttcagatgcttttacaattcagatggggacttcttgattggtgagttctgaagacttcagaccccctcactgttaattgacccctaaccgcaagctgctttctaattttatacacattattttccttcattctccaatctgtcttatttcatttagtgcaatccagagactgaggtctagaggccacaggtggtctggaaaagatttctagtgtacctcaaagcccctactctatttccttgtctctctgtctttgcccatctcttctggacctttctgatgtgggagacctgggcagctgaaaagaaatgaagactaatactaatgggattaacttattacggtaactgtatttgccttgaaactctctcagtaaaagcccatttatcattagtaactgcaatttaaattcaaattttcatgagaccatctaaaatgtaaagtctatcagagattgttctggtctgcctattatacttgatggttttttagtatcaatattttggaatcaacattttcgtgtatatgtcacacaagcaaatgtcagcctttcactggaactatcagaaatgggtgattttccatcctatttctgctacccctttttgaccatgtcacaaaattgtgcatatacaagttccttgcctggtgaccaaaaaagcagagtcattgttttattcacattcttctagataggaaaatagctaatctaagttgtcagaatttatctttttccccaagagactcaataaagctctttgcatttggaatggaaaagcaaatgcagccttaagcctttcctgttcatgaaatggttatcacaccaaaagaattgctcaccactgccctgtctttttttgtcagttccgcagaaagggaaccttctcatttacaccgagtttggcaagatgcttgtacagcccaatgagatctgcgtcattcaggttggtgatgtgtccccttctcttccctgcctctcactaatttgggagcagtcagatgtttcagctgctgctatttccaactctaaaatttctctgtcatgtctgggcaacgaggagggaatctgagttatgcagaaggttccatgtgctgaagagtaagcaagcttgggtgcctgctttcttttaatatagcacataattctaaaggaaagaccacttgtcattgcactttcctaaatatttacatatactctggataaggccctgttcccactaatggcagtagaggcagtgaaggtggactttttttttttttagtgtggctaaatcaggcttaccattatctctggacccaatgagagggtagactagaattggcttgggtcacatgtgtgattaggaattcagtttttctttttaaactgaattttaaaaatttctttttaaaaaaattcagtttttcatgtttgctctggtcacctcccaagcagctcaacaaacaagagctttacttttgcatgtgggatgggctatggctctgggcagcttctttataactacagctgtgatttcagagggcacaccagtgtctgctttccattccagagaggaatgcggttcagcatagatgtctttgaggagaccaggggctacatcttggaggtctatggtgtccactttgagttacctgaccttggaccaattggtaaatcttcattacaagcctctaagcctcgcttgagatgtaggactcagataattgcatgaaagttaaacatccttctcccttcgctgtctcactcaaacttccacttttctctctagacaaattcttctctagaccaagtgtcttcccagaaaatatatgcaaaacagaaagcaacccaaaccaatccattataaatctctctagaatagtatacagacattggagataaagacggcatgtaatagatttctggttgcatagtgtgtacaggaaagaatatagaagtttgggttactgtgggcttgggtcaccagaaacagctccacagaagagatgagaatttgactaattctttatgaaaagttgaggagagtaaagaggaaagggaacagctttgcaaaagcatataagtgagaataagctttgtgattaggaggaagatatttttgttaagtcagtgagatttataatggattggtttggattgctttttgttttgcatattgtataaaatgggaaggccataaaaatgccctgggctgtattcctatggaaaggagggatggactgggtgacacatagtctatgaacctctgtgtacaccccaccaaatccacacacttagcagtcaaaaaaacacatcactcagtgctatgagagatctagaaaccacaccccaggaggcagattaaaacattccaaagtgaaccaaggtctccacagcccccattcttctggcaagctggaggaagtgaaaatgttaggaggggttgttctcaaactgtctcttggattgaaagaaatggctgggaaaattggcccttggtttactctttggtcacatctcccaattcttcccttccttgtcaacagctttttagagcaaacagggacaggccagtgtgtgccttctggtcagctcctctgaggaatccaaatatgcagaggaaggtgggaggcagcaagaggcagctggagccgtggtgggccgtctgtcatcctgttcacctcccactcttcccactctgctctggcttcctgctgctctatagtcagcatagcctccaggttccgtggaacatgtaccctctggaaaatatctataatttgctaaccagccggggacttatttttttaagtccaggagctggaaatgataaaacactcctcagctcgctcctctcagagttaaactgtttttgcacttaagtttttcatgtttggtcttttgatttatttcctttctctggaggaaacactcactcctaagcaaaggtaagcaggcaggtcctaaatacttcttcctgagtggcagacagggtttttcaggctggagaaccgttttcagactggaatctgagttctgtctagggagcagaggcatgccttaggcaacagcgtgtaaccctttctatctgagatcaaggactgtcaatgacttctagaatattcaagggttccttcaaaagaaaaagttctggagttctatcagatcttcccttttcctcttttcagttctctttctctcttcccttcccctcacctgtagtgataagataatgcatataagattgttttgttaaccatagtcactccacaaccttagaaagtaatgctggtttttgtgaatttttttctgaccagattccttgggtcttcctaaaaggtaccagactggaaatgcagtgaatctttgagcaatgaaagcaatttgtggagtagctcttgacatgaaagaaagcctttctcttcatgcaaccatgggcatctttcctatgttttggaagtttctaaaagacttttgggttactgttttctaggggccaatggcttggccaatcctcgtgatttcttgatacccattgcctggtatgaggatcgccaagtaccaggtggttacacggtcattaataaataccagggcaagctgtttgctgccaaacaggtaaagtaaaagggttggcaggcaagggaggaaatgaagagtgattgagcacttactgattgccaaggcgagtgttacaaactttacatatatcctttcgttgttatcataccactacggcactacaaataaagcaaatagttctagtagtcaattatactttcatagtcatggaaaaggccagtaatgataaataatttaccaatttcacagtaagtggcagaaccagaatttgaacccatatctgtctgactccaaaggttgtgccctttctactcaccaagcaatgaaaatattagcaatatgtaggtttctataagtggtatggaaaacataatatatgggcagcataatatgttctgaaaagtaaatgagttaacagatcagccaagatttatagtctccaataccaccctatttcaaatacaagcaattctacaaaacaagtagaattcagttaattagcttggcttggtttgtaccaccaggctggcaattcaggacacaagcaaaggcacagatattaataaataataataacaacaatgtaatatggactctataacataatatattactaaatgtactgaatatatattagaataaaataatcatataataagaagaacccaaagatctcttctgtttagcattatttgtttgcttcattttgtctatttgacttattccttatattttccaaggtatgttattcttcttaggcagcatctagagataatgccaaccagccgaggccaaccagtttggcacttaaaattaacccctgaagcagacatattgttattctcttattctctgggtcaaggtctctcaaaattcgggggctatttgcatcagaaatcctcaaggaggcttgtttaaaattcagatcctaggctgggcatggtggctcatgcctgtaatcccagcagtttgggaggccaaggcaggcggatcacctgaggtcaggaattcaacaccagcctggccaacatggcaaaaccccgtctctacccaaaatacaaaaattagccagatgtggtggtgcacacctgtaatcctagctacttgggaggctgaggcaggagaatcgcttgaacccaggaggtggaggttgcagcgagccaagatcatgccattgcactccagcccgggcgacagagcaagactccctctcaaaaaaaatgcagatccttagatactactctagccttgcaaaaaatgataagctttggagatgggacatggaaacctacattcattttaagcatgttccccagatcattgtttacatacaattgttaaagaaccacaattgtagaagcagccagtagctcctccgaaaggtttgcactttccaagtggaccctgtgctggttattttctgtgtgagtccccactgatccattctccctctttgccatgatctgtgccctggaaggttgactgtatcacccgggctccctagccagctggtttctgttgggttcaacccacaggaaactacaaggcaggaggaaagacaaattgggatatttcttcccctgcttcctcgctgtttaggactgtgtttctgacagtagctgcatcccccatatgacctcagttcctgttgggtagccctagtggtgggctggagctgattcatagtgacttgcaaaagctgatatgcacgcttctgtccaactgtgtatttgttgatgtcatactggtagctagaaaatcatcatggtgagactgtatacaccttagaaatcagtaaacactatatgtcaatgctttatgtatttttttcagagtgctagttgtgaaatatttaccagcacaccactgggtaacacccttctttataattctagctcttgctaaagtcctataacaatatttccctcctcattccacatgcccaggaatagcagtgtcttcccgctattgctaggctcagatacctcaacatttctagtcattccagttaaccctaaccacgcctctatgagtagcgccttcattaaaatctttagcactttcggacccatagatacagaagggaccaccttcctatagcaggacactgatcctcttctaccccaggacaggaccaggaagtattatgttaggattgctctgaaatctcaagtccttggagttggaacttttagaggccttctcccctctcctggactcaccaacccaggcactgtgtctattgcaagctcctctaggctgaaattacctggagaagcatcacagcaggtactctctgttccaggaaacagaaggtagcccagattgtttgagaactgctgacatccacagatcctcacagttaggttaaaaattgttgaaaaggcactacttggagaatgtgctgtgtttctgctgcatgtgtgatcagaaggcagctgcagcttatgaaccagaaaaatagggttagtggctaagtagagggtgtgtggagcaaccacaaaatgattcagggttatacttctcccaaaggacggtaaaattaaatcgagaacaaaatcaaatcaaaagaagagagaggtatactcagtacatattgtgggatcacagctacaaaagcattagatggtaaaattatcctttcctgctttttgtgtttaggatgtctccccgttcaatgttgtggcctggcacgggaattatacaccctacaagtacaacctgaagaatttcatggttatcaactcagtggcctttgaccatgcagtaagtctgaaccctgtaggggccttgggatgaggcaacgcttgggtgggaggggtccacagtagacccctgacatttacagatctaacatttccaatgtcaccattggaagccctagatatagtcatttgtcctttggtgagggagtaaataacacaactagtagggaagcaaagccagatactcaacattcccctgtgaacatagcttcattctctacagagcattggtgatactctgacttgtatttgccaaactaagtggataaacacttagtttctttgtggaaaatttatcccccaaaacaaccaagtgttaatgtcggtggtagaatgaggagaaaggaactttatgaatttggagaagtccctgaccccacaactctcaagagcctcctctatgatctctgacttctcaccccagtgccttcattcctggctgtatttggcagtgacagagtgaacagcccacttctaaagttactcataactttcagtgcttgagtttaaaccaaagaaattctagagcatgaacttggtcatatttttcactcagttcgcaggccacaaatggtctctggtctacagtgcaggctcccaagaccctacattcttaataaagtggtggttctgagaccccggggggaagttcattttgcagctcacttcataagagatgaacctaacccacaagctggaaggataattagagcagaagtcagagactcagaggcaaaaggattattgtgagccagttcagtttatctctggggggacaaacctacctctccaaacagcagcaactcttaataaaagcaaaggggaaaagaaaagtgagacatcagaccccaaacaaacagcacgaaaaaggatcctgagacactgataaagctttatttgtgattcactacctttgctttaatagtttcagatcatgtcccatgacagttgaagaaatgtcaattctcacagcaataagggttgggtttatttttatttgaatttacacagatgcgatcttctctgtattgctgcaatagttatttttccaaaattcagttctgatcatgccaccactgtcttcattagaaagcctttgcaggcttcccatggcttaggattaagtctgcactctgaagcatggtgtttgatgctcttcaccatctgtccctggactcattttccagtatcacctcttgcccctctcccttctgtcaatgcactggggttttagccttctctcctcttaacaaaatctctgtgcactttgatgtgttttcagtgattaaaatgtcatttcccttccttcccacttccttagtcctccctccctccctccctccctttttcccccatccccgccacgtccttcctttctttttttttttttaacttttattttaggttcaagggtacatatgctccttccttccttccttctttccttccttccttcctttctctctctctttttctttctttctgttcattcttgaagacctacctcaaatgtcacctcctctttgaagccttccttgaccctttcaggtagaattagctgcccaacccccaccccacaattaatgctaaagaagcagggaatcgatccccatgatctttgaatctccagactcttacatggcatctgaaagggaacatgattgttgatttcaattaaattgaatctcaaccttctcactaaagaattctgaagagttttaaaaagtataatttcgtccctcaacctatcctatctctacactaccactatgaagactacggatgtaaatgctgtgttttagacctgaaagtcaaacaaaggtaggaaagcaatgaaccacttctcagacttttctgccaatggatacaatctggaatctccgtattctcccaaagaggagcacatctacaccaaaacttggattttgctttatttctatttctactttgctctgagcatcccttctgctgcacatctcagctctagtcaacttgatctgaggttgagaagcaggcaccgttggttctcagacccacggggtaataagttgcatgtaatgtgggctcagcagggtgaaaaagcagttcagaatccttttagctggtgttaattcattttgcctcaagcacagcaagaggaaaaagtcatatgagtgattattgcaccttgatgacaagcccagacttctgttgtttgatcagaaattaggctgtccgtttgcagcaacatggatgcagctggaagccataatcctaagcaaattaatgcaggaatagaaaaccaacttctgcatcttttcacttataagtgggagctaaacattgagcacccatggacataaacatgagaaaaatagacactggagactactagaagggggagggtgaaaaaactacctattggatactatgctcgctacctgggtgatgggatcctgtattagtccattttcatactgctgtgaagaaatacccgagactgggtactttataaagaaaaaggggtttaacatatccacagttccacatggctggggaggcctcacaatcatggtggaaggcgaaggaggagcaaaagcatgtcttacatggaggcaatcaagagagcatgtgttggggaactgccctttataaaaccatcagatcttgtgagacttattcactatcatgagaacagcatgggaaaaacctgcccccatgattcagttacctcccaccgggtccttctcacaacatgtggggattatggaagctacaattcaggatgagatttgggtggggacacaaccaaaccatatcagatccctaccccaaacctcagtatcacacaatatacccatgtaacaaaactgcatatgtatccctctatctaaattaaaagttgaataaaaataaataaaaaaattagaatgtcacttgcaaacaccttcatgtatgcatgaaatgtgtgtcattgtccagtcacttcccttgcatcatgcgttcagtctctccttgtgtgttcacaggacccatccattttcacagtattgactgctaagtctgtccgccctggagtggccattgctgattttgtcatcttcccacctcgatggggggttgctgataagaccttcaggcctccttattaccatagtaagtctctcttttaccaagccacatttgcaagccaaagagacaacaaagcagtgagcgctacacattgggaataatgcctgggttatttctggacacccaccatggcatgaattcaggatcctgctgcacaaggcctagtgctgatccccaagctttaatctctttaagggatggtagttgtgttagtccattcttcgttgctataaaggaatacctgaggctacttaatttataatgaaaagaggttcatttggctcgtggttatgcaggctgtacaagcagcatggtgctggcatctgtttctaatgaagcctcaggaaatacaatcatggtggcaggcaagagggaagctggcatatcacatgatgagagcaagcaagagaaaggaggaagtcccagcttcttttgaacagccaaaccccatgtgaactcatagagtgagaactcactcataaccgtcatgatggcaccaagccatttatgagggatctgcctccattacccaaacacctcaaaccaggccccacctccaacactggggatcacatttcaacatgagagttggagggaacatacatccaaactacatcaacagtgatgcattgattctgagcctagttcccagtttctctgtccctgtaagaggcagaaaggctggtaaagtttagaagccttgttagaaaggcttctaaacaagtttcctcacattttagatgtttccttttggggaatactggggaggttgttagttagtctgttgttttgggaaagttcatcacctaagtctggttcagagaaccagagaaataagaagagagagacagagagagacagagagagagacagagagacagaaatgtgccttctccaattattttggcagggcaaagcagactgcagcctgcattaaggaatgaactctattctggaaagagtttctgcagaacatttgttgcctagtacaagacctaacaaatctactatttttattttattaatattattattcttagcacctaataattattgtccaatttctatggctctgttacaagttttttaaaaaactaactcatgaagtgtttataatacttgtaagagacaggtagtattattgtcccccccgctttttttttttttttttcagaaaattaaactgacacaagagggattaagtaactctctcaaggactcacagcaagttaagtgtagagtcaggatttaattgcaggctgtctgataccagagcaaacactcatgaccactaactggtatggctagcatagtgcctgatatatagcatgcttttaataaatatttatttaataagtgaatgcatcaacaagaataaataaagtacttcacggctgtacttaatgaggttgacatttttaattgtgcaatagctagctgaaaatccaatcaaaggtcaatgtgcaattctacttcctggagtgtgcatttttttgtgcatagagttctggaaagactctaagaggcattccacctggaacattctagaaaacaaattcctttctttagtaaactccagggccttctgtttataataggtccctctctatatataccagttcccaggtgtcagggctcaacagaacacaacagtgcactgaatggccaatttagctattttatagcatcaggaatgaaggcccttaggatggacgtaggccactccatggtcaaatgccagcatcccccttttcagatggcaccatcatggtagagaaaagaaaacaatcagttaccatggcaaagacagcagctattttgtgaatagcatcataagtcgtttctaaaaactgtgaagcctactaaagactctaacttttctcctcctggaagttagtgacctagaggacctgttgtcaaggagagaaaattgccctggcttatagtctgtacttcgcatgttactccttaataattcaccatttcactcttgttcttgtattgaggttactctgtgtgcctgtagtggttcttacattttaccatgtgtcacagtcagctggaaggtttattaaaacacagattactgggctccatcctcagaatttctgcttcagtaggtctgggataggacctaagaatttgcatttttaacaagttcccacaagtgatgctgaatctgccttttttttttttttgagacagggtctcactctgtcacccaggctggagtgcaggtggcacaatctcagctcactgcaacctccaccccccaggctcaagtgatcctccccgctcagtctcctgagtagcttggaccacaggtgtgcaccaccacacctggctttttttttttttttttgtattgttagtacagacggggtcttgccatgttgcccaggctggtcttgaactcctaaactcaagcaatccacctgccttgacttcccaaagtgctgggattacaggcatgagccaccatggctggccagaatctacatttttcactggcaagtcaggggattctgatgaaggaggtttacagactgcttgttgagaaatactggcctagggtgtgtccccatccctaggtggaggaataatagagtcatctgatttagacaagtttgctactgtgctatagggtctcaacccattccttaatttttatttgtagttcagacttgctgacacaaataatcttgagagatgcctcctatagttttttaatgactctcaaagtaaatttggccccagggtagatcttataaaggtatgggtaccctgagttcgttgggaaaaaaccacagaaccccaggttagaaatgagttttccagagatattaaaaatattgccttggcaatactcaaaatctttgctgctttgatgtgactttattataagagaaaatggagaattatttctatagaaatattgcctccagtcatcttaatgtgccttagtcaactagattcagctttttttttttttttttttttttgagacggaatctcactctgtctcccaggctggagtgcagtggcgccatcttggctcactgcaagctctgcctcccgggttcatgctgttctcctgcctcagcctcctgagtagctgggactacaggcgcccgctaccacgcccggctaattttttgtatttttagtagagacgaggtttcaccatgttggccaggatggtctcgatctcttgacctcgtgatccacccgcctcggcctcccaaagtgctgggattacaggcgtgagccactgagcccggcctagattcagctttaatcagaaaggcaaggtctatcctcccactgtcctttgaaatatagaaaatgatatagaaatgtcatcaccaagctcactgctatctaaattcatattcagatcaaagctgaattctgttttgctctcttcttaaaattaagccatgaaggtgaccctgaggacacatactagagcaaggagcttgacaccaaatttaagtcatgagctgaactgtttttaaaacatagacaatttatgcttacatttgcttctttttctgtatttccacttcatagagaaacaagtagaactatgatctgggtctcacctcttcagcaggagctcacacactctcactcactttgtaggggcctgcagtagctttctgtttctgagcagggtgggtgtggctgcttagtcaattataaaagcatttggcacttggttatacttcacatgtaagcaagaagggcaggcatgtatcatgtccagtgtttgattttgtaacggttgccactgccacatctctctattctgtccttggtttgccctctcagtactctcacaggacagactatgagtagctttaaaggctatgttgttgttgttgttgttaattatttcttttttaagtagctttaaaagctatttcttattcatctctgtctcatgttagccagcacatatctaattatatgtgctggctaactggatgggcagatgggtgaagtgggaaaaagacagatgaatgaatgggtaagtagatgtgtggtttgagatgcaaaggcacttaaatttgcccaggtgttatatttctttaattcctgctctatggtattgctactctaataaagagctttatttcaatagaagcataagattggaagagtggaagcatggtgatttttgttaaattttgtgtgactctagaaagcacaactaggaccaatgaatttaactcatataaaagcaaatttccatttaatataagaactttcttacacacagagctcttcaataatatgatatgctttgtagagtggagagcttccattcacatccaggcagagcccgggaggtaatcagtcaggaaagatatagaaatttcttctacattgagtagaagtaaggataccttccaatttcaagatttaggactctatgaatagggtatcaatggaactagaaaaaataaaaacaaatccaaaagacattctgaagaacagaaaaacaagaggataacagattcatctatagaagataatatttgttataataaatagcatttatggtctgttttatacacataccaagattctttcacacagattatcatttgataatggactttaagtctggggttcttttcattacattatcatctatcatccatcaaaaccacacaccctcaatctaagccttctagattgggaattagaaatatgctgttgctgtgtcctacagtggagctacttgggaaagggttatgatctgggagataagataactttgatacagggctcgtaagcttagatgatagagtacattcgctctctattatgactagcattttaattattattatcttctctgggccctgattttctttagatctagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaaccttcccagggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggtaagtatgttaactgccacattccagcggcctctgaactccccacccttactgagaggggtggccgtttttcatttctccaaagtcacagaggaagagtcaaaagagggagagttaatgactgcataagtatgtttacatgtatatatactcacatccttgtgtatatactagacttctgttgtggtggtgtagaaagatcgttggacttggagtcagacctgggttctgagtttaagtcccatctcttagttcctacaggatcttgaacaactcacttagcttctctgtgcttcattttccccatctataaaatgggtatagtatccaacccagcagatggctatgagttaacctaacagactgtccaacactattcaaatgtaagggaacattattaatactatgtgaagcctcttcctgtatccttatgcagccctgggcatatgctatgtctcagagtcttctgcgttttgaagtaatcctccagggccacagtagtagcggaggcaggatctcaccttcagcacgtgtttcaagccaaggagggtcaaaaagcccttgcctcactatagtcagggcttgtgagaagcaattctcagctgttttttgcattttcctttgctctgctttggcatggatgcaactgatgggatttaaaacctgttttgtattcttcctgtgtcaggctgtaaacattgaggctgaacacaattgcagctggctgcggtgcttgattttattttatttttgcattcttcgaggtagagtttatggtccacagggagtaattttatgctaaatcacatgcaaatttgctttacttttgaaaataaatgccttcaatgctacctggtttaaaatctatagcagagacctgcctgcttcatgcttgcaaactacctaaacagtgagcattatctgtccgtctgtccactgcagtttgctttcagtcccaaccctggagccagagttggtggagctcctttgcaaaaggagggtgttcagagtcccatttgcttgctttggctctatttcccctttcaagggcctctatggagtttctgtagaacccctacatctcaaagagatgcagtctggcagtctcagttaagctattacctctgaagtctcctggaggtgcagtcctggaggctattctagagttgccactcaataacctttggtcccccaatttggctttgggtagtcaatgttatgagggagctgtgttttacaacagtgaggcgtaggacagggctgtttctatgaggagcaatactttgaattactagtgagaaagagctctcctattaggatgggagaccctgggtatcaaggagccagaatacctgatggcggagggtccaacatcttacctagacctaactttcagtcgtcctcaccatttcccattatataattcagacccaggtctatctacatgccttatccttattcttgtttggagtgattaacttggtacaatagcatcttcaaagtcagctgggatggggcttttgttaatccagccaaatggagaggcttttaagaagcagtcagcaaagagacaatagcaatggccataatgatccttgtatgtgaatagtgctttttaaaaatctttattacttattatttattatttttatggatacataataagtatgtatatttatggggtacatgagatatgatgatacaggcatatgatacgtaataatcacatcaagataaatggggtatccattacctcaagcatttatcctttgtgttacaaacaatccaattatattctttcagttattttaaaatgtgcaattaaatttttattgactatggtcaccctgttatgctatcaaatgctaggtcttattcattttttttcttttatttctttatttatttttaacttttatttgaggttcaggggtacatgtgaagatttgttatataggtaaactgatgtcacaggggtttattgtacagattatttcatcactcgggtactaaacagtacccaatagttattttttctgattctctccctcctcccaccctctattctcaagtaggcatcagtgtctgttgctcccctctttgtgtccacaagttctcatcatttagctcccatttagaagtgagaacatacaatatttggttttctgttcctcttagtttgccaaggataatggcctccagctccgtcgtgttcctgagaaacacatgatcttgttcttttttatggctgcatagtattccattatctgtgtgtgtgtgtgtgtgtgtgtgtgtgtgtgtgtatgtgtgtgtgtatgtgtatatatatatatatatatatatatataaagctcttaagtttaattagatccatttgtcaatttttcttttgttgccaattgcttttgatgtttttgtcatgaaatctttgcccatgctgatgtcctgaatggtattgcctaggtcatcttccagagtttttatagttttgggcttaacatttaagtccttaatccatcatgagttggtttttctatatggtgtatggaagcggtccagtttaaatcttctgcttatgactagccagttgtcccagcatgatttattgaatagatagtcctttccccattgcttgtttttgtcagcttcattgaaaatcggatggttataggtgtgcggccttgtttctgggctctctattctgttccattggtctatgtgcctgtttctgtatcattaccacactgttttggttactgtagccttgtagtatactttgaagttgggtagcatgatgcctcctgctttgttctttttgcttaggatagccttgggtatttgggctcttttttggttccatatgaattttaaaatagtctttcctagttctgtgaagaatgtcgttggtattttgatatgaacagcgttgaatctttacattgctttggatagtatcgtcatcttaatgatgttgattcttcctacccatgagcatggaaagtttttccatttgtttgtgtcttctctgatttctttgagcagtgttttgtaattctcattatagagacctttcacctctctggttaggggtattcctaggtattttattctttttgtggcagttgtgaatgggattgcattcctgatttggctttcagcttgactgttgttggtgtataggaatgctagtgatttttgtacattgattttgtatcatgaactttgctgaaagttgtttattggttgaaggagcttttgggctgagactatggtgttttctagatatagaatcaggtcatctgcaaacagggataggttgacttcttctcttctggatgcactttatttctttctattgcctgattactctttgccacgacttctaagactatgttgaataggagtggtgagagagagcatccttgtcttatgctggttttcaaagggaatgcttccagcttttccccattcagtatgatgttggctgtgggtttgtcataggtggctcttattattctgtgatgtgttccttcaatgcctagtttattgagagtttttaacttgaagatatactgaattttattgaaagccttttctgcatcttgaatagcactgtataacttgcatagcacttccatatgatctcatccagtcttcccatcaagcctgtcacaggaaatcaggcagcgatactcatatccattgttttagacaaaaataatttaatgtatattagagcccaaacattaatgtgggtgctttgggttgtagcacaagataattctattattttccttttgcctgtctgtattatacaaatttccaaatgtgagcatataagaattgtagggtttggtttttgggttttgttttgtttttaaagccacagtggataagaaaagtcagcaattgatgaagctgtaatgtctaagatgcacagagtatttacatattctttctgttgtggacaaaaacctcctgacagtgcaacatccaccattcagacacttctgagatatgacttttaaaagtgctacagccattcctgccatttccttcacctccctctcctccccactccctttttcccttttcccagcccatctcttggtcagagtcctgaaaagacaggctcaaatcccagttctgcgatgacttgtcgccttaagcaagtcgtttcccagctctcagccttaattcctcctctgcaaaatgggaagtatgactttcctcacaaggacatagccacagtaagtgaaggccctcagaagatggatattcccaggattctcccatgtctgcccttggatctagcagacttagttccgtaataccatgaagataatttgaagcttaagggctgaattttattttacagaatgaaacttgaggccctgagaagttaagggtcttgtaccaggtctcaccagcttacaaatggtaggaccagagccacaactcagggcttgagcctgctctcctcaccactctagcacacaaatctttgatttgttattggaagatttcacctacccataccttctgttgacatctaatcaaatgtgtttattatctatctcacctcttttttctcatccccatcgtcacttcctccaggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtgga

SEQ ID NO: 36724 - DNA, 54114 bp, Homo sapiens
tagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaaggtaagaaaccatctgacaagtttgctatggcttcttcagccaaaatttatggaagtttctgagaacttcagggtatcagagttggaaaagacttagagaggccctggttcaaacccctgtgttcagaggcttccctgtggtgtctgtgggcacagctggagctgaagaacaagggaaaggtgataaaggaaagaaatgaagctcttattggtcatcccttgcctttgttcatttcaattattgtcttggaaatctgtagacatcctaagagctcccctccactacggacatgcacgtttctctctatgtctttttcccaacccctgctctgacaccttcccattgctgcagcctcatggaccacttccggtgaccagttagatatgcttgatctatttagttaattaaggctctgaatcagcccttggccagaagaagcacctcctctaggaaatcattccttctttttagtaatacgcaattgaaaagtatgtgtgggttatgtgctgttaggtgctaagcattttagctatgaattaactcataatcctcaaaataaatctggggtatagagagaggttcttgtttcaattagaaaagtaatgcttggagagactatgatttgcccaaggtcactgccaatagatgacttgattagaagcagggtatgtttgaatgcgaagtccaggctcaaaaaggggccttagtggctcctactagactggtatcttaaggcaaggaaaacagaatatgtccctaatatctaaaaccatgcctagtgcccaggccaggcttgaatcaatgctcaacgcatgcatgtgtaactgaacagaactgcccagaaccttggctcaggccaagtaggccagaccaccccacaacagacatcttccctgaatgcagggtttgagaagtgccctaatgccctctaactgatgctgagtttgaagaatccatcagttaaggggaggtgtttctgagtttgaagaatcaaacaccttcctaattggtaggaatcctgaaaacactccacaccggagtaaaagactttggttttttatctttatgcctgactaaaagttaactctcattctttcattcagcaaatattttgtgctagtgcatgacactgcagattaatatcgtagatgaactgagtctgggctaggtagagtcaaaaaaaaatttcctaaaggagcctgtacctaaactgagtcttcagagagaagttggaactggcaaagtgaggaaggacggggtctggagggaagagtgagtgcaaaggcacagcacatacagaatgcctgcatgctctagaatccaaaactgtgtcagccaaatttgagttgatggagggacagccaaactgagatacccaggcggtggttggatttatggatctggatttcaggggagtgggcagggctaggggaatagaactgagggtcatgatgtcagtggtaggagttgaagtcttggaagaaagagtagatagaaactttgttttctgatgaacattctatgaggaagttcagcagaggttggaaacatctttaccatttataaataaattttatgtaaaatcctatcctgctgtcatgtttaagcaacttattatgcacagcaccaggacatcaatgtaaattgcatgccagtctttgctctcagtttcaaaggcattcttccctgcctgctgtctaatctttacaaagaaaggttaactccagaggtcaggaatctgaacacagaaaaccagattgcatcatattcattctaatcaataaacattatataatttttaaaactgtttctcatcttttatttcttcattttaatgaatatgtcaacacaaagccgtaaatgaaatcacatttacacaaaagtacaactggggtaagaaaattcaaaagataaagtaataaaattaaatttaaaatgaaataccctatgtatttgagtaagttgcttagcttctcccaaccttggtttcctcatttctaaaacgaagaacttgcttaatattcaggctctgggccccaccaccaaatccttgattcactggctctgggtctgtatgtaacaagcttctggagtgattctaatgattagccagagacaggacctactattctacgtaactgatttcctcttgctgctgtaaaaaattaccacaaatttattggcttaaaacaacacaaatgtattatcttgaagttgtggaggtcagaagtctgaaatcggtttcactgggctaaagtcgaggtgtcagtgtggctgtttcttctggagactctatgagagattgtgttttcctgccttttccatggattctgtttcctcttctagaggctacccacattccttggtttgtagcctcttcctcgatcttcaaaaaaatgtatctctgcttttgtaatcacgtcacattttctcctcttataagtcaaatctccctttgcctccctcttataatgacacttgtgattacatttaggatacacccaaataattaggatatctccccatcccaagatccttaattatatatgcaaaagtctgtttggctagaaaagataatactcacaggtttcaggggttaagccatacatatctttcagagtgagccattagccattattcagcctactgcgataatgtgcaagttccctttacaatctatgttctatgttcccatcaaggttaattagaaatattagactctttttccacagaaaaaaaaaatgtagcagtagtttcatctctaccctgacttctctctctttccttcatgcccagtaagaggaagtgaggtgcaccatctgttcatctcatcaggtgttacctagaatcagagtcaggagaaagcacctcataaaactactctgacaagtaaaccatatcctggggaccaggtgagaattaaaaagctgtatactcataagctgccaaagagctgatggtactgaagtcacatggagctcaggaatttattcttgcatttagaaagtatgcatataattctctcgaaaagaaatgaaatcatatttttctgtcggatcaaattattcagaaatccgaactgtagaaaacatacaaacacacttgcttaatgttagctttttaatcttatttttgtacacagtatacttttacataggcactgaaccagctggaaatgaatgcttggattttcgcagctgataaaagcagagttcagattctgtccttgagctcaatgtctggagaaagcagctgtgaatactgcttccttaattcagatgcctttggccgtgaggggcatggcattttaaagctgcaataaactctgtactttttctctcaggggattagaaaaaccaattgatttgatagtgactcagcagttttcaccttcctctttagccaatgccctgcagctaagattgagaaacggattcagaactcacacctcttggtgcttggtggctcccttccaaaccatcagctgttctttctactttctttcctattttttaaagcacagtctgaatcaagtgcttcagaaccatttatactaactcgtgttccaaacacataaccctgaaccctcttctaaggccaccagttacaaagaatggggaaggttaatgagtaactccaccagtgcctgccagaaagctcagctgtactccagccttccttcctctcttgcagagagaaacaatgcggcagttgaacaaagcgaaggcactgtaatgcccagtggcttcagtcacaggctggtctaaaattccatttcacagaattgaagataatttggggttattaccaattctcagcagctcaaattcaatcccgttgatggtgagcatggggttcattttgagagtagaaaattggatgcagtggagaatcagaatgttggatggtctctgccatttccccaaagatatcatcctaactgcatgctgctgcttttaacaaatcagtatacaacttagtattttttgtgttgacaaattttcaaatatacaaaatattgagtctgaaggcaaaaagaataatttttcacttccattgcttcctaggtcataacattcacatctgatatttcttccaaatacagactgttgttggcctgatcatcactcacacatccaggcttgttacatctccacgccactgagtatcagggaacctgccccaatattcacgtaggttcttttctattttccctaagcgtcggccaactttagaaataaagggacagagtacaaaagagagaaattttaaagccgggcatccgggggaggcatcacatttcggtaggttccgtgatgccccacaagccacaaaaaccagcaagtttgtattagggattttcaaatggggaggcagtgtgcaaataggtgtgggtcacagacatcaagtactttacaaggtaatagaatatcacaaggcaagtggaggcagggtgagatcacaggaccacaggaccgaggcgaaattaaaattgctaatgaagtttcgggcaccattgtcattgataacatcttatcaggagacagggtttttaggatcaactggtctgaccaaaatttattaggcgggaatttcctcttcctaataagcctgggagcgctgtgggagactggggtctatttcacccctgcagtctcgaccataagagacaggcgcacctggaggggggctgtttataagcctatacctcctggctcgtattctctttctcagggatgttccatgctgagaaaaagaattcagcgatatttctcccatttgcttttgaaagaagagaaatatggctctgttctgcctggctcaccagcagtcagagtttaaggttatctctcttattccctgaacaattgctgttatcctgttcttttttcaaggtgtccacatttcatgttgctcaaacacacatgctgtacaatttgtgcagttaatgcaattattacagggtcctgaggcaatatacatcctcctcagctgacaggattaagagattaaagtaaagacaggcataaatcacaaggatattgactggggaagtgataagtgtccatgaaatctttacaatttatgtttagagattgcagtaaagacaggcataagaaattacaaaagtattaatttggggaactaataaatgtccatgaaatcttcacaatccacgaacttctgccatggcttcagctgatccctccgtttggagtcccagacttcccgcaacaactgagaactctggagggcctacccttcacccacttccacccttcttatatctcttaaggagctgtgttcagatggttacatttcgcttgctgagcaagactgcattttcattatcctgggctaaaatcaattggtatttaagttagagcaaaaagggttctaaccctatttacagcagcacacatacacttacattagaattggctttaagggaaaaattcaatcaatcgacaaatttccactgattaccttctatgagccaagactgccatagtctcagccttcatgcagcttataggctagcaaaaaagccagacagtgcacaagaactcacaagtgtgttgagtgttgcaagagtaagtttcaggggctctccatgacttacctggttgagaaaccctttaactttttttttcctctgggtgtaaagtgaagagatggcaatcagagtaggttccattgtgtcattgtgaaaagatgctgggctggcgtgtctcctgaaggccacccatatctttaaactttattttcatgcattcgcacaaatatagatgtgttccatagatgaggcagatagcagaggcttctgcctacagcaaggctagtttggagagggttttgctgtcagggttggacccacacacctcttcatagatgctttttcttttttttcccagagtttgaaagggaaatggagtctcaagttcagggaggttacagtgtagacccacaaatcagctaagtacagctaagggtggagaagtctatgcaatatccagcactcttctgattaattagaagtctttaaaattcacagaaaccatattgtcttccctaaatgattcatatgtcaagacacagtaaagatattatatgtggaacatcatacacaaacataggtccatatagaaattcttaccttagtaaactgccaattttctgaaatgctctttaaatcctgctaatggtggcatttgtgtctttgtcacctacagtacatttctggatttgggaatgagtgttcttcagaggatcctcgctgcccaggttccctgccagaaggacaggtatgagcaaataaagtgcttagaagagctctgaatcctattcctggatgactagctttcaggccaaagtgcctccacccaccgtggctcttccaatctagcctgtgaactgtctagaggtttcccaagtcataggggcaatgaagatacagagcaatgacaacacaaagattaaaattggattggtggcacagcagccaatccaaactagtgaaattaactgtagggtttccagtaggatccccaaaaatccagagttaaagagaatccctcatattccccttgaacaccatggatgtgagcattatgataaaataacaaggtgctttcacatgtatgcacaaagatgttcatactagtgctggttagaaaagcaacaacacgggaaacaaaaatattttcaaaactttttgcaggccgtatcatagcataaaaaaatcctcatttcttaaaaaaaaaaaggaaaaaatgcctgattattacagggttacaggtatgatagggtcacaattttggaggataagaatgcaaggaaaaataccaacatgtgaacgcttggttatttctggttgtgagataatgggtgttatcatatagtttatacattttctacaataaatatatattacttttataatcggggggcaagtcacatcaaaagttgttacaagaaacatatcgggttgcagatggtcatgtgcagtcgcccagagcatccccatccccctactgagttggttggtgggaaggtgggatgcttttcggatgggagtaatattgtttattgcatcctttgtttcagaataatcctcaggtctgcccctacaatctctatgctgagcagctctcaggatcggctttcacttgtccacggagcaccaataagagaaggtacaaggattagatgaattctgacctgcagactgtgggtactatgacagggactttgtgctgcctccttcccctgggccacagcctcccagagctgcccaagatcctgcttcttataggctatggtctgggtcatggtcagaagagaatgaacttcctgccagctagcaccaagtgactggtggaagaaggtgaaggaaagctgcacagagctgggaaaatacacatgtccagttccatttacaaattacctcctatattcagaaggaaatattcctaatagtttggtcttcttctaaagactgtcctgttgagttttggcttggggtttacctgttttgttttgttttataatgactaagtcacaattatggaagattcagagcaatatctttctcagctgactagaggtatgttctttgcaagaaaatgttgggtaaacgaagtttggatagttaaaaagtcacatattatggcccactgtggtttgaattaataaggtttttactctggtattcgcctttgctagaaaccagcatattcatttacatactgtgccatgttccatgtttgctctaatcctacatccaggtcaatgaacgtaatcccttgattaactcatatcaggcaggttggatgcagtatgtgttatagttttgggaggcagtaagtgttatgatttaaacaaatagtgtctaattataaaaattttaggctgaggtatttgtgaagaggaatgctgctggtattagagactcggggagaagggcatgtggtcttgtactgcttagtagggcagcctgggtttatctccacaggtccttctgagaagcaaatgagatagtaagtaaaaaactataatggaccacacaaatgataaagattgcaaggtttaatcatggccaccctggaggcaggccccctaagtataaatcctggctccttttccagctgtgtggccttgggtaaatcatctgccctcttggatcctctagttcttcattcgtaaaacaaagataattatggtacctatttcatagctgtggtgaggattaaaagaaaggatgtgtgtaaagcacattagcttagcttagcacattggcacaggcacatggttagtgctcagttaatgctagttattgtcatgataactatcattaagtattgccatcatagcagagtttctgcctcatttccagggtatctctaggaggctgtcaagagaactgggcatgatatgtggcaagtgctatgttacaatgtcagtatcaacagtacttttctctcaatagatatatgcgtgggaagaggaagagatagagaaagatttctatacatgtcaaaaatcaggggataattccttcactatttaatcatctctctctctctctctgtaagcccaaatagggtaagataagcacgcagataattctgtccattctaatttatgacaacctgtcctctatgactatgttcttgactttatggcccattccctaacaggccacctggtctccggattctgcagcctgtccccattattcagcaatatcttcagccagcaggagctgagctttgttccagcaggctgaaaaggagctgttggcatttcattaagaagctggcactgttccctgaatcagaattaaatctctgttcagggcaatgtagtactgcctggggagttttataaactcagctaaaaaataagggacactaggtatggctcacccatctatttagaagaactctccaaagatatccacaagaattttgtggaaatgcttcccacccaaaatctccagtgggaaaatgggaccagtcttatccataagtaggccagcctgaaattcttagttactactcatctgaaccatagcatacagggccaccacaaaactattaaagagtctatctacctacctacgtacctacctacctacctatcagggattaatttttatcagattagctagctgattgatcccttgggtcttgaaaaggcaaaagtctggagagataatttggaaaatgtggactgtgataaaaattcagaagattaagagaagaaaggcaatttaacaaacacatgataagccagcagctactgtatgccaggcatttttggtacacaaactctctgagttctcacaacaatcttaggtgacaaggatgaagaacataaggttcaggaagtctagtaactctcccaggatcacacaggtggttccaagacatacacacatgctctgaacttcatatactgggagctggagaggcttagtaagaccaaggtctgaggtcacgtcatcaagagatggagaaatcaaatggaaactaaacagatctagccctttttcccccagatggctcaatgttgggccaggccaactcaactcactgaggtagactgtccttggtcttgaaagggccagagcctgttgattcaggtctggtcttccgttgtccttctgtattttgtcagggcagtaccctctgaaaggacttgggtccctcttagtgagcttcaatgtcccttccagcttctggaaggtcttatcctggtgtcctttcagattcctttatcagagtcttcttcccttcctgaagcctgagatctggtcctggtagagaggacacactttaaaaagaaaagaaagaaagacaaataaaggcataaatgtactacaataaaacatggacatacactcttataattttagagtacagaagtgttaatttatttttattttattttaagttccagggtataggtgcaggatgcacaggtttgttacataggtaaatgtgtgccatggtggtttgctgcacttatcaacctatcacctaagtattaagcccagcatacattagccatttttttaatgctctccctcccccaactcccaccccccaacaggccccagtgtgtgttattcccctcactgtgtccatgtgttctcattgttcagctcccacttatgagtgagaacatgcagtgtttggttttctgttcctgctttagttcgctgagaatattggcttccagttccatccatgtccctgcaaaggtcatgatctcattcctttttatggctgcatagtattccatggtgtatatgtaccacattttctttatccagtctatcattgatgggcatttgggttgattctatgtctttgcattgtgaatagtgctgcaataaacatacgtgtgcatgtatcttcataacagattgatttatattcctttgggtatacacccagtaatgggattgctgggtcaaatggtatttctcattgtaggtctttgaggaatcaccacactgccttccacaatggttgaactaatttacattcccaccaacagtgtaaaagcattcttatctctccacagcctttccagaatctttttctcttataaattaatatcaaaaagacaaacccaatagaaaatgataaaggacttctacaagtaattcacagaaaaactataaagagccaataaacaaatagacttgttttttggaaatattttgtattttctaattcataataaaggaaatacaaaataaaatgagatactatttttcacctaaaacactaaaatttttaataatactccagatttgtgaagatgtgggtgaccaggcactctcacacgttgttagtatgataataaagagttaaaatgatctgataattttgtttagaaatgcactggacgtatctgaaagaatatataagaaatatataagaaaatcactaagctctgatgcctctgaggaatagccctgaagaaactggaggacgaaggtgccatttacctttcaggactttttaattacttgaattatttttacctttggcatgtattacttttgtaattttaaaggagaaaattgatttactatttcaaaaataacaaagataccacccatattctctcaagctgcgtagaactcattgttcttgccttccagagcaaggactagcatcctatgatacacacataagctaatgtttttctatggattttcctacacagatatccctcaaggtacttccccttcccttatagtttttagaaaagacaattcttcattttttggcagcatggaaataaccatgagtcagagtccatttgaagcatgatgggtggaatgaaaaagtgagaagaggccagggctgtgggcagcagatggccatgaaaagtgatgctgtatcattgcttcactgcttcacacattagagcctacaggtcgttgttgacttgagtgtcttcctgatggtactgcctgagccattctgtgtatcactcagaacattactctaaggcttgtatatcttgtatgtttttccctctagctggctgtataggattctaccttcagtttctcacaagccctttgaatccattgacgaaggccaagtcactcacaactgggatgaagttgatcctgatcctaaccaggtaacctggtcctgtgaattgaagcttatcatatacccaaagccttgactagaaatacctaaatagaataccatggtcattggaaaaaatagatagttttttaaagtattattttaataaatgctaaagtgtgtctgttttctgctcaaacttgggtggtgtattagtccattctcatgctgctatgaaaaaataaccaagactgggtaatttataaaggacatatttttaattgactcacagttctgcatggctgaggaggcctcaagaaacttacaatcatggcggaaagggaagcaaacacatccttcttcatatggcggcaggagagagaagtgttaagtgaaagggggaaaatccccttataaaactatcatatcttgtgagaactcactatcatgagggtaaccatccccatgattcaattacctcccaccatgaatgtccctcccacaaaacgtgaggattatgggaactataattcaagatgagatttgggtgagacacagacaaatgatatgaggtgggaattttggaaatgatggattgattatgtatatacatattgttaaaagaaaaacctttgacaaatctaatttaacagagtttaattgggcaaaggacaattcacaaattattctacctgagccaggataggttctgagagattccagtgcagacactagtagaagacgatttatggacagaaaaaggaaagtgatgtacagaaaacagaaatgaggtacagaaatagccagattggttgcagctcggcatatgacttacttgaacacagttttaatagtgtgtcaccatgattggcacaagagtaggttacacatccaattaggttatggttcactatgtatggagaaacctttaggcagaacttaaaatatgtaaggaggcaactttaggacaaacttgattaacagtctgcgtgtgtgtgtgtgtgtgtgtgtgtgtgtgtgtgtgtgtgcacatgcgcacataagcttgtatttttctagcctaatggcatatagatggacacaggagtagttcggacttactagaactgctcaggtgaattggatgagcggaaattttataggttggtcaaaatattttatattttataggttggtcaaaatatctacatgctcatggttttttttttgtttttaatctaaacttaccacaaaatatagaaaatacattcaatacagacatctttgaagagaggcctttgaaatctggcataggggtgagagtcttgctatctgggctgaattatgcaagtctattgtggtcacagatcactatcacagtctcttcagacctaggacttccattctttttctaggagtttcctccttttggtctagtaatagtgggcgttttctctaattatcgttattacttacgtactctgcttgcagagtatataagataaaatgagacagaaccagtactatagcaatgagatagacccagtgctataaacgactgagctctttttttaaccttctgagaaccccagtgtattgcctttgtccctgagtttaggtacatgttgctgataataggtatgtagggcaggaagaaaaacagacctgggtttgcatccctgcccatctacttactagctgtgtcttaagctatgatgtttcaattgtaaaatgggatgataacatttgcctcacagtgctattgtgaagattatgagagaataggtgtgaacctgcttcatacaatgcctggcatgtgataggcaagaaccatgattctgatacagctatttatatttacctgaatttacattattcaggtaactttatttcttcattttatattattttttactctgaaggcttcttctgccctctttccctccctcctactctctctctcctccctctctccccaccccgccactttccacaacccaaggaaatctcctgcttcccctttgtttaccatgacattttgtctatacctgccaatctccctcccctaagtgcttagactttttataagacaaaagtcaaaataatttatagacacctttggtttcctgcccagttctctctcttgtcttaattatggaaatctcagcgaaataagcatctgcttgaatgttaccacccctctctaccagggacaggaagggagggaggcatttagggtggaaaaatgtgaattggtatttaaaatactatctacctcatagccactttgaaactaagatattttgtctaaataattgacccttaaactcgtatgaagtttaatgcataaagcagacatcctccctggtccccagctggcctatatattgcctttaagcacattgcaaaatgcagcccctattctaacccccaaccccttagactcagtcccccacacaaagggacacagacgaggcattcagctcctccctttccccttcagtgggacaaggcccttgcacagggcacagcttgcacaaccaacctggggaccctgacttcacctcattcctgagtctcatgtggattcaagtaatatgggtatagtaattatgtatatgaagttaactaaatgagggattataagaaaagtccatgggcagatttggataatttaaattattgtttatttataatgaaaaataattatttattattattttgcttcaagatagcaatcaaatcagtagtggttaacagggtaggctggggagttccagggctcctgcctgctcatgtcgatcacaacaattttctaagcctctcaaccttaataaatcttcatagatctgtttatagttgtgtggacaacagtggagccatacttcttttacatagttttattcggggtgggaggttaggttttaaacctaacctttaaagaaaatatgtgatgtgactctactttgagtgtgatgtgtaatatgctcagtaatatacctttattatatattattatttccttgactatcattgctacattttatttaacatgaatacaccctttcataggaactattttggagttcgtgtgacatatccatggaagacaatcttgttctaatagaatttttctagctttgtctttttttttttttttttttttttttgagacaagagtctcaccctgttgctcaggcgggagtacagtggtgtgatcacagctcactgcagccttgacttcccaggctcagatgatcctcctacctcagtcccctgagtagctgggaatacaggtgtgcaccacaatggccagctaattttttgtatttttggtagagaaagggttttaccatattgctcaggctggtctcgaactcctgggctcaagcaatctgcctgcctgagcctcccaaagtgctggaattacaggcatgcaccactgcacccagcttagctttgtctgattgtatgagtaaaatatacttataaaaacccaaaagtattgtagaaattaataaaatattactggacgtctcccatcattaagtgagagtcaagtatataagttgtacatgttaattcattatttcataaatagttgacatacattttgaccaggaagtttgaagcaactggattaaaaagcttgagttaatacagaggcatcaaaatagctgtatcagggtgggcatggtggctcatgcctgtaatcccagcactttgggaggccaaggcaggcagatgacctgagactgggagtttgagaccagccttacctgaggtcaggagatcgagaacagcttgaccaacatggagaaacaccatctctactaaaaatacaaaattagccaggtgtggtggtgcatgcctgaattcccaactactcgggaggctgaggcaggaaaattgcttgaacccaggaggcggaggttgtggtgagccaagattgcaccattggactacagcctgggcaacaagagcaaaactccatctcaaaataataatgacaataataataatagctgcattggaagtttctgcttgttttctagcagaccctcagcccatatttgttccccttctccccgcttcccatgtctcccattctaacctatggttagaatggctttgcttttgtccttgaacttgttgcctttcttctgttttgaattccctgaacactttctatatggtagccaccaaatgaatttcttctccaatatcttccctgctcctttgagaccttgtcttcacacacactgggagagatgtgcctcagaattcaatagcgtctcagtgtctctgtgaacaccggctccaaccaggtagcagtttattatctttctgacttgtgacctctgtcacctgccaactacttctctctccatgataaaccctggctgatcttgcaaaatctacccttttgtcttttcttttacaccttctttacaagttaatatctctttccaattttatacttcattatttaaccacagcattttgcattcatcactttctccctcataacctcctccaaatatgtactccagactctcagcaagaaaggctgagaaaattatatttaggcaccctctgacagtccttcccagctgaagcctgtgtgataggtatgtcttcacctgtcatagaccaaatccaatacttcatcagcttcaccaactatccacattagtcatctctgggaatttgaagacctgaggactgcctgatgattcctccagtgtaacatttagtcccaaaggcagcatcttgcaatatgtgatcatcactgtcatccttgataccctctcaggaagactgggggctgctccccctaaagccttcattttctttagtgtatatttaatcagttatccaagaattaatgcaacctctttttgagtgtatttaaattcagcctgaggacataaattcaattaattaatacctcacataagaagtatacctaattttatgtgtctgcctctaatttctgaagtctcagaatttaatgaactaatctacatccaatttaaccatgattttacagatttcagctagaattcctgaattagcacttctctttaagagtcctttaaaatttatttttcttattatttcattctaacctcttgattgttgaaaaatcagattcttgactcagttaagactcagctgagaaaattacctcttggttcttaaccagtataatttggatcaagtgagaaatacctcaaagctaattaaagaacatatcataaaatgccttctgtctctagtacatgcaaattataaaaaaaagtttcaaaacaatatacccttacagggtatttgctgtctaatttgtcaaactttccaggttttgccatcctgaaatccccttccctccacaaatgtcttggattttcctgcctctcttgcccaagtctgtcctagtcacagccagactccttgagaaataatctaaacccactttatcaccctcattcactctttaaccctatgcaattcagcctgcccagatgactctattgaaaatatttataccctctttacacaatagtgcatcactctctaattaatacatatttttatttaaaacttacattaaagtgtcaatgcccagtaattccactaacacagagttaacaacttctaatgttttgggttctttccagtcctttctttttgtacatatatgtaaataaataattcctagggtcccatgtagccagtaaccaagagtaatttaaaataatatctggccaggcacagtggctcatgcctgtaatcccagcactttgggaggccaagatgagaggttcacttgagtccaggagtttgagaccagccctggcaacatagcaagaccctggctctacacaaatgtgaaaaaaaattagctgagcatggtggcaagcaccggtagtcccaggcactcaggaggctgaggtgggaagactgctcgagcctgggaggtcagggctgtggtgagccctgttcatgccactgcactccagcctgggcaacagtgtgaaaccctatctcagaaaaaaaaaaaaaaaaaggaagaaaaaagaaagaaggaaagaaagaaagaaaagaaagagaaaagaaaagttaatctttacttgtttttcctgaagacattaaacagtatccaatatatgacccacagcaacactttttaaaatcccctttttccagtttttcccagactccaaccctctcacatctgtcttctctcacctcacctctcaccttccccaagctcttcatgccttgtcaccattgattgttggcttctctcttcctccctgtacattctgcctctagaaaatgatacctgcactgtagatcccctaccccatttggctgggatcacacatggtgttatgtgggataacacacacataacagtgacctccatggcaatactggagttcaaaggactccagtgagaataggcaaatctgaattttccgcagagatcagggaagggaagaggaagaggctatgaatacacttataatagtgcttttaaaaaaaaaatcagttacatatatatttactataattaagctgatggtgtaatgcagtcttagattatttttatttaaatatcatattttgcgcctttttccatgtctttttaaacttcttgagtgtagatatttttgatattatattataatccaataaatgtttataaaaattcctaatattgtgagatatttgaattttttccatttttgctattatgtagtaaatccacgctaaatataatccttttctcctctacatcccagcctggaacaacagacctccttcttttcttcctgaatccccttttttccctgggttccatgacattgcatgattcccaaacctgcaaaataagtattcttcaaggtcctgaactagaatcttgatatagtttgactgtgtccccacccaaatctcatcttgaattcccacgtgttacgggagggacctggtgggaggtagtctatctgcacaagctctttctttgcctgctgccacccaaatgagatgtgactttctcctccttgccttctgctatcattgtgaggctttcctagccacgtggaactgtaagtccaattaaacctttttcctttataaattactccttctcgggaatgtctttatcagcagcataaaaatggactaacacaactctcacctcccccttgtcatcatctcccctctgagagaaggggaagtacttactctctctcttcccctcctcttccttactgtctttcttatcctcctcttttcttctccttctcttcaccccaaccttccccttcccctctgtattgttctgctagagctatcataacaaaaagatactgggtggcttaagcaaaagagatttactttctaacagttctggattccaagattgaggtatcggcagggttgctttcttctgaggcctctctcattgacttgtatcttctccttggctcctcacatcatcttccctctgtgtctatagccaaatttcctcttcttataaggacaacaatcatatcagattagggtccactctagtaacctcatttaagtttaattattcctgtaaagactccatctccaaatatagtcacattctgaaatacagggggttaggagttcaacatatgaatttggaggaggaacacaatctagcccataattctctccttctgcttgtttttccctctaaatatctactaaggattcccactcttttggattctctttgccttagagatgaagggatagttgttgataagaaataatcaagtgggacaaactaacaggaggaactccttgagcaatagaggattttcctagctcactacactgaatcaggtgccaagtccatagaatggtgatgcctgagtatacataagagttaccaggggacttgttgaaaatgtagattcctcagtcttgctccccagagatcccagttcagtaggtctgaggtggtactcaggagtctccccagatgactcccatgcaggttggtgctggactgcactttatgaaattctgctgtagagtgtgctttcaggatctctctggttccttttttccttttcctacctccacctggttcagacctcatttcttcttacctagactattttaatgaccttctacctgattcctatgtcttcccctccctatcccacaccgtgctgccagaatcagcgtgctaaattatcatctcaaaaatctttaaatctaaccatcacccgccccctccactgcccagccaatccagtgcaggcttccagataagagatcaagagctctgattcactatcacagcctttcagactctccactcacttccatgtcccctacctatcagtcacactagaaccatcgtcattttatctacctgggatttcctgttcttccatcacaaatactcacccatctaaatctcactcacgatttatgattcattttaaataatactttcttcattatgccctttcaatatttctcagagtatttaaggttctatgtctctatcatcttcatctgatctgcagtatccagtacatgccttcttccaaatagaatcgcaagtatttgttgaatttactccctgatagttcagatcctatcattctataaataaattagattgcatttctctaaatgcattcagtggtgtgtgccaacattacagtgcacattcccctgctcagcccttttggacagcttgctagctctttttacatttcatctccatcaacttacatttcacttcttgcaaagatattggcgctgtctgcaaaccagatgatttcattgcttatatctcttattttccatatataagaatgttaaataggccctgtgccaggacttattcctgagagaacatttctatttacatttctcttccaaagttatttgcactgatccacttccttgtttttctatcatgaggttttcacatttccaggatcttctgtaatggattacctgagggaagagacaatgtcatgttcacctccagcatctagcataaaatctggcacacagagaggttcaataaatactgtttgaaataattaatataaggggattagacaagaaacattaaccctgaaggacctaagcagggttagtgtcccaggaatcagactggccagggtgattcagcactggaggaacagtaaacaaaggtcaatttggaagaccaggtacaagaccattaaaaggagggaaagcttgggtttaggagccaaggagatcaggaataatttgggaaacaggtcaagacaggctaagatcaaagggctcagggtgtaggttagtaagagggtctgagaaagtgttggcatcagttcttagtagagaaaatttaactgttctaaaccatcagttttttcacttctaaaatagagatgataataataatcatagggagcctcagagagttgttgtgagaattaaatgtcatccaacaaatatttattgagtgactattatgttctatacttcgtgctaggtgctaggtaatggatttaaagctcttagctttacattcaaggacaaggtcaaatgagaatccaagttttcatccttgatggctcatcttcatttgtagcctcatgaaagacttttgttatgttttgttttgttttttgagtacaggctggagtacagtgttgtgatatcagctcactgcaatctcctcctcttgggttcaagcgattctcctgcctcagcctcccaagtagctgggattacaggtgcccaccaccatgcccggctaatttttgtatttttagtagagacatggtttcaccatgttggccaggctggtctcgaactcctcatctcaggtgatctggccgcctcggcctcccaaagtgctgggattacaggcgtgaaccacctcgcttggcctgaaagacttttagaaatctaaattacagtgacttggatcctcattatctatattcttgcctatcacctcaaagaactccaacggatcaaccaaagcctgatttctctccacataattcatgctacctttttttcctcaaacttccaaagtttctgaagaattcaagtgagccactgttttattttaatccttcctatctttcttagtctggactgaaactcaccaccacaaattaccctggatctctctgctaacaactatttatacattgtattagtccattcttgcactgctataaagaaattcctgagactgggtaacttacaaagaaaggaggctcatagttccacagggtgtacaggaagcatagtggcttctgcttctgggaggggcctcaggatgcttccaatcatggtggaaggcaaagggggagcaaggtatctcagatggcaggagcaggagcaagagagagaggagggaggtgctacacgcttttaaagaccagatctcatgagaactcactgtcatgagaacagcaccaagagggtagtgctaagccattcgtgagaaatccacccccattatgcaaccaccccccactctctcttgctcctgctcccatcatatgagatgctcccatcatatctttgccttctgccatgattgaaaactttctgagcctctccagaagcagaagctgctatgtttcctgtgcagcctgcagaactgtgagccaatcaaacctcttttctttataaattactcaatcttaggtctttgtttatagcagtgcaagaacgaactaacaaagaaaattggtaccaaggagtgggacattgctataaagataacctgaaaatgtggaagtgactttggaactggataactggcagaggttggaagagtgtggagggctcagaagacaggaagatgagggttagtttcaaacttcctagagacttgttaaattgttgtgacaaaaatgccaatagtgacatgaacaataaagtccaggctgaggagatctcaaatgaaaatgaggaacttactgggaactagatcaaaggtcaaacttgttatgccttagcaaagaacttgactgcattgtgctcctgccctagggatctgtggaactctgaacttgagaatgatgatttaaggtgtctggtacaagaaatttctaagcagcaaagcattcaacatgtgaccaggctgcttctaaccgcctatgcccacatgcatgagcaaataaatgacctgaagttggaacttaaatttaaaaataagtttagatttaaacctatatttaaattttaacttgtatttaaagggaagtagagtgtaaaagttaggaaattttgcagcctggccatgtggtagaaaagaaaagcccattttcaggagaagaattcaaactggctgcagaaatttgcataaataaaaaggagccaaatgctgatagccaagacaatgtgggaaaggcctcaaaggcatttcacagacctttggggcagttcatcccatcacaggcccagaggcctaggagggaagaatgattttgtgggccaggcccagggccttgctaccctgcacagcctcaggacactgttttctgcatcccagctgctccagctcctcctgtggctcaaagggatccaagcaccgcttcaaagggtgcaagccataagccttggtagcttccatgtggtgttaagactgcaggtgcacaggatacaagagttaaggcctgggagcccccacctagattttagaggatgtatagaaaacttaaatgttcaggcagaagccagctgcaggggcggagtgctcacagagaacctctactagggcagtatggaggggaaatgtggggttggagctcccacacagagtccccgctggggcattgcctagtggagctatgagaagagggctaccattctctagactccagaaaggtagatccatccacagattgcaccgtgcacctgaaaaagccacaggcactcaatggcagcccatgagagcagccgcaggtgctgaatcctgcaaagccacctgagtggggctgaccaagaccttggtagcccacccctcacaccagtgtaccctggatgtgggacattaggtcaaaggagatttttttggagctttaaaatttaatgacttccctgctgtgtttcagacatgcacggggcctatagaccctttgttctggccaatttctcccttttgaaatggaagtatttacctaatgtctatacccccattgtatcttggaagtaactaacttattttatattttacaggctcataggtggaagggacttaacttgtctcagatgagactttggacatttgagttaatactagaatgagttaagacttttgggcactgctgggaaggcatggttatattttgacatgtgagaaggacaggagatttggaaggagccaagggcagaataatatggtttggatctgtgtccctacccaaatttcatatcaaattataatccctaatgttggaggtggggcctggcaggaggtgattggatcttggggacagtttctcatgaatggtttagcaccatccctgttggtactgtcctcatgatagtgagtgagttctcatgagatctggtcattgaaaagtgtgtggcacctcccacctctctctctctctttctttctctctctctttctctctctctctctctctcactcctgttcctgcaatgtaagccatgccttctcctgcttcaccttctgtcatgattgtacatttcttgacgcctcctcagaaactgagcagatgccagcatcatgcttcctgtacagtctgaagaactgtgagccagttaaacctcttttctttataaattacccagtatcaggtaattctttatagcaatgtgagaacagactaatatgtacactatgatgactatttcaccgagaaattacttcaaaattcttggataggtggtactcacttctaatgatatgtctgtctatcctcagccagtgttgttgagagtactcaagtcatccaatctagttgagtccatgggaaatttggagggaatctcagtaaattaaagaatttcagttttgaaagggatacttggatcatctagttcaactcccagtattctaactggaaatatttaggccaattatctaatattttcttttcatctctgagcatgaattttgaatcttgataatcaaatgttgataccaattctgtcttcctcctttggtaatcttaagtaatttttaattctaactttggacacccttaaagatgctttcaaattatttttgaccacctcatttctagcaagtaaaagtttatcttccaatagaactcatagaatacagttgtaaaatatgtgaagcaataatacaactaaaaggataaatagacaaatccacaattttagttggagacttcaacacccctctctcaacagttgatagaacaactgaacagaaagtcagaaaagatacagaagtgatctacagaaggagcaggattggaaaaaaagttttttaaaaaagaaaggatatggaagtgacgattttacacgtgtgaagaactgacattttacctttggacttttagaaatatttgattttctagacatcgcctgaatgttattttgacttccaaaagatctcacggtccaggcacagtggctcatgcctgtaatcccagcactttgggagggcgaggcaagtggatcacctgaggtcagaagttcgagaccagcctggccaacatggtgaaacctcatctctactaaaaatacaaaaactacccgggcatgggggcatgcacctgcagtcccagctactcaggaggctgaggcagtagaatcgcttgaacccaggaggtggaggttgcagtgagccaatatcgcgccactgcactccagcctgggtaacagagcgcgactccaacccccccccaaaaaaaagatctcaaaaatttactttattcttgttcttagcaatgttgttagtgccttagatttattcatctattcagtcattcaacaaatattaatgcctactatagtcaagccattgcattgggcattacaattgattttattatttttgaaatgtttaataagtaaattctatagagaagaagctatttaacaatagcatatagtataaataaaataaactatttttaaaagttgtaggactatattagtctgatcaagctgccataacaaaataccacagactgggtagtttaaacaacagaaatgtatcttcttacagttctgaaaactgagagtccaagtccgaggtgttagcagggttgatgtcttgtgaggctcctctttggtttaaagacagtccttcttactgtatcctcacatagcctatcctctgagtgcaagcagagagagagatctcttcttcttataaggccatcaatcctatcagattagggccccacatttatgatctcttttaactttaaaacccatctctaaacatagtcacattgaaggttagggcttcaacacacaaatttggaagaggacacaatttagtgcatatcaaggactaaatcagtcagcaagcatcctttacttctttcagagtttctcctctggagagaattatggaattatagttctcaccagcacctgttgttatatgtaagaaaaaaacaaaatttgggagagaaaatggctttcctgaagatcacagagaaaacgggaacagagacagtagcaaaaaccaagtcttcagtgcactctccttttggtctggccttggctcagagagttactgctccacagcatacaataaagctgcagctggctttagtagatgtttgtaccatgcactccatggactcttcctattaatcctctgctcaaatctccctcctcacacttatcaaaatatcacatcagcgctcctgaccaaaatctctgctttctcttgtgagtactgagtttatcagaaccaccttggggattttcttatccttcatgatacaggcccagtatgatctgaatatagattctgtataatcttctgccatcagggccaacagataaatgactcctctccctatactatctctgtcatttggtggggatcattttttgcattagagaaggttcgtcaaggtcgttgcttcttccggattgtgggccctattgaaggtatgttctcttcactatgaaatgtagttgcattttcttccaccacctcaggctctctgttctcatgacttgagggctaatgtgctacagaagaccttgaaaaatgaccagctgacctggtcaacccatcagtctctctggctcaaccttttccactcaaagaagacaaaccccttctctgagggccaggactttattaccactcacagcaaggtttttgtttgtttgtttgttttgttgttgttgtttttgttgttttttgttttttagacagagtctcactctgtcacccaagctggagtgcaatggtgaggtcttggctcactgcaacctccacctcccaggttcagaagattcttctgcctcagcttcctgagtagctgggactacaggtgcatgccaccacacccagctaatttttgtatttttagtagagatggggtttcactatgttggccaggcttgtctcgaactcctgacctcatgatccacccaccttggcctccaaaggtgctggaattacaggcgtgagccaccgcccctggccttaccacaggtattttaacatcaggcagatgtacaaagatattgtcccagtacaacaaaccaggcagaaaatcccctgctactgggatttctccctctctctcttctttctttccccttgctctttcttcttttttcttgatcacttttttccttagatttgtaaatccttagacttgtactaattaatcactcctgctatttagtaactggcattgtcactgccacgtatggcccaagatgccagaatttagttgattgatcagttggtgggttggttggtttgttgactggatggacttttctgagtatgatgcttggttcatcaatacaagaatcacagaacctctggattgggttcttaaaccctagctgcacattagaagaacttttataaaataccgatgtctgggccctaccttcacagattctgatttaatttggtcttggtctcaaaggctctccatgtgattctcatgagtggccaggattgagaatctctggatagagctaaaagattacgcaggcaaccattgatctgatacttaaatcccttctactgggaaatccagaaagatgactctttctggattttctttctgaaactaagattctaggtagtattgtcttcctaacaatcttcctgggtataaatactctgctctgttactatagaaggaagcagcaggtaatgtttagtggtagaccagaacttcccctaaaaaatccagcagtgcttagctgtggcacttcctgatgttagggaaatatcctcccaggtcagtggttctcaactgggagaaaatttcccccaagtgatgtttggcaatttctggagacatttttggttgttacagcttggtggaatgtcactggaacctggtggaggcaggccatggatgatgctaagcatcccacaatgcacagaacacctccccacaacaaagaattatttcgtgtaaactgtcaatagtgccaagattgagaaaccatttcctagatccttgccctcaggtccccctattatacccctaagagataccatccttaatgaaattagtcctaaagcatttccttctttctgaagcatgatttcagcactgtttcccaaatcaacattttacatcctttttaagtatcttttaatgtgaccatcctgctttgcttttaagaaatgaaggctgctgcctgactgtgtgtgtcagagaggcagaataatcccaaggctgccttttccacttgctgcttcctttcccatctggctgcctccctgaaatacagaatgagctgagccctatgacctgatggaggccctgccaagcccaccttgaccaggtgctgcagccagtggagctagtcttcagggtgcgggtcgctccatgaaacgtggcagctgggcttatcagctgccagcctggataagtcaggcctgctgccaagttgattaataagcgctgggctgacacttcaagaagggcctaaacctgctgattttcctcccctcttccttagatcatttcattattaaattaaagattgttgtgatttaaactgaactgtcaggcagcctagggacaaacgtggggtttggtgaagcagctgaacctggtactgcatttaccaaatcagatctcagctgggtgctctttctttctcttaaaaaaacaatttagaactctaagggcttgaagtagaagtagaaccttcccctgcagtgtcaggagcccacacagggaggctggcatgccaggaaagggacctgattataaatagcatgaaaagcagcatcagtcaaaactcactgatgtgcctgggcaaaatgttaaaagaaacaaatagcttctaaaaaaggaagcaatggttttatttttataatctaaagtgctaaggaacaaaagcagtttatattcacatagttttaaacacacaaacatgtgtgtgcacgtgcacaaataacacacactaacagagtccctttaaggaaatgatggataatcattttaatataacaaaatcacaagtagagcctcacagagggggtagctgtcctttcttttctatgtaattgatgctatttatttagaaggtctatggtttacccttgtgaagtaatttttctgtatgtgtattttttttccagcttagatggaaaccatttgagattccaaaagcatctcagaagaaagtagactttgtgagtgtaagtcagtcccatccacaccctccctactgctctcctctcttctgtggtgagtgagccaaccatttgcagcctgaatgccaagcagaagcagccctatcaggaggcagcagagacaaaaccacctgcgtatgctttgggggctggcggagggatgtcttacttacagaaaccatatggcccctgacaccagagggtattcatgaactatttatatctcagaaaggccaatgacaattgaacattttcttacttaagttcctttcttttggctagaacgggggcttttaacctttttctcactttgatgtctgatgtctgatgatgtctttgtttataaatatataaaataaattatataaaattacaaagaagctaatgatattgaaatataacgataaaaatactattaaaaacaaatttgatttggtttatagtcattcatgtgctttcttgttaatgtgctaaatcataatatctatggaaaacatctaataattctggtatgagcataaatatactttgaggtatctataacaactataatgtgatatccatgatttttatcattgataaagttacaggcacctctaatactgctgtggttttttgcctacattcatattagttgaaagaaatgataaatttcactcagagattagcaaaagtaaatataaaatatttcccatccaagttcataaatctccctgaagtagatgcttgggctagaatggcgtcaattcaacatggcaactctagttagtacaatgctgattggaagctctgtttggtagttataggtcccaggagtactggaataactgcacagagcaaggagtatctgggggagaggagaaaggagctctaaggaagtggggctcaaagagaccagtggagggttctgcagaccagcctcagctcatggcttacgtagggacactccaagtgccgagccataggataaattgttggaaacatcttgaagttctcatctttattaagtgctccaaactctttgtagactcacttaaatataccctaaacttacaaattgagttaaaatacaaaatgatatccccatctcctttcttgtgtgaattgtagatatctggaggcgcagagctctctccttttggctctccatctgcaggtttggggctgagggctattttgagaagacccatgtgttaaggtttcttgcactatggatcatctggtcacacagcagagagaattacagtccatctgaatacagtcctctgccctgttccagagagattaggctgaccctatccataagcagagggctgcccatagtggagtgtacttgagaggcattaactggtccctgatgctgcaaccttcctccccaagcctcctagatgcctgatggtacctccaacagaatctcttcttccagttgatgtcaagcatcaaattgataaaataccaagtaatgaactgatactctgtaagttcttctgatatagccactaagacaacccagatttaggccatggctggagactagggtaaaccacaaactaccaaacatgagtcagtaaattcaggctccttagaggctgcctggattccaaacgtcccaccggtcccaaagggaagaccctagtagaaatgtgcctcatgaccctcagggaccagtggaagggctgcctcttgggcaccgttcacattaacctttccctcttctgtgggtctctcccagggcctgcataccttgtgtggagctggagacataaagtctaacaatgggcttgctatccacattttcctctgcaatacctccatggagaacaggtaagtggctcagttctagggaaggacatgcccatcttctaagggattttggccagaagtcaaactccaggtttcactcttgtgaagtcacatatgcacatacatagttgtttttgttattggttttctcctcaaggcaatattcatatatatttattgacaatgataatgaatgagacaaaaggcatttatcttgactgaacatcagtgatataaacaagcacatcacataacaatgtaaacagaaaagggaggatggagccctggaatgcaggagtagatcgaaaggcattttgactttaagtctgagtccaaatatgcttttgttgttgtttgatatttcaaggatttttctgagccaaatatgagtgaccaatggcctgcgacacagccatcaggagatcctgagaacatgtgcccaaggtgattgggctacagcttggttttatacattttagggaggcataagacatcagtcaacacatataaggtgtacattagatccaaactgtggtttttatctcagtagaaaagtaacagcagatttaaagcaggcagaaaagaaaacagagaaatagagaacttagaaactctgtagttgcaggttgacctttgggctctgaatgatacaattttcccattggtttaaaatgtgcacaacagactgtaatatgtaaccagctggagtactagaaactctggcatacccttgaacttttccattttacacaaacacttgcaagtagaggcacctttctccttgtctttcctcattcttagattatttgtttcccacgttttttttcttaaaaggaggaactgagctgtgacctaggggttttgtgggtggtggattggtgtactgaatgtaggcaggactccacagtgtttcaccaccgagtcgtttccaccctcttacctgtctcagtttctctctccagagatctagcacctctgagaggcctcaaaatgccaagtgatcagctcttatatgtatttccgggacaaaactatttttgggggggttccctgtagcgccactgcacatcacaggggatgaatccctcagacactgcaactcagcccctagtcacccagggtgcctttcagttgggaagaacaaaatgccctttctcttcagagctgaggagctcagtctctcatttatgcacaaaaatgacagtcacacgaatgcgcaggcaagccaactgagctaaatttggggagaaaaaacaatggagtagaccatttagaatacacctccaaactggaaaccaaacagggtacccaaaagggagtcattcttgttgtctttagaaaaagacaacggaggccgggcacagtggatcacgcctgtaatcccagtactttgagaggccgaggtgggcggatcacgaggtcaggagctcgagaccagcctagccaacatagtgaaaccccatctctactaaaaaatacaaaaaattagccgggcgtggtggtgggcgcctgtaatcccagctactcaggaggctgaaaaaggagaattgcttgaacccgggaggcggaggttgcagtgaaccgagatcatgccattgcactccagcccggacaaccgtgtgagactccatctcaaaaaaaaaaaaaaaaaaaaagaaaaagaagaaaaagacaatggagaaatcctttagaatggacctgtgaactagaattaggaacctaaacaagagcttcctaggagggaaaaatcaagaactgtcaaccaaacagggctcaggaggacttaacagttccatcagaggagaagcccaaagttgaaggcgctttcaataggtccctgctgataccttagctctgagttcaggcaactccttcagggttctgagtcttctctgaggcccaatgtgtccaggtgccaaattattgttgacaaaaatagtcaaactattaatatgtaaaatatttgaattgatgtattctgagccaaatatgagtgaccagtgacccatgacccagccctcaggagatcctgagaacatgtgcctttgaatatccttaatttctaaggttccccagggctgttcttgagtcccaggtcacagtgtgtgagtttccattaggaccacccattagtagcaggctacccgactttggcttcagctaacagctctgtgtaagcttaaaattcttaagtagaggagcttatatactggctttgcaaaacaaagtatgcaaatggcattcctgccttattatacactacctctggaactggaccatttgtgtccaaagcccaactctacatttcctggctgagcgaccttgtgagccatgaatcagggacaagatcacagccctatgacaaggctctggaggcctctctttgggtcaaatctcatatcaggccacctcccctctctccacttgagccgcattggccttcattcacttctttcaagctgccgcgtgccctccttctaagcacttgcacttgctgttccttctgcctggaacattctttcctttctccaaaccctcacctagataacaccttcagatatccggtcaaatgtgtcccttctttgaagaagcctttgctgattcttcaaactaaccaagtcgctattctttcattccctcaaacttgattttcacagggtcattacagtctgcaaagatattgttctgtaattatttgattgctctctgactccccactagactctaagttccacaagggcagagcctgggtcattttgctccccattttatacccagctctgagcttgctacataggcactaaacaatgatttgtgttatgacgtaatttgtctagacaatgttaaaactgaaaatcacaagaattactctatatgtttcagatgcttttacaattcagatggggacttcttgattggtgagttctgaagacttcagaccccctcactgttaattgacccctaaccgcaagctgctttctaattttatacacattattttccttcattctccaatctgtcttatttcatttagtgcaatccagagactgaggtctagaggccacaggtggtctggaaaagatttctagtgtacctcaaagcccctactctatttccttgtctctctgtctttgcccatctcttctggacctttctgatgtgggagacctgggcagctgaaaagaaatgaagactaatactaatgggattaacttattacggtaactgtatttgccttgaaactctctcagtaaaagcccatttatcattagtaactgcaatttaaattcaaattttcatgagaccatctaaaatgtaaagtctatcagagattgttctggtctgcctattatacttgatggttttttagtatcaatattttggaatcaacattttcgtgtatatgtcacacaagcaaatgtcagcctttcactggaactatcagaaatgggtgattttccatcctatttctgctacccctttttgaccatgtcacaaaattgtgcatatacaagttccttgcctggtgaccaaaaaagcagagtcattgttttattcacattcttctagataggaaaatagctaatctaagttgtcagaatttatctttttccccaagagactcaataaagctctttgcatttggaatggaaaagcaaatgcagccttaagcctttcctgttcatgaaatggttatcacaccaaaagaattgctcaccactgccctgtctttttttgtcagttccgcagaaagggaaccttctcatttacaccgagtttggcaagatgcttgtacagcccaatgagatctgcgtcattcaggttggtgatgtgtccccttctcttccctgcctctcactaatttgggagcagtcagatgtttcagctgctgctatttccaactctaaaatttctctgtcatgtctgggcaacgaggagggaatctgagttatgcagaaggttccatgtgctgaagagtaagcaagcttgggtgcctgctttcttttaatatagcacataattctaaaggaaagaccacttgtcattgcactttcctaaatatttacatatactctggataaggccctgttcccactaatggcagtagaggcagtgaaggtggactttttttttttttagtgtggctaaatcaggcttaccattatctctggacccaatgagagggtagactagaattggcttgggtcacatgtgtgattaggaattcagtttttctttttaaactgaattttaaaaatttctttttaaaaaaattcagtttttcatgtttgctctggtcacctcccaagcagctcaacaaacaagagctttacttttgcatgtgggatgggctatggctctgggcagcttctttataactacagctgtgatttcagagggcacaccagtgtctgctttccattccagagaggaatgcggttcagcatagatgtctttgaggagaccaggggctacatcttggaggtctatggtgtccactttgagttacctgaccttggaccaattggtaaatcttcattacaagcctctaagcctcgcttgagatgtaggactcagataattgcatgaaagttaaacatccttctcccttcgctgtctcactcaaactttcacttttctctctagacaaattcttctctagaccaagtgtcttcccagaaaatatatgcaaaacagaaagcaacccaaaccaatccattataaatctctctagaatagtatacagacattggagataaagacggcatgtaatagatttctggttgcatagtgtgtacaggaaagaatatagaagtttgggttactgtgggcttgggtcaccagaaacagctccacagaagagatgagaatttgactaattctttatgaaaagttgaggagagtaaagaggaaagggaacagctttgcaaaagcatataagtgagaataagctttgtgattaggaggaagatatttttgttaagtcagtgagatttataatggattggtttggattgctttttgttttgcatattgtataaaatgggaaggccataaaaatgccctgggctgtattcctatggaaaggagggatggactgggtgacacatagtctatgaacctctgtgtacaccccaccaaatccacacacttagcagtcaaaaaaacacatcactcagtgctatgagagatctagaaaccacaccccaggaggcagattaaaacattccaaagtgaaccaaggtctccacagcccccattcttctggcaagctggaggaagtgaaaatgttaggaggggttgttctcaaactgtctcttggattgaaagaaatggctgggaaaattggcccttggtttactctttggtcacatctcccaattcttcccttccttgtcaacagctttttagagcaaacagggacaggccagtgtgtgccttctggtcagctcctctgaggaatccaaatatgcagaggaaggtgggaggcagcaagaggcagctggagccgtggtgggccgtctgtcatcctgttcacctcccactcttcccactctgctctggcttcctgctgctctatagtcagcatagcctccaggttccgtggaacatgtaccctctggaaaatatctataatttgctaaccagccggggacttatttttttaagtccaggagctggaaatgataaaacactcctcagctcgctcctctcagagttaaactgtttttgcacttaagtttttcatgtttggtcttttgatttatttcctttctctggaggaaacactcactcctaagcaaaggtaagcaggcaggtcctaaatacttcttcctgagtggcagacagggtttttcaggctggagaaccgttttcagactggaatctgagttctgtctagggagcagaggcatgccttaggcaacagcgtgtaaccctttctatctgagatcaaggactgtcaatgacttctagaatattcaagggttccttcaaaagaaaaagttctggagttctatcagatcttcccttttcctcttttcagttctctttctctcttcccttcccctcacctgtagtgataagataatgcatataagattgttttgttaaccatagtcactccacaaccttagaaagtaatgctggtttttgtgaatttttttctgaccagattccttgggtcttcctaaaaggtaccagactggaaatgcagtgaatctttgagcaatgaaagcaatttgtggagtagctcttgacatgaaagaaagcctttctcttcatgcaaccatgggcatctttcctatgttttggaagtttctaaaagacttttgggttactgttttctaggggccaatggcttggccaatcctcgtgatttcttgatacccattgcctggtatgaggatcgccaagtaccaggtggttacacggtcattaataaataccagggcaagctgtttgctgccaaacaggtaaagtaaaagggttggcaggcaagggaggaaatgaagagtgattgagcacttactgattgccaaggcgagtgttacaaactttacatatatcctttcgttgttatcataccactacggcactacaaataaagcaaatagttctagtagtcaattatactttcatagtcatggaaaaggccagtaatgataaataatttacaaatttcacagtaagtggcagaaccagaatttgaacccatatctgtctgactccaaaggttgtgccctttctactcaccaagcaatgaaaatattagcaatatgtaggtttctataagtggtatggaaaacataatatatgggcagcataatatgttctgaaaagtaaatgagttaacagatcagccaagatttatagtctccaataccaccctatttcaaatacaagcaattctacaaaacaagtagaattcagttaattagcttggcttggtttgtaccaccaggctggcaattcaggacacaagcaaaggcacagatattaataaataataataacaacaatgtaatatggactctataacataatatattactaaatgtactgaatatatattagaataaaataatcatataataagaagaacccaaagatctcttctgtttagcattatttgtttgcttcattttgtctatttgacttattccttatattttccaaggtatgttattcttcttaggcagcatctagagataatgccaaccagccgaggccaaccagtttggcacttaaaattaacccctgaagcagacatattgttattctcttattctctgggtcaaggtctctcaaaattcgggggctatttgcatcagaaatcctcaaggaggcttgtttaaaattcagatcctaggctgggcatggtggctcatgcctgtaatcccagcagtttgggaggccaaggcaggcggatcacctgaggtcaggaattcaacaccagcctggccaacatggcaaaaccccgtctctacccaaaatacaaaaattagccagatgtggtggtgcacacctgtaatcctagctacttgggaggctgaggcaggagaatcgcttgaacccaggaggtggaggttgcagcgagccaagatcatgccattgcactccagcccgggcgacagagcaagactccctctcaaaaaaaatgcagatccttagatactactctagccttgcaaaaaatgataagctttggagatgggacatggaaacctacattcattttaagcatgttccccagatcattgtttacatacaattgttaaagaaccacaattgtagaagcagccagtagctcctccgaaaggtttgcactttccaagtggaccctgtgctggttattttctgtgtgagtccccactgatccattctccctctttgccatgatctgtgccctggaaggttgactgtatcacccgggctccctagccagctggtttctgttgggttcaacccacaggaaactacaaggcaggaggaaagacaaattgggatatttcttcccctgcttcctcgctgtttaggactgtgtttctgacagtagctgcatcccccatatgacctcagttcctgttgggtagccctagtggtgggctggagctgattcatagtgacttgcaaaagctgatatgcacgcttctgtccaactgtgtatttgttgatgtcatactggtagctagaaaatcatcatggtgagactgtatacaccttagaaatcagtaaacactatatgtcaatgctttatgtatttttttcagagtgctagttgtgaaatatttaccagcacaccactgggtaacacccttctttataattctagctcttgctaaagtcctataacaatatttccctcctcattccacatgcccaggaatagcagtgtcttcccgctattgctaggctcagatacctcaacatttctagtcattccagttaaccctaaccacgcctctatgagtagcgccttcattaaaatctttagcactttcggacccatagatacagaagggaccaccttcctatagcaggacactgatcctcttctaccccaggacaggaccaggaagtattatgttaggattgctctgaaatctcaagtccttggagttggaacttttagaggccttctcccctctcctggactcaccaacccaggcactgtgtctattgcaagctcctctaggctgaaattacctggagaagcatcacagcaggtactctctgttccaggaaacagaaggtagcccagattgtttgagaactgctgacatccacagatcctcacagttaggttaaaaattgttgaaaaggcactacttggagaatgtgctgtgtttctgctgcatgtgtgatcagaaggcagctgcagcttatgaaccagaaaaatagggttagtggctaagtagagggtgtgtggagcaaccacaaaatgattcagggttatacttctcccaaaggacggtaaaattaaatcgagaacaaaatcaaatcaaaagaagagagaggtatactcagtacatattgtgggatcacagctacaaaagcattagatggtaaaattatcctttcctgctttttgtgtttaggatgtctccccgttcaatgttgtggcctggcacgggaattatacaccctacaagtacaacctgaagaatttcatggttatcaactcagtggcctttgaccatgcagtaagtctgaaccctgtaggggccttgggatgaggcaacgcttgggtgggaggggtccacagtagacccctgacatttacagatctaacatttccaatgtcaccgttggaagccctagatatagtcatttgtcctttggtgagggagtaaataacacaactagtagggaagcaaagccagatactcaacattcccctgtgaacatagcttcattctctacagagcattggtgatactctgacttgtatttgccaaactaagtggataaacacttagtttctttgtggaaaatttatcccccaaaacaaccaagtgttaatgtcggtggtagaatgaggagaaaggaactttatgaatttggagaagtccctgaccccacaactctcaagagcctcctctatgatctctgacttctcaccccagtgccttcattcctggctgtatttggcagtgacagagtgaacagcccacttctaaagttactcataactttcagtgcttgagtttaaaccaaagaaattctagagcatgaacttggtcatatttttcactcagttcgcaggccacaaatggtctctggtctacagtgcaggctcccaagaccctacattcttaataaagtggtggttctgagaccccggggggaagttcattttgcagctcacttcataagagatgaacctaacccacaagctggaaggataattagagcagaagtcagagactcagaggcaaaaggattattgtgagccagttcagtttatctctggggggacaaacctacctctccaaacagcagcaactcttaataaaagcaaaggggaaaagaaaagtgagacatcagaccccaaacaaacagcacgaaaaaggatcctgagacactgataaagctttatttgtgattcactacctttgctttaatagtttcagatcatgtcccatgacagttgaagaaatgtcaattctcacagcaataagggttgggtttatttttatttgaatttacacagatgcgatcttctctgtattgctgcaatagttatttttccaaaattcagttctgatcatgccaccactgtcttcattagaaagcctttgcaggcttcccatggcttaggattaagtctgcactctgaagcatggtgtttgatgctcttcaccatctgtccctggactcattttccagtatcacctcttgcccctctcccttctgtcaatgcactggggttttagccttctctcctcttaacaaaatctctgtgcactttgatgtgttttcagtgattaaaatgtcatttcccttccttcccacttccttagtcctccctccctccctccctccctttttcccccatccccgccacgtccttcctttctttttttttttttaacttttattttaggttcaagggtacatatgctccttccttccttccttctttccttccttccttcctttctctctctctttttctttctttctgttcattcttgaagacctacctcaaatgtcacctcctctttgaagccttccttgaccctttcaggtagaattagctgcccaacccccaccccacaattaatgctaaagaagcagggaatcgatccccatgatctttgaatctccagactcttacatggcatctgaaagggaacatgattgttgatttcaattaaattgaatctcaaccttctcactaaagaattctgaagagttttaaaaagtataatttcgtccctcaacctatcctatctctacactaccactatgaagactacggatgtaaatgctgtgttttagacctgaaagtcaaacaaaggtaggaaagcaatgaaccacttctcagacttttctgccaatggatacaatctggaatctccgtattctcccaaagaggagcacatctacaccaaaacttggattttgctttatttctatttctactttgctctgagcatcccttctgctgcacatctcagctctagtcaacttgatctgaggttgagaagcaggcaccgttggttctcagacccacggggtaataagttgcatgtaatgtgggctcagcagggtgaaaaagcagttcagaatccttttagctggtgttaattcattttgcctcaagcacagcaagaggaaaaagtcatatgagtgattattgcaccttgatgacaagcccagacttctgttgtttgatcagaaattaggctgtccgtttgcagcaacatggatgcagctggaagccataatcctaagcaaattaatgcaggaatagaaaaccaacttctgcatcttttcacttataagtgggagctaaacattgagcacccatggacataaacatgagaaaaatagacactggagactactagaagggggagggtgaaaaaactacctattggatactatgctcgctacctgggtgatgggatcctgtattagtccattttcatactgctgtgaagaaatacccgagactgggtactttataaagaaaaaggggtttaacatatccacagttccacatggctggggaggcctcacaatcatggtggaaggcgaaggaggagcaaaagcatgtcttacatggaggcaatcaagagagcatgtgttggggaactgccctttataaaaccatcagatcttgtgagacttattcactatcatgagaacagcatgggaaaaacctgcccccatgattcagttacctcccaccgggtccttctcacaacatgtggggattatggaagctacaattcaggatgagatttgggtggggacacaaccaaaccatatcagatccctaccccaaacctcagtatcacacaatatacccatgtaacaaaactgcatatgtatccctctatctaaattaaaagttgaataaaaataaataaaaaaattagaatgtcacttgcaaacaccttcatgtatgcatgaaatgtgtgtcattgtccagtcacttcccttgcatcatgcgttcagtctctccttgtgtgttcacaggacccatccattttcacagtattgactgctaagtctgtccgccctggagtggccattgctgattttgtcatcttcccacctcgatggggggttgctgataagaccttcaggcctccttattaccatagtaagtctctcttttaccaagccacatttgcaagccaaagagacaacaaagcagtgagcgctacacattgggaataatgcctgggttatttctggacacccaccatggcatgaattcaggatcctgctgcacaaggcctagtgctgatccccaagctttaatctctttaagggatggtagttgtgttagtccattcttcgttgctataaaggaatacctgaggctacttaatttataatgaaaagaggttcatttggctcgtggttatgcaggctgtacaagcagcatggtgctggcatctgtttctaatgaggcctcaggaaatacaatcatggtggcaggcaagagggaagctggcatatcacatgatgagagcaagcaagagaaaggaggaagtcccagcttcttttgaacagccaaaccccatgtgaactcatagagtgagaactcactcataaccgtcatgatggcaccaagccatttatgagggatctgcctccattacccaaacacctcaaaccaggccccacctccaacactggggatcacatttcaacatgagagttggagggaacatacatccaaactacatcaacagtgatgcattgattctgagcctagttcccagtttctctgtccctgtaagaggcagaaaggctggtaaagtttagaagccttgttagaaagtcttctaaacaagtttcctcacattttagatgtttccttttggggaatactggggaggttgttagttagtctgttgttttgggaaagttcatcacctaagtctggttcagagaaccagagaaataagaagagagagacagagagagacagagagagagacagagagacagaaatgtgccttctccaattattttggcagggcaaagcagactgcagcctgcattaaggaatgaactctattctggaaagagtttctgcagaacatttgttgcctagtacaagacctaacaaatctactatttttattttattaatattattattcttagcacctaataattattgtccaatttctatggctctgttacaagttttttaaaaaactaactcatgaagtgtttataatacttgtaagagacaggtagtattattgtcccccccgcttttttttttttttttttcagaaaattaaactgacacaagagggattaagtaactctctcaaggactcacagcaagttaagtgtagagtcaggatttaattgcaggctgtctgataccagagcaaacactcatgaccactaactggtatggctagcatagtgcctgatatatagcatgcttttaataaatatttatttaataagtgaatgcatcaacaagaataaataaagtacttcacggctgtacttaatgaggttgacatttttaattgtgcaatagctagctgaaaatccaatcaaaggtcaatgtgcaattctacttcctggagtgtgcatttttttgtgcatagagttctggaaagactctaagaggcattccacctggaacattctagaaaacaaattcctttctttagtaaactccagggccttctgtttataataggtccctctctatatataccagttcccaggtgtcagggctcaacagaacacaacagtgcactgaatggccaatttagctattttatagcatcaggaatgaaggcccttaggatggacgtaggccactccatggtcaaatgccagcatcccccttttcagatggcaccatcatggtagagaaaagaaaacaatcagttaccatggcaaagacagcagctattttgtgaatagcatcataagtcgtttctaaaaactgtgaagcctactaaagactctaacttttctcctcctggaagttagtgacctagaggacctgttgtcaaggagagaaaattgccctggcttatagtctgtacttcgcatgttactccttaataattcaccatttcactcttgttcttgtattgaggttactctgtgtgcctgtagtggttcttacattttaccatgtgtcacagtcagctggaaggtttattaaaacacagattactgggctccatcctcagaatttctgcttcagtaggtctgggataggacctaagaatttgcatttttaacaagttcccacaagtgatgctgaatctgccttttttttttttttgagacagggtctcactctgtcacccaggctggagtgcaggtggcacaatctcagctcactgcaacctccaccccccaggctcaagtgatcctccccgctcagtctcctgagtagcttggaccacaggtgtgcaccaccacacctggcttttttttttttttttgtattgttagtacagacggggtcttgccatgttgcccaggctggtcttgaactcctaaactcaagcaatccacctgccttgacttcccaaagtgctgggattacaggcatgagccaccatggctggccagaatctacatttttcactggcaagtcaggggattctgatgaaggaggtttacagactgcttgttgagaaatactggcctagggtgtgtccccatccctaggtggaggaataatagagtcatctgatttagacaagtttgctactgtgctatagggtctcaacccattccttaatttttatttgtagttcagacttgctgacacaaataatcttgagagatgcctcctatagttttttaatgactctcaaagtaaatttggccccagggtagatcttataaaggtatgggtaccctgagttcgttgggaaaaaaccacagaaccccaggttagaaatgagttttccagagatattaaaaatattgccttggcaatactcaaaatctttgctgctttgatgtgactttattataagagaaaatggagaattatttctatagaaatattgcctccagtcatcttaatgtgccttagtcaactagattcagcttttttttttttttttttttttgagacggaatctcactctgtctcccaggctggagtgcagtggcgccatcttggctcactgcaagctctgcctcccgggttcatgctgttctcctgcctcagcctcctgagtagctgggactacaggcgcccgctaccacgcccggctaattttttgtatttttagtagagacgaggtttcaccatgttggccaggatggtctcgatctcttgacctcgtgatccacccgcctcggcctcccaaagtgctgggattacaggcgtgagccactgagcccggcctagattcagctttaatcagaaaggcaaggtctatcctcccactgtcctttgaaatatagaaaatgatatagaaatgtcatcaccaagctcactgctatctaaattcatattcagatcaaagctgaattctgttttgctctcttcttaaaattaagccatgaaggtgaccctgaggacacatactagagcaaggagcttgacaccaaatttaagtcatgagctgaactgtttttaaaacatagacaatttatgcttacatttgcttctttttctgtatttccacttcatagagaaacaagtagaactatgatctgggtctcacctcttcagcaggagctcacacactctcactcactttgtaggggcctgcagtagctttctgtttctgagcagggtgggtgtggctgcttagtcaattataaaagcatttggcacttggttatacttcacatgtaagcaagaagggcaggcatgtatcatgtccagtgtttgattttgtaagggttgccactgccacatctctctattctgtccttggtttgccctctcagtactctcacaggacagactatgagtagctttaaaggctatgttgttgttgttgttgttaattatttcttttttaagtagctttaaaagctatttcttattcatctctgtctcatgttagccagcacatatctaattatatgtgctggctaactggatgggcagatgggtgaagtgggaaaaagacagatgaatgaatgggtaagtagatgtgtggtttgagatgcaaaggcacttaaatttgcccaggtgttatatttctttaattcctgctctattgtattgctactctaataaagagctttatttcaatagaagcataagattggaagagtggaagcatggtgatttttgttaaattttgtgtgactctagaaagcacaactaggaccaatgaatttaactcatataaaagcaaatttccatttaatataagaactttcttacacacagagctcttcaataatatgatatgctttgtagagtggagagcttccattcacatccaggcagagcccgggaggtaatcagtcaggaaagatatagaaatttcttctacattgagtagaagtaaggataccttccaatttcaagatttaggactctatgaatagggtatcaatggaactagaaaaaataaaaacaaatccaaaagacattctgaagaacagaaaaacaagaggataacagattcatctatagaagataatatttgttataataaatagcatttatggtctgttttatacacataccaagattctttcacacagattatcatttgataatggactttaagtctggggttcttttcattacattatcatctatcatccatcaaaaccacacaccctcaatctaagccttctagattgggaattagaaatatgctgttgctgtgtcctacagtggagctacttgggaaagggttatgatctgggagataagataactttgatacagggctcgtaagcttagatgatagagtacattcgctctctattatgactagcattttaattattattatcttctctgggccctgattttctttagatctagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaaccttcccagggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggtaagtatgttaactgccacattccagcggcctctgaactccccacccttactgagaggggtggccgtttttcatttctccaaagtcacagaggaagagtcaaaagagggagagttaatgactgcataagtatgtttacatgtatatatactcacatccttgtgtatatactagacttctgttgtggtggtgtagaaagatcattggacttggagtcagacctgggttctgagtttaagtcccatctcttagttcctacaggatcttgaacaactcacttagcttctctgtgcttcattttccccatctataaaatgggtatagtatccaacccagcagatgactatgagttaacctaacagactgtccaacactattcaaatgtaagggaacattattaatactatgtgaagcctcttcctgtatccttatgcagccctgggcatatgctatgtctcagagtcttctgcgttttgaagtaatcctccagggccacagtagtagcggaggcaggatctcaccttcagcacgtgtttcaagccaaggagggtcaaaaagcccttgcctcactatagtcagggcttgtgagaagcaattctcagctgttttttgcattttcctttgctctgctttggcatggatgcaactgatgggatttaaaacctgttttgtattcttcctgtgtcaggctgtaaacattgaggctgaacacaattgcagctggctgcggtgcttgattttattttatttttgcattcttcgaggtagagtttatggtccacagggagtaattttatgctaaatcacatgcaaatttgctttacttttgaaaataaatgccttcaatgctacctggtttaaaatctatagcagagacctgcctgcttcatgcttgcaaactacctaaacagtgagcattatctgtccgtctgtccactgcagtttgctttcagtcccaaccctggagccagagttggtggagctcctttgcaaaaggagggtgttcagagtcccatttgcttgctttggctctatttcccctttcaagggcctctatggagtttctgtagaacccctacatctcaaagagatgcagtctggcagtctcagttaagctattacctctgaagtctcctggaggtgcagtcctggaggctattctagagttgccactcaataacctttggtcccccaatttggctttgggtagtcaatgttatgagggagctgtgttttacaacagtgaggcgtaggacagggctgtttctatgaggagcaatactttgaattactagtgagaaagagctctcctattaggatgggagaccctgggtatcaaggagccagaatacctgatggcggagggtccaacatcttacctagacctaactttcagtcgtcctcaccatttcccattatataattcagacccaggtctatctacatgccttatccttattcttgtttggagtgattaacttggtacaatagcatcttcaaagtcagctgggatggggcttttgttaatccagccaaatggagaggcttttaagaagcagtcagcaaagagacaatagcaatggccataatgatccttgtatgtgaatagtgctttttaaaaatctttattacttattatttattatttttatggatacataataagtatgtatatttatggggtacatgagatatgatgatacaggcatatgatacgtaataatcacatcaagataaatggggtatccattacctcaagcatttatcctttgtgttacaaacaatccaattatattctttcagttattttaaaatgtgcaattaaatttttattgactatggtcaccctgttatgctatcaaatgctaggtcttattcattttttttcttttatttctttatttatttttaacttttatttgaggttcaggggtacatgtgaagatttgttatataggtaaactgatgtcacaggggtttattgtacagattatttcatcactcgggtactaaacagtacccaatagttattttttctgattctctccctcctcccaccctctattctcaagtaggcatcagtgtctgttgctcccctctttgtgtccacaagttctcatcatttagctcccatttagaagtgagaacatacaatatttggttttctgttcctcttagtttgccaaggataatggcctccagctccgtcgtgttcctgagaaacacatgatcttgttcttttttatggctgcatagtattccattatctgtgtgtgtgtgtgtgtgtgtgtgtgtgtgtatgtgtgtgtgtatgtgtatatatatatatatatatatatatatatatatatatataaagctcttaagtttaattagatccatttgtcaatttttcttttgttgccaattgcttttgatgtttttgtcatgaaatctttgcccatgccgatgtcctgaatggtattgcctaggtcatcttccagagtttttatagttttgggcttaacatttaagtccttaatccatcatgagttggtttttctatatggtgtatggaagcggtccagtttaaatcttctgcttatgactagccagttgtcccagcatgatttattgaatagatagtcctttccccattgcttgtttttgtcagcttcattgaaaatcggatggttataggtgtgcggccttgtttctgggctctctattctgttccattggtctatgtgcctgtttctgtatcattaccacactgttttggttactgtagccttgtagtatactttgaagttgggtagcatgatgcctcctgctttgttctttttgcttaggatagccttgggtatttgggctcttttttggttccatatgaattttaaaatagtctttcctagttctgtgaagaatgtcgttggtattttgatatgaacagcgttgaatctttacattgctttggatagtatcgtcatcttaatgatgttgattcttcctacccatgagcatggaaagtttttccatttgtttgtgtcttctctgatttctttgagcagtgttttgtaattctcattatagagacctttcacctctctggttaggggtattcctaggtattttattctttttgtggcagttgtgaatgggattgcattcctgatttggctttcagcttgactgttgttggtgtataggaatgctagtgatttttgtacattgattttgtatcatgaactttgctgaaagttgtttattggttgaaggagcttttgggctgagactatggtgttttctagatatagaatcaggtcatctgcaaacagggataggttgacttcttctcttctggatgcactttatttctttctattgcctgattactctttgccacgacttctaagactatgttgaataggagtggtgagagagagcatccttgtcttatgctggttttcaaagggaatgcttccagcttttccccattcagtatgatgttggctgtgggtttgtcataggtggctcttattattctgtgatgtgttccttcaatgcctagtttattgagagtttttaacttgaagatatactgaattttattgaaagccttttctgcatcttgaatagcactgtataacttgcatagcacttccatatgatctcatccagtcttcccatcaagcctgtcacaggaaatcaggcagcgatactcatatccattgttttagacaaaaataatttaatgtatattagagcccaaacattaatgtgggtgctttgggttgtagcacaagataattctattattttccttttgcctgtctgtattatacaaatttccaaatgtgagcatataagaattgtagggtttggtttttgggttttgttttgtttttaaagccacagtggataagaaaagtcagcaattgatgaagctgtaatgtctaagatgcacagagtatttacatattctttctgttgtggacaaaaacctcctgacagtgcaacatccaccattcagacacttctgagatatgacttttaaaagtgctacagccattcctgccatttccttcacctccctctcctccccactccctttttcccttttcccagcccatctcttggtcagagtcctgaaaagacaggctcaaatcccagttctgcgatgacttgtcgccttaagcaagtcgtttcccagctctcagccttaattcctcctctgcaaaatgggaagtatgactttcctcacaaggacatagccacagtaagtgaaggccctcagaagatggatattcccaggattctcccatgtctgcccttggatctagcagacttagttccgtaataccatgaagataatttgaagcttaagggctgaattttattttacagaatgaaacttgaggccctgagaagttaagggtcttgtaccaggtctcaccagcttacaaatggtaggaccagagccacaactcagggcttgagcctgctctcctcaccactctagcacacaaatctttgatttgttattggaagatttcacctacccataccttctgttgacatctaatcaaatgtgtttattatctatctcacctcttttttctcatccccatcgtcacttcctccaggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtgga

SEQ ID NO: 36725 - DNA, 322051 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggtacccgcgcccgcgccgcccgtcggggtggccgccgcgcccggcaggagggagggagggagggagggagaagggagagcctagggagctgcgggagccgcgggacgcgcgacccgagggtgcgcgcagggagcccggggcgcgcggcccagcccgggggttctgcgtgcagcccgcgctgcgttcagagtcaagttctctcgccgggcagctgaaaaaaacgtactctccacccacttaccgtccgtgcgagaggcagacccgaaagcccgggcttcctaacaaaacacacgttggaaaaccagacaaagcagcagttatttgtgggggaaaacacctccaggcaaataaacacggggcgctttgagtcacttgggaaggtctcgctcttggcatttaaagttgggggtgtttggagttagcagagctcagcagagttttatttatccttttaatgtttttgtttaatgtgctccccaaatttcctttcatctagactatttgattggaaatatgtcagctatgatgatgactttctgggaagcgattcctgtcacccgctttcccctcctccccaccccacgtcctggggctttagagagcgattgggagttgaatgggtctgatttcggagttagctggctgagtccgcgctggagcggattgctggcatgtgacttctgacagccggaaatttgtaggtgtcccgcgagtttaaaacaagccatatggaagcacaagtgcttaaaaataatctcctgccagcccagtgacaagcctgtcccacccggggagaatgccccggagtggcgtgcgggtcagccagggtctgcgcctcgcagccactgtggaaggagcgcggccggtccaggacacaggagaccactttgtgacttcaatggcgaaggttgtgtgtcctcattttaatttttttccctacaagaattgttctttctccctctcctctccctcccattttctcttgcccagtttctccttttgttttttgttttttgttttcctgatgggcctgcagagggattaggtgggcgcttctggtgaacaccttcctaggtggccacaggacaggtgtaccccggactgggtttggaagcttcagggcgccacatggctgggtcctgaattaggcatttcccaactgtacactggtatccggactggtgtccctatatctttctgccttgtaagccgtggaccagtttttgttcagtattctgtttccagggatatttatagcagaaggaaggggactaaagtgcagtttggccccagaggatactgaagggcagattctgggggtattcagtgtgcatcttcagccgccttggagaaatttagagcatcccacagccacgcagatccaagctgtctttactcaaaagacaaacaatgaacaaaacttttaaaggttggcatatttcaaattaattttacttgttttaatttagggttaaaacagagaaaaaggatttcttctgcccacctttttttttttaaatggaagaacaaagtacagcgattaagtctaattccacacaacatttaaaactgcttgatgtgaaggaaggcactggtatgatgtgaattccataaccttatgatggactccagaaaccattttcttccctatttaattttcagttcttttattgcaaattaatgctgctgaatttcaatgggcactaatgagactgctccttggtagattatttactgccttgctaataattacaaagtgaacctggtcaaatacagaggggatcgcatcttattcaaaattgttcatcatcccagtgataagtggtatcagtgtaatatgccctatcttacactttctgcattacatgatattcaaacactcttagaataataaaaaaagagacaaggaacttaaaaattaaaaaaaaaacttgcacaaatgggactctgtgtggaaattcagttttagaatgatttttcctgtgttttatttcccggattatctttcctcttttgttagaattctgcctgttattatccagcaaggaaaagaagcatctatgcaagttcttcatatggacagatattatttagtatttttcccctctcagtttttctgcttaaatgactctgggtataaaggaaaggattgattgggctcttttaggaaactttaagtttcttaagtagttctcaaaagttttggggctgaaagcagtgttttcaaactgcttgtcatgacccagagggtcatgaactcagtttagtgagtctagaatattttttaaaaggactaaaatggaaaggaatataatagaaaatatcagagtgcatggtatttcgtaaggataagttttgtttcctgaaaatctgttttaattatatgtgcttctgtgtgctgattgtgatgtaaaatgtatttcttactgtggattgaattcaaagaaaaaattagaaagctaatggcctaaaatattatatgttcagtagaaaacaaaaaattcaggcaagtggctggttgtttttacctatacaaatcaaaaggctattttgattgtcttcattttccccttataaattaggttggtgtctttagtcatttaggctaagttttactatctgattcttaacttttctattgtagaatggtgctgtcatgtggactgtcctcccgagtgtcccactggatgttcagagaatttatgtgaaggtcacgtcatttagcattgagatgctgtggttaccttcttccatttcttccataatatgcagccacatctatgtgtgaagaaatgtaatagataaaatttctctggacgcataataatgtgagaaagattgtcacatgtcccagcaaattgttattaatataaatttgttacttggcaagctgagattttgcaagatgttactcaaaatttcacaatgaaggaaacagggagtcatcttatcctgggttccttttttagatttcaaacaacttaggaactttgaataaaactaaagatgaagcttaactatatcaactatcctttttaaagttctaattaggaatttaatgctgcatgcttatttcagttttattactcagtattcttaaaagttagacgtctctcacttctccaaaaaacttggcaaatgtataaatcttttgcatcaaaatcaatgccctgctaatttgtatcctggccatctgcatattttggacaactaatttttccactggtgatcatttgaaactctttctcaactttgaatagagactgatttccaaagtgagatttaagtgactaagtttcaagtttccgatacatttttccttttacttagataacatttcagcccccttcctttctgatcttacttttttattaatttaaattgttactgattacgtgacactttgtgctggtctaagaatagtccagagtcacatattccctggtgaatgagcatattttcggatgaaaacggaatcacatcttcaatccccatttcattttcacctcctccatgtggcttgtacctgtttggaagaaagctcctgaaggataattgccacttattctaatctttctcacactcatttaatttggatccctggctaaagttgttatttacttttgtgattatacttagtctatgacattcataatttgggaaaattctcaggtttgagaattttggcggcttgggatttcttttagtttcttatagttttaaggatatgtaagacaggtgtaagaaactgccaaggggaggaaccatagatatcaggaaaaactagaaaagatgccagacttaccattaatgaatgatgagacaatagtaactttgttaagtgagattgtatatgtgaaagtggtatagaaactaaacaaacattaggtgtttttattattttactcacatgttaatatttgttttggtgctttcataggctaaaaagctgggaaataacagatttaagtggtcaggaattttgttataaatatagaatgatgattatatgaaatcttttcctgtgaaagtcaaatttaagtaaaatctttatcaccatctgcaacatttgtctgcagcctggcttaccaggttatcataaagaacatttattttacagatacattaaagaaagtcaaaaccctgattatgtgtaaacaattttacataaggaaatatatgaattttaattatatttttctaaaatccgtactcagcatgaaattaatacatcttaacccctccctgtgacttcattattatttttaatgtaactttagaagaacccagtagagagagcagcgtgctaagtgtgtttctttcttttccagacaactttgaatggagaggagcaaattagtcttttggtttaattctgtctcagtttgcttatctaaagaaaggaaaacagagtggctacacttgtttagaaccatatgcatactccagagaaagatgctctattaatccaaaaaatacagccacttgaaaccagccaaagcgaaagtgtaagggacttcatggaaaggaggcagttcaccaaagttattgaggggttttatattttaaactccgccagtgaattgacgtgtaatgtcacttacaaaaaaaaaaaaagtatgtctgagctgttcgctacttcgtctctaaaatatactcatactgatctctgaaatcccagaatttaagtgggctggaggttacgggaagcacctttataatatccttaatctcatgagggaagaaaccataattgctgaattctctgccttggataatatcaggagggactctgaagaaagttttgcagtaatcaacaatgttttaaattatgtgtatatttttagatcacctcaaaaaatataggaagcacagaatgacaactattctggtctcaactgacacaattttatgtagtttaataaagtaataatttcaagaaacgtgggcaaataagaaagagtatgactttcttacaacccgcttgtaagtgatgtggtggtggtaatgatccatgattttgatgatgacgatgatgatgaaaatgaagtttttgtctcagtttgggtaggtggtatttctggatgcctcctatggaccctggagatgttcatcctatacagaaatccaatcctttaaatctacttggctcattgttttagaattctaattccatagtctgaaaattttaataatgatattaccaataatattagaaacttattaagtacctataattgctatacaaaaaatttaaaagaacccaaaattccaagcaagactgaaaattttttgtctctcctctgaactatttagagggacaaattagtttgttcttataatatctactttaaataaatgtgccatctttaataagatagtagacttctttgtttggtaatgttctattttttggagatcctatgagttacacttgggaaaattataaaagttcacttaaagttaataaaatccattaagtaatgttcagaactagacatttccaaatgagcccttgaaaagctcaggtgggttctttttgagagttccccaaatgttgtcaaccccaggaggaatggaagacctctgcagttttgttattcagattctcatctccttctcagaagccgtagaactggccgggccctaaggtccacgctccttggttccagttctgtcttccatccttcggtcccgggctcattctgcctgttcctaaacggtggcaagttaggggccccagcagccaacttgtgcttacctggcactacttcctgggcagttttcttggctccttgacttgttgggcggcttgggatttcttttatggccctgaaagcaaaagacaatgttctcttttagtttcctgcaattaaatgatgttagaaatagtcatcttcacattggcgtacttcctctttcttctgtaggtcttttagaattttgagtccattctcatattttcttgtttcatttgctttattttctaatacatagaagtttaaactccctttaaagagtttttggcctcttttaccctattaagctttcttttttcttttctgttttagttgttccatctgtgtattctcagatatttttctttcaccttttctggtttatttctttattgacctgtctcatctgttattttaatgaaatttggaacagggctaaacagagttcctacctcagccagtataagaatataccgtaataactcagagtggtattaactagattaaaagtttcaaaaagtgatgtttttcttgtctctgaggatagaaacttcaacaaaataaagaagaaattttcaattagtagaatttctttgaaagtttgttcattcattcatttggctaccttattccaaattgagtcattcattgagggcttagactatataaagtgtggttttgttttcccagcagttcatgcaacagcattgcacctagcagctgggaagtcttatagcatgaataggtgagattctaataccagaatctcctgcatgtgtaaactaacagtgtagtcttgactgttgtctcccagtaaacttggtttcaggagttttagatccatgtgaacgtgtacaaggcatttttgctaactgtaacttcccacttaatcaacaaaaacaaaaacactcatttctgaacattcagtgcattcatgattaatcttaattacaccacaaaggtatttttcaatggtgattttgcgggagtggggtaacagtttcgaaagcaacattgtcagaaacatagttgattttaaaggttctttctggtgactttgacttctgcttttttagaagaccttacacagagttgtatttatttctcctggaatatttcaagcaattcagagtgaaagggtatacattccaatttgcgtatgagataaaatttagttacattgagaagctattttctttagttacagggaaaaaattgtagggcttttggaagcctctttgatttctaataggaggaatccctgagcactggtccaaacagaaatcatctcttcttcattgctgtatttccctcaagctcttagcaaagtgcatggcacgtgaaagcccggagaagctgttggttgaaagaatggatggtggtgggcaggaagcatcagggacatggtttgcttcagtctattggctgggagaaaggccatttaggaagggatccttagatgccactggaagaatgtgggaagtttgtgaatctctctttctcaggaacaaaagtagaaaaaggactccacacagcattccaagtacagtcggccctcattattcatggattctgtatttgcaaattcgctgacttactgacgtttatttgtaaccttcgagtcaacactcacggtgctttctcagtcctttgcagacgtgtggaatggcaaaaaaatttgagttatatgacgtatatgttcccagctgaggctgagcaaggctcacttctccttgcagccctcagactataaacaagtgtccctcttgctatctacttcgtgttatgatttttgcattttcataatccctgttgatgattttgctgtttaaaatggcccctaagcatggtcctgaagtactgtctagggattctaagacaaggctctgacgtgtcttaagagaaaatacgtgtttgataagctttattcaggcatgagttacaatgctgttggccatgagttcaatgatggtgaatcaacaggatatattaaatacagtgtttttgaacagaaaaacatataaaacaaggttatgtattaatgagttggcaaaaatgctgtgaccaaaggctcccaggaacctaccctattttcccctcaatgcaatggttcagtatttgctaattcagtgtttgaggtgactttatagaacatgagtaccatgaataatgagaatcgattctgtataatagagtgatgaaagcacaggtctgggagccagcagctatatttctattctggcgtgactcctgtgtagttgtcatcactggcaaattgcttaactgtgtgcctcagtttcctaatctgtaaaagctacatcgtttggatgatgtgaggattaaacaaattcatagatgtctagggcttataacattcctggcacataacaagtcattattttttattactacttcggaagggaattgagtactataccctgaagaaggtgagtatgggaattctctacgggtctggaatgtccctatatttgtttattttgccttcaagtgactaactttaataccctattgtgattagaagttaaacttctgcaaccaaaaggaagcaggaagctagtatttcttgaagtgcttattacatgccaggtactgtgctacaaaaacaaaacaaaacaactgtaaaaaaaacttcaaatttggctgcgtgcagctgctcatgcctgtcatcccagcactttgaggaactgaagggaggattgcttgagtccaggagttccagaccagcctgggcaacacagtgagaccctgtctctacaaaaaaacaaaaacaaaaacaaaggcactccaaatcagtaaaaattaatcaatcaataaaaagagtgaggggcattaagtattgtggactgaagcaatcccagagagggaattaattgaagctgaggtaagcagcttatggagaagctatgatgtacagagggcaaggaaggaatttttctgtaatttggaaaaatgggaactgtgagaaagaaggagttggaagctcatacttagggagcatctacaaggacgtctttttcacgttggttggaatatccaaatcaaggattatttcagaatcacccagatgattaaaaaactactgagatccaggttgtatttcagcagttctgacaattgctctgggtcgaagcttgaatcagtagttaagaaaaacaacaaacaaaacaaattttggggcttttctcactgatttacagttaaagctcatttactcttcctatgactttagatggaggatatttccaagtcttcaggatggagacatggagggaagtgagactagtgatgtgcctcaaggttttgctgttgttctaaccatgaggagcactattcaaacccaggtctgctagatttccaagtcttcatttccttgggcctcttggatttcagaagcagagggtaaaaggagtgctggggagaaagatcacagtagctttcaattctactcctcagctttccaaaataagtttcaagactggccgttgcatttgatatggaataaatacaaagaaggtagattgaagggtatgaagatgcagatttttgataccagatatgaagataacattaggaagcaatctaaaacatggacacaaacacacacctgtgccagttagcctgtataattcgatttttgttaagtgtttagataactgaaggtaatttaagccctcatatcttcccttcatagggttctttttccctctggttcatcagagagttgccaccaattcaggctgttagtggtacacataacctctagcattgttgatacagctataaaatcccaaatatcagtacaattgttgattgcataaaatttccagttgcatggttggaaagtcctgtaagtttgaatccttaaaccagtcttaaatgtggaggaggactcaattaaagctctcctcgtgtcctccctctgacgtatttgcaaaatcctttccacaaatagaatactgtttttaatgcttccccagtccaattttgcgttgtagaagacgaatttatggatgagggaagtggcattcaggcactccagcttggtatagaagcccatggtgtctggtcctcagtcctcaagcccgctcatttcctcatgtgaactcagaataagcagctgaaagcaagtcttcaaaatctcagagatatgtataaatgcaagtgtttgggtgagaagtgaacatgggtctcctctagtgcccacactacttgactaacaggttttgggctccacacaatgagggattatcaacccctgtcccagggctctctgggtcttggttctttgtttttgatgctcagcaattgtgatcagtgaaaccaatgttgcttttctatcaagagtccaacccttttctaagaagggttgtgtttgatattagggaatagctagcaaagttatcaagtaacttgtagaaacattcttttgcaagagttcttatactgaatgactgtagttgacagcagtgcagtactggtcattttctaggacatcttaaaaacactgatgagaagtttcctctcagatgtctgtcatgtcattcttgcctttctctacacagggtcagttttctcttattgctgttaggagttcctcattggtttttcagcttttgggctttcaaactctaattaatcataagctactagagtgtactacctaaagtgtgtatatacacatatatacacacacacacacacatatatatacctggtatacatatatatatataatatacatatatcatatatactccccaacctgatctggttcttcctctgcataaaagacctcaggccagtcagagaaaacatgtatgttccatggtgtggcaatcaagcccttgtatttggttccaatcagtctcctaactattactccaagaagctcttgttgaaagagccatgtttaaatggcatgttcctactttcttcttcatagtgatcttcatctgtaccatgtacccttctttcttcttgttccatctctgttaggctgattctacccagaagtcaaggttcagctcaaatgctatccctatcaggtgaattttccacctggcatttgttcggtgtgcattgtgtgcatacagcaccttttcccggtacctttactgtaatcaccagataattcctttcattttagttgtaaatagagttgtcttccccctctatggaatagattttattaatgtatagagcagcagtccccagcctctggaccatggactcgtactggtttggggcctgttaggaactgggccgcacagcaggaggtgagcagtgggcatgcaagtgatgcttcatctgtatttacagctgctccccatcgcttgcattatgcctgagctccgcctcctgtcagatcagcggtagcattagattttcataggaatgcaaaccctactgtgaactgtgtatgtgagggatctgggttcttcttatgagaatctaattcctgatgatctgtcattgtgtcccatcacccccagatgggactgtctagttgcaggaaaacaagttcagggctctcactgaatctacattatggtgagttgcataattatttcattatatgttacagtataatactaatagaaataaagtgcgcaataaatgtgatgcactggaatcatcccaaaaccatccccagttccatctgtggaaaaattgtcttccatgaaaccggtcatggaactggtgccaaaaatgttggggaccactcttataaggcatattagagtaatttcatagatttcctaattcatttatcatattcattcactcagcaagcattactggatgttgatcatgtactggctttggtggtaggtgcagagattgggaacattgtcatcaaggagtttatggttgagtgagggagatgacaagtggatagacaatgaaaaaacagtagaataagaactgtgatagaaaagagacagccaggagcattgaggagaggcacttaaccagatggaggatcttggtccattgatatggaggtcaaaatggtttaatagagcaagtgaccctttcaactgaattttttaagaatgaggatttagccagacaaagaagggcaggtgaggttgtgaagaggaactgagtggtactcttcagagctccagcccagttccttggacagaataaatgcttactaacttatagagctgaatattgaattaataaaataagggtaaactgttaagaatcagagaaataacttaaagaacactgatagctagtgttttttgaacaccatgtacccaggtgccttgccgaaaaccttaatgatcatcttgtttaaaccttacatttctcataagaggctggtactattgttattctcattttatgggacgtagaaactaagacttggagaggggaagtgacttgcccaaggtcatacaaccagtactggagaattagggattctagatctagaatttggactctggagcttaaggttttaacccacgacattatgcagagaaattgacaggatttttctgttgctgatcaatttacttggcagttagtttgttacttccttgtctttattttagttgtgacaatgctttcatcttagactgtgtcccgaggctgctgcttttatttttatgggaaatggctatttttatgatccttgctaaaagcatgtttaaacaattttccattaagtagggggatgtttttccttctaatatcagaagccaataaatgaaattctacaaagacttgctggtagcaaccttaggaatttctttgcatgtgaaacccatctgagaacttaaaatctgggtaaaattgtagtgtaatttggtgcaatcgtctctttgcacaaataacatcataaaatcatagtattgtcatctaggaggggccttagacatgatggaatcctaccttttatattttccaggtgaagaaatcaaagtctagaaaggtgaaggaacttcccccaaagtttcccagctggtagagacagaaccagggctaggtcctctattctgactcctgaccactacctcacacctaatagatggaggcatgcccagttcctgttcaccgagggcatcagaccatgccatactcattgctactgttccagcatttatagtagaagctcaagcaagcaggatgacagaatacctaattctggtcactacaacattataatgatggctaaagtgaatgccccagccatgcttgtctagacaggccatctgtttaattggtatatggttcacgtgagaatttttaacctctgtttgtcgagtcggtgttagttctctagtgatgaattatttcctatacttccatttagattatttactcttaatttaataaccatacattgtttactttggtattgaagattcccttgtttttcttctttttttctgtttccagggcttaaaggttaggagtgaccttgccagacttccctggagacttacactgtctcctttcagatttctgaagcagttgggtgctatttttagtccactatcaccaatgtgaaaatggaacttgcattatttcattatagatatttcactttagtattgacagaattaaaaaaataatttgatctgtgcttgatctagcagccaggttacaatagacatttttagttacctggtccacatgttgaaaaacatgtgtcttctctgagactaatgactaagcccgatgttggttatatactgtttactattaaattttccccttgtagtttaatattgttccaggaaatgaaatgaaagtttaataagaatggcaattgatggacccatatgtcggaagtataactaatgtccccgttacatgtgttaaagaaaggcatggctggtgggttgtaactgtactacaccaagatgatttgacacaacttattctacagagatatatatttatcaggatagaatttataactaaacaaaactatagcattttttcactttgattttttttaaatgagtcaaagaactgctagaattgtcagttaaaaaattttaaaaggagatatgaaaaaatcttacaattcacaatgctgtaaagagataatgtagggattaatatgttcttgatatcaatattttatgacttttatacatgtagaagcaaaacaatttgaggtaggtgaagttagtatggacttcttgagattgtccttcacatttcttttcctttcggtgaaaaattgaaggccaaaatgtattttcttctggttttgaaaatactgtcaagatccttgcaacaaaatgagttcctctaaggagctgaaaacaaagctcactcccctcgtgatactctgagaggctttgctcagcatcctgcattctggtgattccttggagacagatgatgctaaacacaggaagattaggtcaatggtaactttttctaagtcaatatttcttctccttgggagatgatcattttaaatcttcccgaagtccaggctaaacctttctaattgaatctccatgaaggagagctccagcaggtggagaggaagtgagaaagagaaatgaaagctgcacgcctcatgacgctgtgccagggagttcttaaaggtgagggagtttctttttggtaacctaagctatgtgaatcagaaggttcattagcttgtttctttttcttttttgtaaactcctacataattttagtaaacaggaacagtaacctaatgtgatatcccactggcccaagacttagtgcatcttcaaagttgcttaattatgtccgaaacagacttttgtctcttgatgagaaaagcatggttaaacgtgtgatgatttcctattgtcctgagctcagatctgtaattgtggccagattcatgcatctctgctgccttctcttagaagaatcatatgtaggcttgtcagataaaacaggatgcccaggtaaactggaatttcagttaaataacaaataacattttagcatgtcccatgcaatattatactaaaatattatttgttgtttatctgaaattcaaatttaattgaatgtcctgtatttttgttggttacatctggcagccctagccatgctgcctttctgcttaatgggcttaattttttgaaggctggaggttttctgttatggtgcccgtttccacctgcttttctaccaggaaaggaggcatgctgatgtagaatttgcatccttatttttgtcattattattgattataacagatgacataggtttagattaaacctacaatgacattgctgtcattcagataattgtaattattgctaattgtaaagaaggataattttttttgaaatgactattatttgttttttgtttttgtttttgtttttctttttttctaattatactttaaattctagggtacatgtgcacaatgtgcaggtttgttacatatgtatacatgtgccatgttggtgtgctgcacctattaactcatcctttacattaggtatatctcctaatgctatccctcccccctacccccaccccacgacaggtcccggagtgtgatgttccccaccctgtgtccaactgttctcattgttcaattcccacctatgagtgagaacatgcggtgtttggttttttgtccttgggatagtttgctgagaatgatggtttccagcttcatccatgtccctacaaagaacatgaactcatccttttttatggctgcatagtattccatggtgtatatgtgccacattttcttaatccagtctatcattgatggatgtttgggttggttccaagtctttgttattgtgtatagtgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatgatatctcattgtggttttgatttgcatttctctgatggccagtgatgatgagcattttttcatgtgtctgttggctgcataaatgtcttcttttcagaagtgtctgttcatatccttcgcccacttgttgatggggttgttgttttttttcttgtaaatttgtttgagttctttgtagattctggatattagccctttatcagatgagtagattgcaaaaattttctcccattttgtaggttgcctgttcactctgacggtagtttcttttgctgtgcagaagctctttcgtttaattagatcccatttgtcaattttggcttttgttgccattgcttttggtgctttggacatgaagtccttgcccatacctatgtcctgaatggtattgcctgggttttcttctagggtttttatggttttaggtctaacatttaagaagaaggatacttaaagtataagggaaaatgttacaatgtatgaagggaacatgaagaaatagaatctggtaaaaaagagttcttgcttttgggaggccaaggcctcctggctaacatgatgaaacctcatctctactaaaaatacaaaaaattagccgggcgtggtggcacacgcctgcagtcccagctgcttgggaggctgaggcaggagaaccacttgaacccaggaggtgtaggttgcagtgagccaagcttgcaccactgcactccaggctgggcaacagagcgagactccatctcaaaaaaaaaaagaaaaaaaagagttcttgctttcaaaactatggattaggtaacttttgtgaatgagtaagatcatgagtattataaaaatagcacctttcttttttgtcttggggaaattatcttattttttaattggatttcagaaaagagtatttcagagaaataaatctctgaaatgctttttgaagtgtgaaagatttagaagacaaaagcaaacctcctgtctagataaacattaaagagatctgccctcccctcctctacctattcaggttgcaacactttgggggtggctgccttggtagagcttgatcgtgactctggtggcttgggagatggcatgctgcacaagggattcatggttacagcgggcttgtgggactggggctctccaatacgtggttgggtttgtaaagaaatcagagctatggtgtgaacaaaaggatatgcatgggagacagtgagacaaggaaatgctccagaaattattggaatataggtcagataactaactgtacttgtgccattttctgggggaaaattctctgaaggctttttgggaaaagaatggaagtgagaattctcaggtcctcaaaatatttccttttactcagtcctaacctgaggccgttaaagaattcccagagtcacgatggaaggcatgtttgggagtaagagccagagtgagggttagaaatgtgttgttggccaggtatggtggatcatgcctgtaatcccagcactttgggaggccaaggcaggtggaccacctgaggtcaggagtttgagaccagcctggccaaaatggagaaacctcgtctctaccaaaaatacaaaaattagccaagtgtggtgacacgtgcctgtaatcgagctcttcgggaggctgagacaggagaatcacttggacccaggaggtggaggttgcagtgagccaagatcatgccactgcactccagcctgggtggcagagcaagactccatctcaaaaaaaaaaaaaaaaaaaaagaaagaaatgtgttttccagggttctgggtacttaggaatttggttgcttttgcaggtggaagtggaggtgactaggtaacagctgagtgattttgccccagttggacatgagccaggttgagcagaaagccctgggatgcggggaggggggtggcggggaaggaattgaaagttggttgtgtggtttggctttggcttcatggcatgctcacaccttgcttcgcatagcatgcttagactacagcaggagcatcaggaagtggatttctgagctcaatacaaaaagttataaataccacctataagggcaataaagatatatagttgattttcttctttgcaaggccaaatcttataggaacataagagcgaatgagttacagcctgggaatttgagccttatattcagagattttaggttgcttctgattccgctgtctagacaaaaccatgagaggatagtgtctagaaatgagaggaagctcttccaatgcagaggctagaatgtgtcagcctgtgctgcgaggcctgggatagatgtttctgaaaagtaaaagggcagctttcctactggatacttgatcctcaggctctagaaaactctgctttattaactttgttgacttcctaggcaccacatgggatccttgttcttcctccttgtaagcagtaattgaaatcagtttggcagcctggtttacagtgaccatggtggcttgtctcccgtgctcttacctcactctgttgatgttgtaaaacctccagctaacttcatggggtggctgacccacgttgctcatttattcattcaacacatattcattgaccatctactctatgccaggtattgttatcagcactgggaatagatcagtgaactattgatctatttgtctaatgggacaaattgacaaattgggaaagattccattacacaggtgacatttaagcaaagtcttgaataagggagggaatagtaccatgagatatcctggtgaaaagcaatttaggctgagggcacagcagggaagaggccctgatgtgggaacatccctggtgtcttgaggtacagaggccagcatggctggcacggagtaagaagttggaggtgccgggcatggtgactcacacctgtaatcccagcactttgggtggctgaggcagatgggtcacctgagcccaggagcttgagaccagcctgggcaacatggtgagaccccatctctacaaaaaaatacaaagaaaattagccagatgtggtagcatgcatctgtagtcccaattgcttgggaggctgagatgggaggatcaaattacttgggaggctgagatgggaggatcacttgagtccaggaggtggaggttgcagtgagctgagatcatgtcagggtgacagagcgagaccctgtctcaaaaaaaaaaaaaaagaaaaagaaaaaagaaaaaaaaagaagttggaggtgagtaaggagaggaacgtgggggacagagtcctcaggactctggcttttactctgagtgagtcgaaaatccaattaaaggtttgaaagagaggaatgacctgatctgacattttattgtgaacgttttcaaatctttacagaagtggaagagcataacgatccttcatgtacacatcgcccagcttcaactatgatgtttcatttgtaaatatttccgtctacacttccaaaggatgatgactatttttaaaagtccaactataataccattatattttaaaagttaaaacactatgtctttaaatatcaagagtttgtattgattcgcactttgaaggtcgagctgatgaaatttcctgaggggttggatgtgacatgagagaggagtcaagtattgcatggtaattaaaaacctttgcagcatagtccatttaccgaaagactatatgtatgcacttcaaagcaggttttaaagattaacatcaagcatctggcttcatgagttttaacttcttttcataaatgttatacaatgtcatcatctctccagctagagaaaatgctattattcttattttcaaatgaggaaaatgacgcagaattatttacatattatgtaacttggtcccaagtcccttagatactggtttagaaaatcctagtaaactggaagtgacttatccaaaattaaaatttattttgctctattgtcttttgttgcctatgggaactttgtgcaggtaactaggcacatgtcaggactgatttactgacctctcaaggtatctttaattattttgggggatatcacggaatgagttctacacaattcatttgaatcgaattgaacttaagaaaattcaaatgatgcattggctgcctcctatttattacatgctgctcataggcataacagcatagtctaacaagtataaaacctgtgtaactgtagctttcagtgcagtgtgatgagggctgagaagatagtggtacaaagaagagaggtagcagagtgaagctgagtcaatatgatgaagatttctctagacttgaaagggctagaaaaggttattcttggcaggaaaaaaacatgagccaaggcataaggataagcacaggcatggcagatttgggaatgtcatgtaatttgttgctgggctgcaaagtacatggaaggggagtgaaggaacagaaggagatgaatctggagggagaggttaaagtgttccagagagcaatatgtaggtgttactctaagtcaaagaggtcgtaatagcatgtccagactccaaaactctaaacaagtcatagaattgctgccttggtagggcatatcacacacatcaacccaatcctctgtcaccatgacatccatataactgcaactctatacatttcccagcctatgttcccagagtctccagatgacattgtctgcaaactgcactgcagaaggctctgctatgtcttcttaaaagtaagcaagactgttttcctttgttacatgagcagcaaaaggatagggtgctctttgacctcacttactgtagggtggataggaaagtcaaggaagagtaacccagaagatttagttttaactttcgcatcaaagaggtcccttagcatctgctcagagatgtcacaatttctggtgtgtgattatgtttaagaattcggccttgccactgttgaagttgttctgtggaaaaagaacctctcttaattttacatgatgcccaacttctcttttattccagaatcactcatatgctgttggactctttccagccatgtgtgctaacctaggcaatgtcataatagatgaattatgtttactttgtctttgatatctcagctcttttatcttctattcaagttcccacctccatcattactgatagtgttcgttgaacaaagaatatgtcagatatacagaagtgtttctccccttttctctgtctctcttttccttcctttcctttagtttcctttctctgtctgttttctgatgcctcattttagaaaagtgattttttttgtgggaaaatcattttagcattagaaacgcaatggctatcactgacagcttcctctgatgaaacggccatttgtcatcattacacggtcatgggagtgctaagaagacttaaatgcagggctaccaccccttcccaattcatcttttatccattttatttctctaaggaaagggtttgaaaaatgggctttgccctcttggatgcagtgaagaaattctagctggctacagatgttattgttggtcggaggcaagggataaaatcatggtcacaccattgtagcgccagatggggaatgtagcaaacatagttgtaatttctcattttacagatgaagaaactgaggtgcagaggggttcggtgacttgtttaaggcatgtaattgttattggcagctttctgttcagaacttaagagtatgagtcagtctagatcttttcatcacaatactctgctcctcttactttttcctgaaatttgtcacattgacagcaatgtgatccctaatgacacacagattcccaaataatttttgtagtaaaaatttccatttgcaattctggacatgtgtgtgtgtggaattttatgtgatgacatattggtcctatcttttgaataggatcataaatgaaatgacttatggatcacattcaaaagcaggccaggggccaatgtgtaagcaggtgggttttcatatttggagttctgtacttttgtgttagtcagtgggtctaggactcttgtagtgtatttcccaagggccaaagtcttctgccttgaggtgtcagctttccaaggcagaggctggatgctttctcttccttctgggctcctttctcttaggcttcccccttctcttctcctccatttgtatctgtcctttttctcggtactttccctggctggtctcagctagatgctcactcaatgctgttgaataaatgaatgaatttcgtagtaattctgcaggtaaatcaagttattgtctcccaatacggtgctatgctttctgaggaaattagactggaagtcaggctttttaaaaaagaagatgtggtgtcaaattgcagctctctctctctctcgacttaccttttttctatcatccatatgccttctttcttgtatctttgggttcccagacctcaccattcattagcacttggaatggattggtaagaataaagaaaggagaggtggtgaaactcagcttgggtcatctggttacacattagtaactgacaaaagataaaaagatacagactaaatgggtttttagggaactttttccagtctattcttgtttcccattagtgtgaaaaatcaacacttgcttgtattttggggtgaagacatttttcttaagtgagtgggaaagcctcttgacattttaccgagagccttaaattttgaatggtgaatgctaatgttctttgtgcataaagaatttcagaacttgtatatatgagcattaatgatgcatcattttctatttgtgagttaaactaggtattatctgtaatcatatttttaggaaacattcaaactttcatcaagtcattctcttatatgactctcagctccattaactctgttttcatggaactcaacagagttcttaacgtttgcattataaattaaattagcatttcccctcaaagaagtattgctgtccttacaataaataattgtagacaatttcttttcttttcttttttttttttttgagacaggttctctctctgtcacccatgctggagtgcagtggcacagtcacagctcactgcagccttgacctcctgggctcaagcaatcttcccacctcaacctcctgagtagctagaattataggtgcacaccagacctggctaatgtttaaattttttgtagagttggggtcttgctatgttgcccaggctggtctctaactcttgggctgaagcattcctcccaccgcagccttccagagcagtgagattacaggtgtgagctaccatgcccagctaattgcaggtgatttctaatgggatttagtatttctgggtttaaggatgagatctgaggtaatgactttgtttccagatgtgaaataatttgctcttgggttgtgagccctttgggtgggctcccaaggatcctgctctcttccaggagcccaggctctggggtcagactgcctgggtccttgactccctgttttctgattgtacaactttggtgagtggcctaattcctctgtgccttggctaccttggttactatttctaaaacaactggtgttgtagtagtactgcttagagtactttcaagggttaaatgaattaatccatgtaaaacgcttaaaatagtgcctgccacaaccatcaatttagtgtgaaaatctgctcacctgcttggccagcccctttcactttattaaaccaagggtcgtgctgggttttccagaagtctaagttgcggtctaatctttgtgcagaagctgaaatagcagccataacgttctccctagatgatttcgtggagcttctttgaactgtatctatctccagtcatttttgtggaagaaattttcttctgtactttttagggatgagaattacctgccttggtttattaactaaaagacaccatgattacaaataaaattaaataaatattgtatcactaaatagataatatgagatagatgtattaagttttcagataaacagtataaaagagctagagtaatttgtaaaaagttgggaggacctattttgtcatgcaggaaacaatttttaacttgcctaccccagaacatagctaccacatggttagggtttgcccaaacctggcccaggagtcatttaccttgagctttcctaaaaaggaggatcaggattttcctctccagactctatcattttaggtagagtccttcttgtcaattctttttaagaacatacatttacttttgtggaaaataaatagatacaaaataaatacatacaaaattgcatagcaattagaaatacccaggaggtatgttatggtcacagacacaaactgcctccaacttctgtccatccatagtgatatttaaagcagagagaggtacacaggtaaccacatttagatggactgggatgttgccacacatacaagcattgataactggcttctcattacctgaatacattcttctgtcagagcaacagactcagctatgcttctggcaaaattgttcttaattctctattgattaatttattcggtaagtatttattgggtattttctgtctgaaaagtgcgattccaggtgctttatgtgtctctgtgtgtgggtgttatataaatacttataatactgtatccatactcttgaaaagcttagttgggaaggcaaggcatgcaataaggaacacagaattttagtcattccacaaccatctgttgaatggctgctattgttagtatcgtggtggaaactgagaagcaaagatgactataataggatctcttttctggagatgcacagtggacacgtagttatatgatgatgataaggactccagaatagttctatacatgatgctctggggccacatgcagattctgatgagaaacaattaactctttttggctgctacctgagaaggggtaattgtcactcaggaggtttttgccttttgaccaacatagaaaggagtgtgagtgaaggctagaggtgtactaacttggtcagggcagggtgacacataaaattaaccatcacagggaagggtagggctggagaggcagactgtggccaggttacaatgcgctgaggctaaggagactgtgtttatcctgtaggccagtgggtcttactctgaagtcttttgggtgggacattcatggacttcaagagacctgtgaatgccctaagattataagtaaaatctgtgagtctgtaactaaagctaaagctatttttctggggcccaccatctaaagaagattctgaagccttagggtagccgtggaggagacatgaaggtccattttgcatggtagaaccctgcctggctcttgctgcagtgtgggaggacaggtttgcaatgtggaggtgtggcaggcatggatttgggaggattggcagaggactcaccatgtccatacactcactgagatggcaaatatttattaatcatccaactgtgtatcagacactaagaataagctgggaggccatggcaagtgaggtcaccacagtccctgccacagtggaggttatggtatacaggtaaggcagggaagagcactgcaaagggtttgcccattgcatcagtcatttatttatgcacatgttgattcaacaattatttctatgccaagctgtcttcaaggtgctggaggaaatgaagcgtacatttcactggggaagacagacaataagtaaacacattaaaatctggcttggcttgatgttggggaggggtgagtgccatagagaaaacaaaccatttatgcagccaacaaacatatgaaaaaaatctcatcatcactggccattagagaaatgcaaatcaaaaccacaatgatataccatctcacgccagttagaatggtgatcattaaaaagtcaggaaacaacagatgctggagaggatgtggagaaataggaacacttttacactgttggtgggagtgtaaattagttcagccattgtggaagacagtgtgatgatccctcaaggatctagaaccagaaataccatttggcccagcaatcccattactggctatatacctaaaggattataaatcattctactagaaagacacatgcacacgtatgtttattgcagcattgttcacaatagcaaagacttggaaccaacccaaatgcccatcaatgatagactggataaagaaaatgtggcacatatacaccatggaatactatgcagacataaaaaaggatgaagtaatgtcctttgcagggacatgggtgaagctggaaaccatcattctcagcaaactaacacaggaacagaaaaccacacactgcatgttctcactggtaagtggaaattgaacaatgagaacacatggacacagggacgggaacattacacacctggggtctatcagggggttgggggctaagggagtgatagcattaggagaaataccaaatgtagatgacgggctgatgggtgcagcaaaccaccatggcacgtgtatacctatgtaacaaacttgcacattctgcacatgtatcccagaacttaaagtataattaaaaaaaaaagaaaagaaaacaaaccagtgtaagaggatggaaagtaataggctcgtttagaatggtgtgagaaagccaggcagggagaaggcgctgagacagggaggtcctggatgtgtttgtggaagagctgtggcagcacctggaacttggggagcaagggaaggagtgtgggcaggcaagggtgagggtgcagggggtcatgctgggccttccaggtcacggaaggacttgagctttactcttgttgtggtgagaagctgctgagggcttggagttaggggagtgaaaagatctctactataatagggagagttcgggatctgtaacttaaccccaggagccagcaaagctccctggaggaaatgcagtttaagctgagaatgggaggataaacaggtgtttttcagagaagaggaagggtgctctaggcacagagaacaacatgctggaatgcttctactagatcataggggcaaaatgggagtgcaggagtaggagagggctttctgggaaagatacttattttaattttgcatgcattgagtttttgaggtttctttggtttgttcatgtggaggtgcagagtgggtatttagcacataggtctgaagtccaggggaggggtgtgggacagcagttggatgtggcagagattccacaaagagcaaatatcatctgagaatggcagagggctgagggcagagccctgaggaacactggtgtttaggagcctgctggagaaagaaaatactgcaaagggaacggaagtggagtggttgccagacatagaagctagtgtctaactagatgtcatgagatgtggggaaggtgttacgtatctaagaatgcaaagttgaacccctgtgaactgtaatacttaagataagtcgtataaattgtctggaactagagcttgattttccaggagagatgaaatgtgtgtaggtgacaggaaacaatgaatatgtgggcgagtgtagtgtgagcaatttctcagaggtgaatttgacagcattttgcttaggaagctacaaagagaccaatgctagttggtgcaaggaattcaagaatttggacttaagtctatataatgatgattttttttttttaacttgagtttcccggtttatcactcccagaatataggcagaagtttgagatttttatgtgtattttctggaaaagatagtttcagtgttttttacattctcaaacaggtttatgatccaaagaaaaggcagtggtcacagatacatgaaacgacaaggtattcaaaggagaacgttgtactttatgacagttctttgggcagtggcttgcaggatgagtttgaggaatgattggaggcaggagagtaattctagtaattcaaatgtggagtattgttgatctctcagacacaaatggaaaaacaaggaattcaaagaaagataggcagagtgttttgaagaaataattgatgaaatttggtaatgagttagatgtaggagatatatttagcaaatatttattaaggactgtattaatctgttatcatgctgctaataaagacataccaagactgggtaaattataaagaaaaagagatttaatggactcacagtgccacgtggttggggaggcctcacaatcatggcataaagcaaaggaggaacaaagtcacgtcttacatggcaatagagtgtgtgcaagggaactgccatttataaaaccatcagatttcatgagaaatattcactatcatgagaacagcacagacaaaagcctgccaccatgatttaattacctcccactgagttcccccaggacacatggaattatggaagctacaattcaagataagatttaggtggggatacagccaaaccatatcaaggacctactgtatatggttaaaattgggagcaaatgagacatgattcttgccttcttggagtttactgtttactaggggaacatacacttgtcaataatcacccaaatataggattggaaattgtggtaagtgccatgaaaaacaagtatagggaattttgagtgtacatagctttggggacttgatttgatgagggagccttatgaagttattgcactagaactgaattaaaccacatttctaggaagtggacatctatttgttggttctttaaatttagctttacagaaatatttcctttaaaaaccaaggcttcttaaatttttaaaactgcttggctaatcaggggaataatgcttttggatagctggtatcgttatttatggttggaaaaacaacagtatttgattacattgagctttaaacttttcctttgattaatgaaaattttattggcccatagtttttattatgctctgtttttacttggtccaagagattctattctctggacccaatatgaataccttcagacatccctctttttttttttttttttcacccaggctggagtgcactggcacgatctaggctcactgcaacctctgcctcctgtgttcaagcaattctctgcctcagcctcccgagtagctgggattacaggcacctgccaccacacctggcttatttttgtatttttaccagagatggggtttcaccatctcggccaggctggtcttgaactcctgacctcatgattcacccaccttggtctcctaaagtgctgggattacaggcatgagccaccacacccagcccagacatccctcttaattatgttgaatatgtaatatcggtgatttcatttgaaaatatttagtagtcgaactagatcaaggcagttaagcttcctatttccatagatgcagtggtattgtgtcttttttatatgatctctcatgcttctggacatccttttttctgctattcttcattccttagctacacttggtgcttcgtggttgtaatgcattgtcatagatgcgttcatttctcattcgatcttcagctctatttctttccagagaatctctacaggcatctgttaggttgaaggacatctaatgtcttaatgtgtagcttggtaaaccagtcaactttctatctgagtcttaagagaaagtgtccaagatgagaaacggtacaggtttggtgacaactcagtgagaaaaagaagaattttacaaggaaggaggtatcttagtaattttgctaaagaagtaggtaaaccttcacttataataaagggatagggctcggttagggtttgtgaagtctccccttaggaaagcaaaccctgaaatattttgaatcttttaaagaaggaaaataagagtcttttaaataaatttttaaaatttattttatatattttttatagacaggctctcactctgtctcccaggctggaatgcagtggtgcaatcatagctcactgcagccttgaatgcctgggctcaagcggtccttctgtcccagcctcctgagtagctgggactgcaggcatgagccaatgtgcccagcaagagacattcattttggtactgtgatggtacagaaaaacaaagggcctttgaggccgaaggagcagaagaaggatggacttagacatggtataggcactttctactaaagagctgtgaagctaaaaatgccaggtctatgacaggtgcagtgggccaaggccaggtagagagcagcaggaagagaggaggtggggacctgtacctaggcccatctgctgggactgatctagccataggtactcagagaagcccagattggtgcctgacccacccttatggcccagacatggacacctcccagtctgttccttcctgctgcccatggatgggctgtgttagtctgtattctgaggacacagctctctgtctagaggaagttatgttatcttgatctgatggatactcaacgtgaacattatttcaacgtgccacagggtcttggagcccagaggaagaccgctcttgccttttagtttatattctttgtttttttttaaataacattttgacagtctttatggagtaagtctgggccaaaatgataattgacaatgttatttacatggatttctaagttggctaaaaaagttcctttatggttagtgaatatagcccatgtagtttccccgtcttctttagatgccttctatttctatgcccaaagtctgcagttgattttcagtaagctgggggtcatcttagagataaaatgtagatgaatggcattttgctgacagcatacatctttgctatttctgaggaaaatgggctctcgctattaaatcttttgtcaatatttataaaaatagtatttacatattctatctatattgtggaaactatacatttattgattcagtcatttgatatcaatgttgttgagtccctattccaagtgaggcactatgctctaagcacatggcattttaaagatgaataagacaccaagaactttgcagatagtaatggaaatgagaattaatcaattgaagattaatatagtaagtagcagaagagaaataaaaaaatcttctagagagttcagaacagggatgttgattcaagtttatggggattaggagtggctggtaagggaggcattcaggcaaaagacataaaaatgcagtattcccctcgcactcattaggatggctactatattagaaaaagaagagagtaagtgttggagaggatatagagcaaatagaaaccttgtgccttgttcatgagaatgtaaaatggtgcagccactgtggaaaacactggtgattcctcaaaaaatcaaaatagaattatcatatgatccagtaattctacttctgggtatatatctaaaagaattaaaaatctgggtcttgaagaaatatttgtatactcatagttatagcaacattattcataatagccaaaaagtagaagcaatccagatgtctatagatggatgaatgggtaaacaaagtctgtgtagtatatacagacaatggcatattagtcacatcatggaccttcaggacattatcctaagtgaaatatgctagacacaaaaagcaaaagtagggtttcacttaatgaggtatctagaattgccacattcacagagaacaaaagtagattggtggctgctaggggataggggaaggagaaaatggggaattattgttgaatgggtatggagtttcagttttgtgaaatgaaaatgttctgaagactggttgcacgatgatgtgagtatatctaacatgattgaattgatgaacacttaagcgtggttacgatggtaaattttgtgttatatatatcttaccacaatttaaaaaatatagcattttattatgtaggcgtgggtgggaagatacttgacacattggaacttctggccatgcgtatactgttcactcacttattccttcattcattcaacaaacatgtattgaatgcttgctatgtgctgggcactgagctagatataacaattaataaggcttataagacattgaatctatcaatttcatgcttgctaaatatctactcccacctccaaaggcactaagcttctacagttagatattcatagctgcttcctactgacttgaatcatgcataggatattagtaaacaagcaataaaaagatttgaggttgatgggggtgggttcaacagcatggtggtgaaatggaaagagatgggtaacagaatatgaactagaattgaaaactgtgagccagtgctctctaatgaacattaaaaaataaagaattcctatttgaggctgccaacctcagaactaagttatttagaatggacgaaattggcaaagtcagacgtactcaacccaaggagccaatattttgtgaatattatggcaaatgtagtttgagaaccactaccacaaaattgtgaaccataataatgactgagaaggcagggagaggttatacaatttgggctaaaaggaaagacagggcttgtgaaggggagcgccagtgaaagtcagtgtggttcgggtatttgggtggggactggaagcaggaagcttgagcttcctttgccaagagaccctgctggaagggctatcatcaattgactttagctcatcttaggattttcattttttaaaaaatgttcacaggaaccttcactccatctatactttcaatgtctgcctacctttctttcttatacaactttgaacactctctccattcatttaaatatattatggagtgccaactacatgccaggtactgtgctgggctcttattccacctttatttgattgcacatgcctgccaagtcctgggccaatataacatctactcctatgtctggtctggcgagagatgcaaactcatcttcctctactttccttacctccttccttccagtcttcttcaagttgtcttcattgaggcaatttcttttacctgtgtttttaatcccaactcctctagtttccttcttggctttattcttttatcttcctctttgtgctttcaaacattccctttctcctggcccatgcccttcagtctacacgaggccttctcaagtctcttcattctaaaaaattcattttcttgggtcttatattcttcagctgccaccctatctgtatcttttcctattctcctccaagttctcaaaggaatgccttccctcattttcatctccttacattccatctgctgaattttggcttgtgcctgtacctgtctaaggaaactccttgctaagagtctgctttgtcaggtctgaattcacttaaccagtctttgctttgttggacttctctgccccatttgccattcttgatcatcctctccataaacctttctacttaaagcattttacttccttattttcttggttttcctagaatctccttactgttcattttcagcttcctttctgtgttcctcttctcttcctacatttttttttagctttctactttcttaaagcattttacttccttattttcttggttttcctagaattttcttactgttcattttcagtttcctttctgtgttcctctgattgtctctctttctacattttttttttctgtgttcctctgattttcacgcagtctggagttgtcatgatcaatcatagcctactgcagcctcgacatcctaggctcaagtgattctcccacctcagccttacaagtagctaggactacagtcacacatcaccattctcagctaatttttttaagaagcatttttatagagatggagtcttgctatattgtgcaggctgggctcaaactacagggcttaaacaattctcctgctttggcctcccaaagtgctgggattccaggcatgaaccaccatgctcagtctctacatgttcctaaagaggagttttgaatattgaagaacagtattttcaaattacattattcaagttataaaaactgatatccagggttatgtggcaatgacgtaaaaatttgaattgttatttttttgacacatgttctgtgttgtccatcagttcatctgagttccaaatgtcccagctgttttatgctttgtctctgtttcccagagaccctgagtgtggtctagagttgggatgagcattggtctctaatggttctgaaataattgtatattcctgcaaaaacattaagtctattagaaaccagctaatttcattttgtcatttttataggtaacatattctggtgcaggtagtatgtttttaaaacaagtttgcaataaacaatttcccctcaaggttaatataataggcaacaccttttgctgcaacagacggcaagaggtaatgaaagattagcttacattatgattcattatttcaaaatgtcaggataaagtggatctgctgcatctcccagagagtgcatgttttgcttttctaatgttaatggatttactgtttttttccccccaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggtaatagtgtgttgaaaacgacttctatttttgatcctatgagcagatcctaagagccaaagcgactgaggaaggaagacatagaatcagccatttgtacaaaacatgaatccctagtaggtccactagtatctttggtagaaacatggagaagagacaggatctcaggagaaggagttgacacatggcagggcagctgaggctgagtaattccgcttccttcctttggcaagactcaatcagtcttgagcaactctacagaagaattccactagctggatctctgaggaaaaaagaaatgttgtctgtgccctgactggggaatgccagatggacattcatgtttggtaggcaactttgcctatatgatctggtatatgctgttaattgtccatgcataattatctctctactcaggccttgtccaggcaaatattctgttttgttctagtttagcttgttctcccctttctctcttccatctctttcttgtctcaatggatgacaggatattttgctatgagctgactcagtggttggtgtcttgtaatggggagatatcatctttatcaaacagttattaagtatctacctgtagcatttcattttcccgcctgcctccattgttttcttgtctatagtttgccaattatagctaatatacggagagctatactttatttctactccagaaatgtctctattattgcattataataggataccctggggaaacactaatcatttttactacctaaaatacctatgctgaatatcctttatctgataggaacagagatctgacagcagcttaggctaaccaaattcattttttatcttaagtgtggggcatttttctctcttcttattctttaccttttcagcttaagtgaaggttagtataaacactaagaatatttctgatggagttttcatgtgattccttctacaaaaacccagatttaagtaacttgttgaaaaccagagtccgctaagttaataaacactgattgaagaagtgattctcatggactttctgtgatagctctttcctgccctgatatgagatgaaagctgggggatggtatatagtatttatttttccttccgttgccagtgggactttttttttttttttaaaagctgttcatatcttaatcgagtagcatgtgaggtcaacatggtctattttaaaagcattttcttcgacacattgcttttaacatcttttagaactctgctgtgagacacatggacttttttgttggtatttttatacaattaatgatattctcaatagtaatctttgtgtgtgtatatatatagaaataaattctaaatgtaagttaatatatttattatttttctaaacatatataaatatatatatgcacacaggctatttaattttattagatgatgctattttaattcagaaaaaaatgacatttatattttgatttaggttagtataagcccttagaggtgttttgacaactctcttaatttgtggttttactgtttatttgattttatataatctaaaataccattgtttttaccaagcatttaatttggcagtgaaagagcgtctgacagaggtatggttagtagataggtctaactgcacaactggatggattgagctgagactgtttcctcatcagtaaaaatgatttgaagcagtggttggcaaagtttttctgtaaagggccagataataatattttaggctttacaagggccatgcagtctctgttgcagctaccgaactggattatagcctgtaaggtgacctgtaaacacatggaagtgattatgtgctaataaaactttatttatcagaataggtaacagatcagccctggcccgtggccgatccctgatttaatgtttatttatctgatctaaatacctttatttatggaagggaataggggatttttaaatctaaagttttgattattcacattttactgagaacttactctatacctgattagatgttccgagagaaataaaaaaaaagtgtaagacataatccataataccacaaaatttaaaatgtatttaggaaatttatttgaggaagtaaatgtacttgttctcatgatacaatcagaaagtaagtcagtattgataaagtgttacctgtatgagaaagataaggaaaacaatagagagatgtaagaaatgaaaataccagttataaattaaaattattaagattgaaagtggaaatgatcttcctccgagaaacaatggcaatattctcacaaattttttacatcatttttgttcagcatttaagataaaattatataaattcccataacatttagtattgtctctaagcattaagaacagaaaaaacagaaggaaaatatatttctaaaaatcaacgaatacagtgtgagatgtttcattggtatggcattatctcaagttcaaacattttgaaaaatgtctgcttactctttgatagttaaaaacaagtatctcagctggcgtggtggctcaggcctgtaaccccagcagtttgggaggctgaggcgagtggatcacaaggtcaggagatcgagaccatcctggccaacatggtgaaaccccatctctactaaaaatatgaaaattagctgagcgtggtggtgcacacctgtagtcccagctacttgggaggctgaggcaggataattgcttgaacctgggaggcagaggttgcagtgagctgagatcatgccactgccgtccagcctggtgacagagtgagactccatctcaaaaaacaaacaaaacaacaccaccaccactaacaaaaacctcttatcgccgtcttgtatacgcagaccagctagtagaattttactgaaacagtagcctataaaaatgcaattccacttggtttcagaaacttcttgtgtatcatagtgtgaagtcacttatcttaggcttttaaaatgggataaatattgagtccaaagttctggaagaagcctagaaagaaggcagagttattaacttttagatatagggaggaaccttaaaattattcagttcttcattcattcacttattcattgactagctttactaacaaagccctatgcaagaccctggaaatgcaatgatagaaaaacctggtccctaccctcacagaacttgtgaggtaaagggggatacagactgataaaccagcaattagatgatggtgtcaagatagaggtgaaggcagtgtcttataggatccaaactccactcagtcctggtggtggttgagtctggctatcagaggtttcctgattaaatctggagggtgagtcaagggagcatggtgaagaaggagggaatgcatgtttagccatgtgaatgagtccatgagtgaagaccaggaggaaaggcagagcgcggggaattctatgcgtaatatttaacaaaattaatgtactgttaaacaaagacatttctgggccatggatttaatcctagactgtgtaaaaaccaagtaattgatttcctttatactttaaaagcatttccatgtatttgatttgtttgtgtgtataaaagggaaataccacaacaagtttaagggtttctagttctgctttctcatcatagtcttgataacttggaactaaaaagtttttgctgaaattgtctgtgactctttataaatcacactgcccctcaaacacatttaaggatggtgaagggtctgacacgtaggtgggaagttctgaagatgccgcagctctccctgttttccttgttacttaagaagagagctagaaatgagtgtacatcagattattctcatgttctaagtgttttggttgaagaggtaaagtgtttggcttgaaagcatacaaattttcatccactacttagtgtacaaacttgattacttaagagattgagtaatggcctccagtgaaacgcattctttttaaaaagcaaagtgaaggatgctatttaagtcagaaggggcaaaattggatattttatgagtttattaatcattgcaggcatagaagtagtgttccttaagatgtgttttagacagagtccctgggatgagttatataagcagatctggttgtagcttcagcagccagatactacctttgagtattacttcaaggaaaaaggactccactgagctcactgcttctctttcattattatttcagaaggttgtgtggcgtagagggggctcaggcctacctatacaccactagctatgttgccattttatattatttctataaggtgccaacagaagctgctcatcagatcagacagacatagcccaggcaagtattgatttacagatgatctttggccaggaagacatggtatcagggtagagtctggttatgggtcaatgcagtggggaccttaggtcctacaggtataactgagagcctgatccaccaggccttagaaagcttcagggtgagacagtccagcaccctggatagctcctttaacagctgtggccggtaagcaggcacttatttgctaaagaactcaagcccatttagctggcttcatctgctttgtagagctctgttaaaaagagttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaattcctaggttttcttctagggtttttatggttttagttggtgggactgtaaactagttcaaccattgtggaagtcagtgtggcgattcctcagggatctagaactagaaataccatttgacccagctatcccattactgggtatatacccaaaggactataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacgagttagtgggtgcagcgcaccagcatggcacatgtatacatatgtaactaacctgcacaatgtgcacatgtacactaaaacttagagtataataaaaaaaaaaaatttaaaaaaaaaaagagatcttagttcttttgggcttggggactcactcttgttcacttaaagtggattggttcttacatttattttcatagttgtgtctggtcaccttctggcttgatgtatgcccctatgtctggaaaaggttagagaatggggtagaagtggaggctgcccgcccatcatgtaactgttttatcttttcagagatacaattgggatcctaactctttggtctccgtatttccacacttgctcttatacgattcagtttccatgcaacagcaggagagatattttagatatattaatcaggtcctatggtcttgagtttacagctctcagtgtaaatcttactctcaagagaaaaattttccttctgcagctgaaaacattcgacatattctctctcctattccttctcccccattcactgtactccaggcacaccagcttttatttttatttattttttgctattccccccaacacgccaacatgttccttcctcaggatctcagcacatgtggttccctttttccctttgcttgaaatacccagatctttacttggctggtttcttgtcattcagattctgcccaaagtcactttctcagaagtagtgttacccttccacgagtaatactactcttacttctctttacagctctcaaattcttatgaagttttcctatttattcatttgtttgattattgtctgtctgcatcaggtaccgtgcaaacttggatgtaaactcagtgatagctgatttctgttcagcattgtttgttgctatagctccagtgcttttagtcatgttgggcacgtccctactaaatagtagaatatggcgaagggtcagagtcatgatagatagccggatgtggtggctcatgcctataatcccagcactttggtaggctgagatgggcagatcacgaggtcaggagttcaagaccagcctgaccaacatggtgaaaccctgtctctactaaaaatacaaaaattagccagttgtgatggcatgtgcctgtaatcccagctactcaggagactgaggcaggataattgcttgaactcgggaggtggaggttgcagtgagctgagatcgcgacactgcactccagcctgggcgacagagtgagacttcatctcaaaaaaaaaaaaataataatgatagataaaaactgctagaggctctctgagaaggaagaaatgtcactgggttaggttggtaagagaagtgttaatgcaagtggtacatttgatataagcatgcaaataaatggtagtttggaggaaaattccagaaatgtgaaacagtattgagaaattgagtaagccagctttgagagaacacacggcttattgtcctctccttctgttttgctcctcagctctctaaagtgggcattctctagggtcctgtcttcaatctcagcttctttttcttcttcatccttctctttccacctagtttcctagggaattatatatatatatatatatatatatataattttgtatatatatacaaaattatatatatatataattttatatatatataattttatatatatataaaaaattatatatatataattttatatatatatacaaaattatatatatatgtctggtacaggctgaattgtgtctcccagaaagatatgttgaagtcctaatgctcagtgcctcagaatgtgaccttatttggaaataatgtcattccaggtgtaattagttaaggtgaagttatactgtggtgtaacccacagtatacttccagtatatacttcagtatatgggcccttaatctaatgtgactgatatctttagaataagaagaaaatttggacacaaacacagagaagagaatgtcatatgataacagagagagagagagagaagagagagagggaggagagagagggaggagagagagggaggagagagagagagagaaggagaaagaaagagaggagacagaagagaaacatctacaaagcaaggaacaccaaagattgctggtgcctaggaaactaatataataacataatatttggggcctaaagtgttacagctgcaccaatatctcccaaatcttgctcctagctcctgccccagcctgattttctcagtgactcccctgtgtttccctctgccaccagcccctccttctgcctgctgtgtgtgacagttcccttgccactccctccggcatccgtacttcaaactggggagttagttatttccattgtttcttattgcagcctctggctctgacgtttccagagctgttgcatagctctattgagtctatctccttaaatgcattttcatccacttaccattgctgagttagctgcattacctttcaccaggatgcttgcaataatttattgtttccatttgccttctccttcatctaagccgtttgcttatgtcttttttcttgttgcgagacattctgcacattgccactctattagtggtcataaagcaaatcactgatcatgtcaatacgcagtacaagatcctttaatgacctccatagcccatggaatggtccttaaacaagagttcaaggactgccacaatcttgttctagcctatctttctagtcattttaaagtcaccatttttacttgtgaaataggcactccagacacagtgaattccttgttcttctacaaatatgatgattccatttctttgctgggaatttctttccagatttacctgtaaaaattcttcgaaccctaatcaaaagtgactgttgttaagcccctgaagataatgcagaaattctctctctcctgggacctcgatattagtttattccattgtattgcatatatttgattgcccatgttctgtcccatactgactgtaaagtccttaaaggtgagggcccaatattctcagagtcactcaataaataaataaaagaataaatggaaattaggatcagtttgtgggctttagcaacacaaaaacattatactttttcaacatgggagaggtatgatgaaggagtttttttttttttttgagacagagtctcactctgtcactgaggctgcagtgcagtggcattgtgtcagctcacaacaacctccgtctcctgggttcaagcaattctcctgcctcagcctcccgagtagctaggattacaggcgtccaccaccatgcctggctagtttttatatttttagtagagacggggtttcaccatgttggccaggctggtcttgaactcctgacctcaggtgatctacccgccttggcctcccaaagtgctgggattacaggcgtgagccgccgcacccggctgatgaaagagtctttaatgcagattaatctggcagaggtatataggagggaccagagaagggaaagaatcaaagcgtgaagaccaatttggctgatattcaactagcttagatgtactaaaaatctgtactttttggtatttgtgaaatggaaagaaggggaatagaataaaggatattataatgaaaggatatacattgcttgaaggtaattaaatatgggttatccaggagataaaagagttaaagaggttcagacatagactgaatgaactgagaaatgaatgacttggtcaccaagaggaaggccagtcatcagggggtaggataagttcaattctagacatgctgcatttgagatgatagctggatgtccagatggaattatccagcagccacagaaacagaatcagctctctgcggatattccaggggtggggatttgaattaatttcctcaattaattttaaagaaacttgatgaaaagaatggtctgaatacttcttgaaggttgcacattattaataatggagaaataactctaaaaccttcctcttgattttcataataatataagcattccctgaatcttaccaaaccttgtaagaaacactcttattataaaaagtgtatgtgcaaagcccttctaaacaggaaaatgataaattagtcctacagggccaaatgcagctctctgggagcttacaattcagaaagaacatcctgctaccagcacattaagctgtacaaatagtaaactgcagaaacaaatataagcatttttatgatgtccaaacaagaaccaagcaggtgtttttttttttttttttgcagattatttatactgtggcagttcatagcctccttttcggacccagagcttgcataatccttcccttatttctacttacgtgttttactctccatcatgtgttaacatacatactgtgcaacagaaatgactatggaggctgagggcagcagagttttagtgtgtacacatatgagctgtcatgtaattttcaagtgaaagcctttgcaatgaaactttttaaaagaaagtcatggccgggtgcggtggctcatgcctataatccagcactttgggaggctgaggcaggcagatcatgaggtcaagagattgagaccatcctggccaacatgatgaaaccccgtctctactaaaaatacaaaaattagctaggcatggtggtgtgcacctgtagtcccagctactcaggaggtggaggcaggagaatggcttgaactcgagaggtggaggttgtagtgagccgagattgcaccactgcactccagcctggcgacagagtgagactcgtctcaaaaaaaaaaaaaaaaaaaaaaaaaaaaagagaaagaaagaaagaaggaaaaagaaagaaagagaaagaaaggcgggcattaacttcaggtattggtaaatttgctaggtgtttggctactgtttctcatcagagaaatagaaagacacaccatgaaagtcaaggcctgaaaacctcattccatgtaagaatgacatccccagtgttaagtgcttgttagtggttaatgcgatcctgtgaaacttagatgtgtttgtgcacacatgcacgcatatatttgaagaactcagaagagttaaatcacagcctttcaacctgtgaaatgacagtagttcttcttttttcctctccctttggctaagtcatctttatcttggagataattaagacaaaaatgcctctgacaaataaaatcagtatagaacccctatttcttggcagcttttgtggacacagctgaagctttcagaggtcttgaaaaaccatggcaacaaatgcctttgaagggtaagcaaaggttccaaatgtttttaatcgctggtgttttttctgctaccacttcaagcatttttcttcattttttgttcatctgatcaaaattaaatttccaatttccctactaagtggttctgtcctggtcatgccattgactatttccattaaagtagtagagtttgtgcccacatatggttgttaagctcatcaacaattccattagaaagctttgtttatcagtggcaataatttcccataaaaattatagataggttttaatgggcacattttcaaaaggcatcaactcgtcctcaaaattatgtgctgacactgttcttacaaccatggttcgtggcctaattccaccaaatttctctctttttcatagagaactgttgtcagtagctttatatccttttaaagagaatggtctgtatctctgatactcattcagagaaatgagtattttagacgtaggttgctaattttaagctatatactacactatgtcagcactatataggttatcttgtaacctgcttgcctggctatttggctgaaaaataacaacatgtaaggaaaatctatttcataagtctaacatttactttgtaaaacttgttctggctactctgttaattttccacttacgtgtgggttagagagcagatttgatttttttttaagcgaaagatatggcttacctgagaaaagaacatagtggggaaagcactcctattattttcctcatatttccattttcctttagcggaaataaaaagacatttcagtttttcagttgctaagaaatgaaggaaccaaagacaaaacaacttaattattaaattacaatttatttctgtaataagcactcgttctctctgttttcctggggaaagagtatgtggactttcaattttatccaaataagcatcatctttctctgattagtgtggcagtttcaaaatcatgtattaggaagtacagagtgaatgagtagagaatttctaaattagcacccaaggttgggtggctagattatgtttataaatatgaacttttgtattaagtgcaatgatttaaaagaatgcctgcatcactttagggcatttcattaagtgctgtgcacaatatttttccttatacatcataaaagataaattatagttcataaaatagtataaattcctaattattttgtgcttttgacacctcagagttactaataagggatttcgttttaaaatgatatttatttatttatttagagacgcagtctttctctgttgcccaggttggagtgcagtggtgcgatcttggctcattgcaacctctgcctcccaggttcaagcgattctcctgcctcagcctccagagtagctgggaccacaggcatgggccaccacacccaactaatttttgtatttttggtggagacggggtttcactgtgttgggcacactagtctctaactcctgacctcaagtggtcctcctgccttggcctcccaaagtgctgggattacaggcgtgagccactgtgcctggctcgttttaaaataatttaaaagtatattttgccaccactattaaccagttaagccatgatggtatattataatcaccatggagatggtttttctctttattttattttgtttgttttctgattgctagcatgctgattactcttcctattctacaagtgcctgcaggccagccccatttttgctctcttcacttcatttttcatttctccctgtttcactcttcatagcacatttgtactctgtccacacctagagacctccctgttgaagttcttcacattctcttccctagagagggttaacttgttgagctcagagacttaaacttaaaataaaatgtaacagatatgtattgaatgactattttattttagctctaggagaaatgcaaagatatatcatccatagaccctgaaatccagctaagggttctgcttatacacaaggtgaaaggttgtgataatgcacattaaacaatagaagagttaaattcagcactataagtgatgcctcaaagcagcataatgggaaaaaggggtatttcagaaaaaaatggtatgagttcagaggcaagagaaaacagaatgctctagattaaactcaaagactttatggaggaggtggtgtttcaatagatacctttccacagaaccatgaagagagttctacttaattgtaagtggcctgtgatttgtcgttagtcattgcatgctcaattctgcatgtgtgataactgtgtatttttatggcaaaatcgcaattacttttgcaccaacctaatagaatagtgtgggtttaaaaaaactatttgtaatatattcgaacatatttcttatatatatgtttcaccatcattagcagtaaatctattttgcatccagagattgaataatattttgtttctaggatgtgagtgatgtactattttaacttacttttgaagtttgacatgggagtgatattaataaaatctaaagatgctcctaaagaggagcaatagataatgtaggtatagataatgtagctattatggaggtaagtgtatttgatactttttattatgatatgaagggaaacaactagtcccaagctacaatttattaaggtaggcttagcttatacgccataatttttatgtttgcaactttcttgattttcttcctctggctttacttctatgggatatttatgaaaggatgtttttaaaaatggctagagacttttgcttctaagagttgacataaacttttccacaacatgaacaattagtagatgatacacttagatacactcttgaatttttaaaattgtggcagtaaaactgatctcagagaaggaagaaaatgctttggccagcttttatcaattatatacaacgtgtttggaagattcagttcctctcgccttctttctccctatataatactttttcttaaggttggtactattgatgcacttggtgtaaacacatgagataatagcaaaatatgaatctaggtcccagaaatgggcttctttcactctgccacctgttctgactgcatttctcctgactttctgtaaatcccggggaggagctggaagagcaaggtgtgtgctagcataactttggggatgaagtacccttctttttttctgattttgttcccacatctccttactggaccaagtaagggcatcagtgtcaaacttcctgattgaagatacatttttgccctaccatgaagggctctgggtaacatttattgcttataaaatgcttttttggtggctactttgtttctgaatataaggcaagataaaaagtttgattcaagagtttcttgtaaacactttgtgtgtgcgtgtgtattcatatatggctgcacacgtacataagtccatacataagtacagtccaccctccatgtttgtgggttcaacatccatggattcaaccgactgcaaatcaaaactatttggaaaaaaatggatggtagtgtctgtgctgaacacatacagagattttccttgtcattattccctaagcaatataacaactgtttacagagaatgtacattgtattaggtattataaataatctagagatgttttaagctatatgggatgatgtgcgtaggttatatgcaaatattatgtcattttatataagggacttaaacatctatagattttggtgtctgaggagtcttcgaacaaatcccccacagatcctgaggggccactgtatatatatatcttcataaacacacccacacacacaaacacacccacccacccacacacacacacacaccaatgtgtatatacttttttttcttttttttaattcgagaccaagtctcgctctgtcgcccaagctggagtgcagtggcgcaaacttgcctcattgcaacctctgcctcccgggttcaagtgattctcctgcttcagcctccctagtagctgggattacaggcgcctgccaccatgcctggctaatttttgtagttttagtagaggcagggtttcaccatgttggccatgctagtctcgaactcctgacctcaagtgatttgcctgcctcggtctcccaaagtgctgggattacagatgtgagctaccacacccagttgcaatgggtatagacttttgaaatgtgtactacaaaatattaacagtgactatctctgaatgataggattatggataaattttgttctttttgcatatctgtatttttatttttccacagtaaacatcttttacttctgtaataaaaacttcattaaaaaatccatgctgcaattgattaattatatactaacttttttttactcttccctcagtacagaaagattattctgtatttaccaaatctttacactttatttgcaaatcattttgactgtctgtttgcaagaggtcaaatttgcactcaagttcagctttcgttcattatccatgagcccaagagaaattgtgtcaggtggacatcaggtagctgaggccaatacaatattattcctttgggttgttgagaaatcatagcagaggaaagcctgtgttgataatagagtaccaccaggaatctaggtctttacagctgctggcctgaccagcaagggtaaaatatttcagtcacgcagccagtgattattaaccctagctctatattccagagaggaagagctagcctttttgggttgtgatctgtcactgattgcagttgcacatatactagccatgaggtctacacacatgtgaagagcatgctacacacatagactagatacactgactcatcagcctggaaacagtgcctgaccctcactttgattgtttgaatgtgtcctgacccattaccctgcctttggatccgttcctgtttttttttttttttttaaagcattttatctgtgaattaaaatagtactttccattgcttcatttttttttccctgaggagtttagctttgtttaattagaaacaagacaacaatcattactggtctggtgcaatcttgtttaggactcctcttttgcttagaactatacctggattagggatcactgtgatttagagtgtgcagtatgaggttatttaaatacttaatagtatatttgaaatgaaaagagtagaaattaaagactgaatcatttaccaagaaataacagaggagaccaatttacttctgtaagatttagtagaggctgttcccttctttataattggctttgtttcagttaccagttaagtggggtgaactgttattaaaaggctatgggtaaggttacagtagcattcttctaagaaaaactacaggagtagtcactgtgcagctatctgctttgtacctgccaatatggcagtagatatggaagggtcagaaaaacaggacttcatgttcaataacttttcctttttcctttctttcccttatttttttcatgtcttgtatgcaagatagcatgcctattctttaccttcaatgtatttttgaatttttaatccagatcatattttatcacaatttgtaacatgtagctaataaaaatggttattacatgagaacttgctttacaaattatagatcaaatttttatacaaattattatgtcaccatagaaaaatagttacgatttatctgtttagtcttagaaaaattatttcacatattagttaaggcttttagttttgagtgagcaaaatccaattcaaactagctttgggtagaggtgggggtaaaagagaggaatggatttcaatggaaggtttacttgcgtgtcttggctaactgcaaacatggcagggtgcaaccagaccttagtgatcacagacccagggactcagaccctgtgaggaccttagccttaccgccactcttctccatgtgtcagcttcgcgttctctgtctgcaagtatgcattttccctaaggtgggaagcagagttggcaacagctgccagggttgacttcctgtggcattcttgcagttagcaaatattagagaaggactctgcttggcccagctttgggacacacctctggaccaactagctgttctcaggaggcagtaacatgtacagaggtgatccctggggctcgccctgtgaaatcattgtgagccaatcactacctccctccctgatgctgatgtctactatgtttgatgtctctgaacttccatttcctcaattgtgaatggcaccctggttcctaccttgctggatagatgtagtgattagagttcatgcttaacctacaggtgctctgtaaagaatcattggcatcattacctcttgttggctctatcccattccctatagatatctttctgctctgagactaagcagagaaaataatttaacatttaattattgtgcttctaaatccacttttacctcttctttctttacttttctctttattatttttaattatttcaaaaataaaattgtatatatttaaggtgtacaagatgttttgatatacatatacataatgaaatgattactgcagtcaagctaattaacatcaatctcctcacctagttatcatttttggggggcatggagtgagagcacctgaaatctctcttagcaaatttccagtgtataatacagtattgttaaacatagtcatcatgttgtacattagatttctagacttgttcatgctacataactgcaactttgtaccctttgaccaatacctctctattttctccactattccatgcctgaaattgtgggatataggtatatagtgtgtgtgatatatatagagggagtgatatatgtatatataattgtgtgatatatatgtgtgtatatacaaacacacagacatacacacatgtacatatgtatatacatgcacacatacacaatgggatattattcagctttcaaaaaggacatcctgccatttgcaacaacatggatgaacctggatgacattatgttaagtgaaacaagctggacacaaaaagaaacatgcaccttacttcttagacacaaatttctttctcatagccagcacctgaaaatagggccaagtattttgcatgatttacaattgactgtataaatgtagcatagccagttatatgatgtgttaccatttctgctataaaatcaaaagaagagatcagaacatttaaaaacttccctgtggatttctacctcttacctaagctttgttcttgtttttttaaacctcatgaacacgaagctttagatagcggaggtcatgtatccttgggctcaaatatacagtttcttagcaatctttgattgctacattgcccttttttgtgtttttaactggccttccctgacttaaaatatactttaaaaaataacaaaggtggtatttagtttgcacagtatggaattaaaggtaaacaactttaaattaaatttggttggatgtataaattattaaaatatcctttctctcatggctgggtaagtctgcattttccattcagcctgctatgtctctttccatgagaacactcccgaagaatggggccctgcttccaaacaagccaagcattttgtagtaaattttaaaaagctaaatttcataataacctttataattgctacctgaaaatggagtttggaatggcaccaaattattaatcagtagaaggagaatagattgcaaaaaggtaattatatcaaattgaatgcttcttgaaatatattctgttaaataaaatacagttcctcttccctgttctcatttgtaagcaatgaggacaattcaggtagcatgaatcaggaatcagagtacttttctgttccgcagattggcttaatcattttgggctcacttcaaactgtagatgagcattgtcctttaacctgccgggcagcagaggtgaccacgttcactgcaaagcccagaagtgagttgttcatctgggttagggtctcaggaagaggcatgttatgacttccccacattcctggacagtttagactgtaattcttggttgtttaaaaaggtgtttgaatgtattttgttcagaggcttgagtaaatggctcttattcttacacttttttttttgcctgctttttccagcattagaatagtttcagccctgacaattagccttatgctgactggagtggattttttgcgtaggaccaagtgttttgcatgatttacaatggactgcataaatgtagcctaacaagttatatgatgtgaagaaaattacttaagggtaaaaatggattgtttactgagaaaatgatgttattataaactggtttgagggtattgtggtttagatgctgtccttacaaatttgagctctgttggtttggagatttaatatctaataataatagttaatgtgtaatgaatacttgccctgctccaggctctatgttacgtgtcctgaatgcatcatctcatttaatcctccataaaatttgaagcagtcagcattgtaattaatctcacttttcagatgaggaaaccaaggtatgtaagaaacaaaaccagtgttgaatctgactagtacgactgcaaagcctgactcttaaccattgtgttctgttgccttctccaagggaaaggagtgcttccagaaaggccattggaagtgaggagtgtcacctgataatagctggctcctcatcccactaggttaacaggcaacagatgggggccacagagttggctggagttagtcctggttgccaagggtaaatggggctgttaccatgcaatggatagaaactaggatgctcctgtgtgtctccttatatcctaccaggtgtagcatgaaggttaaggacaattccgtcctcttatttggagaggagaccaaggccctgtaggactaaaggtttgggtgagctgaaagccaagggcaattggcccagcttggggaggagagttacaaatacatttgtgactatcagaccagaaacagactgcggtgttcacctgcggtttgggtacctgctgcttgttctttgctggggtatctgaagactgaaaacacagctcacacttagcctttttcctattctgtgtgaaagaactgtagtagttttctcttgcttaacaaggttctagtggtgaagtttattgcttagtctgtgagttgtagggaaataaccacaggatgggatggtagcagaacgagaaaagaaaagaagattgtagatgccaggctggtgtcggcttgaaatttttaaagtatacagttcttctttatggattattaaaaaaaaacagcaaatgaatacacaagattaaatgttaagcagtacaacattgtacatgatgaaaggttaaagtctttctctggtctcattcaaaaatctacagtctcttgtagtatagtttgaagtcaggtagcgtggtgcctccagctttgttcttttggcttaggattgacttggcaatgcgggctcttttttggttccatatgaactttaaaattctgtgatgaaagtcattggtagcttgatggggatggcattgaatctataaattaccttgggcagtatggccattttcacgatattgattcttcctatccatgagcgtggaatgttcttccatttgtctgtgtcctcttttatttcattgagcagtggttttgtggttctccttgaagaggtccttcacatcccttgtaaggtggattcctaggtattttattctcattgaagcaattgtgaatgggacttcactcatgatttggctctctgtttgtctgttattggtgtatagaatgcttatgatttttgcacattgattttgtatcctgagactttgctgaagttgcttatcagcttaaggagattttgggctgagacgatggagttttctagatatacaatcatgtcatctgcaaacagggacaatttgacttcctcttttgctaattgaatactctttatttctttctcctgcctaattgccctgtccagaacttccaacactatgttgaataggatggtactggtaccaaaacagagatatagaccaatggaacagaacagagccctcagaaataataccacacatctacaaccatctgatctttgacaaacgtgacaaaaacaagaaatggggaaaggattccctatttaataaatagtgctgggaaaactggctagccatatgtagaaagctgaaactggatcacttccttacaccttatacaaaaattaattcaagatggattaaagacttaaatgttagaactaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgttctttgctggggtatctgaagactgaaaacacagcaaaagaaactaccatcagactgaacaggcaacctacagaatgggagaaaatttttgcaatctactcatctgacaaagggctaatatccagaatctacaaagaactcaaacaaatttacaagaaaaaaggaaccccatcaacaagtgggtgaaggatatgaacagacacttctcaaaagaagacatttatgcagccaacagacacatgaaaaaatgctcatcatcattggccatcagagaaatgcaaatcaaaaccacaatgagataccatctcacaccagttagaatggtgatcattagaaagtcaggaaacgacaggtgctggagaggatgtggagaaataggaacacttttacactgttggtgggactgtaaactggttcaaccattgtggaagacagtgtggcgattcctcagggatctacaactagaaataccatttgacccagccatcccattactgggtatatacccaaaggattataaatcatgctgctataaagacacatgcacacgtatgtttattgcggcactattcacaatagcaaagacttggaaccaacctaaatatccaacaacaataggctagattaagaaaatgtggcacatatacaccatggaatactatgcagccataaaaaaggatgagttcatatactttgtagggacatggatgaagctggaaaccatcattctcagcaaactattgcaaggacaaaaaaccaaacactgcatgttctcactcataggtgggaattgaacaataagaacacttggacacagggtggggaacattacacactggggcctgttgtggggtggggggaggggggagggatagcattaggagatataactaatgtaaatgatgagttaatgggtgcagcacaccaacatggcacatgtatacatatgtaacaaacctgcacattgtgcacatgtaccctagaacttaaagtataataaaaaatatttaaaaaatctacagtccctttctcaataggtaaacactattaacaatttcttctgaaaattacatatgtacacacacacacaccccacacatagatattttgttaacatacattaccttatgctctacacattattctgtgcctagcttttctcatcgaataatgtgtattggagatctttccatataagtacatattggtctcactcattcatttttaatggctgtatattagtccatagtatggagtaataataccttttattggcacaaagttttgcagttgacaaagggtttgcatatattgtttcattgggttgtatagcagtcatcaacggacatatcaagaatcccagaagggtaacctgggcttcacccaggatcgcatggagcttgggactcaaacagctaacattccctaaacaggcccatattcctgcaatttagtgcagctgctacaacatttaggtaaactctttgaaagcagtaaaaagatcaccaatctgggacatcaagaagccagacgacaaggagacatagacctcaggtgagtgagaaaagagaataattgaagtttagaactgaatgggcactaacgaacaacagatacatctctttcctttcaccgatgaggacctgggtgtggcctgtggatgttaagtagcatgtttaggccacacagctggattgttttctttcctgaggctagctctggagaggggaggaaacggagatgctagatttttccgggctctcttttctcatcagctagaatgggatgtggatggaatgcagcttgagaagccaaacacccttgagaaatgagaactctgctttctgatgtggggcgcatcctatctgagataactctcctgccagcgcagtatgaccattgcgacttgagctgtgtgggtgcccaggtggtgtagaccttaaaaccactcctgcttttgtttactgaatgtctaatattcacacagttctttgtctgagtgcagggccaaagcagcaaataacgaagaagctgtgcccaaccataagaactatgaaatgctccagatcatctacgctagtttgagttaaatttaccatgcaaataaatatagaacatttcttcttatgcatagattgtatttgttctattaaacaaccatcctgtaaaggttttattcattcatttatttttatttgttaggagaaattgttatttaagctaagaaagtagactagtagttatttctttttttttgcttattatactttacgtttggggatacatgtgcaggttagttacgtaggtatacacgtgccatggtggtttgctgcacccatcaacctgtcatctaaattaggtatttcttctaatgctatcccttccctagccccccaccccctgacaggccccagtgtgtgatgttcccctccctgtgtccatgtattctcattgttcagctcccacttatgagcgagaacatgcagtgtttggttttctgttcctgtgttagtttgctgagaatgatggtttccagcttcatccatgtccctataaaggacatgattgcatccttttttatggctgcatagtattccatggtgtatatgtgccacattttctttatccagtctatcattgatgggcatttgggttggtttcaagtctttgctattgtgaatagtgctgcagtaaacatacgtgtgcgtgtgtttttagaatagaatgatttataatcctttgggtatatacccagtaatgggatggctgggtcaaatactagaaggctacagtaaccaaaacagcatggtactggtaccaaaacagatatctagaccactggaacagatcagaggcctcagaaataatgctacacatgtacaaccctctgatctttgataaacctgacaaaacaagcaatggggaaaggattccctatttaataaatggtgttgggaaaactgactagccatatgcagaaaactgaaactggaccccttccttacaccttataagaaaattaactcaagatggattaaagacttaaatgtaagacctaaaaccataaaaaccctagaagaaaacctaggcaatacaattcaggacataggcatgggcaaagagttcatgactaaaataccaaaagcaatggcaacaaaagctataattgacaaatgggatctaattaaactaaagaacaactgcacagcaaaagaaactatcatcagagtgaacaggcaacctacagaatgggagaaaatttttgcaatctatccatctaacaaagggctaatatccagaatgtagaaggaacttcaacaaatttacacacacacacacacacacacacacacaaacaaccccatcaaaaagtgggtgaaggatatgaacagacagttctcaaaagaagacatttacactgccaacaacataaatatgctgccaacaagcatatgaaaaaaagctcatcatcactggtcaagagaaatgcaaatcaaaaccacaatgacatactatctcacaccagttagaatggcaatcattaagaagtcaggaaacaacagatgctagagaggatgtggggaaataggaacgtttttacactgttggtgggagtgtaaattagttcaaccattgtggaagacagtgtggcgattcctcaaggacctacaattagtagttatttctaggtctgacgggctgtcttttagtttgttttcttattctgaggtggacttaaaccaattttaaaaacagggatgactgaattcgtgtgttaatcttgtactacaggaaccctttgacattgattcagaagcacccaagtgtttgttcattaatccttttttatttttgcatattatttatttttcaacttttattttaaaaatcaggggtacatatgcaggtttgttacaaaggtatattgagtgatgctgaggtctggcatatggatgaatctgtcactcaggtaatgagcatagtacccaatgatagttttttgtacccaatgatagttttttgttttctttgtttttttttgtttgtttgttttttgagatggagtctcgctctgtcacccaggctagagtgcaatggcttgatctcggctcaatgcaacctccgcctcccagattccagcaattctcctgcctcagcctcccaagtagctgggactacaggcgtacaccaccatgcccggctaatttttgtatttttagtagagatggggttttaccatattggccaggctggttttgaactcctgacctcaggtgatctgcccacctcggcctcccaaagtggtgggattacaggcgtcagccactgtgcctggccccaatagatagtttttcagtccttgcccctgttcctccttcccacttctagttatcaccagtgtctattgtttctgtctttatgttcatgtgtaccaaatatttagctcccacttataagtgagaacacatggtatttggttttctgtttctatgttagtttgcttagatagacctccagctgcatccacgttgctgcaaatgacacgatttcattcttttttatggctgtgtagtattccgtggtgtagatataccatatattctttatctaggataactgatgggcaattgggttgattccatgtctttgctattttgagtagtgttctgatgaccatatgggtgcatgtgtcttttcaatagaacaatttattttcattactcttatcaggatacctgggaggaacttctcctacgaagttaatttggggggactcctgaagatgagtgaaaccccttattaagcacttagagggtcgaaagtgtacaagggaacgttcaggtgtgacagcttgagagacatgcatattccacccccacaccagagcttagtgaaccgtcttttctattttctcccaaagcaccaaaatggcccagaaattggaagatggaaaatggacttatttatgagtctgggaaggcagggcagtaagcacagtcctgttcagggttctgagttttaccctcttgctctgattgcgagatcattttcctcttccttgcttcttcagcttaggacaagaacagtttggaaattgtttctactactttggacaccatagtttagatttcaaatgagtacaagtgggaggaaagcttggataattctctggaaataatcgaacagagtgaaggagaggggtctacaggtgagctgaatgctgcatggcattgaagtaatcacaccagtcgtcacaattctctcctctttgatggttatctgttgtcccagaaggaacaatttcagaaagtccttttctggactgtagaatagcacttgcttatttgatgagccctgagaagcattactgaaagcggttcattgtccctgaggtattacaatgagatggtggtcactgatttcattatgttttcctttattgcagctgttggtttgatcctttgccaggtgcttaaaacaattgtggttttgcagatggtaagttagaggttggacaaaaaaagggatcatgtcactgccctggccaaaatttcaacagactggggtctagtgagggcaaatagatagaggctttcctcttcactttgtgttatttagaaaaagaaactttccaggacaaatttctttcctagaattccttttttaaaaattttttttctttgaaaatttacttagatgcaaataatatatttttcttccttttaaataataaaagtaagatgtctcttggaggtggtggttgtcactgacaagattaactagaactgactagctgtaaaaatataatttgggatgcattattaaggcatgccatttttatttgcatgccattgtgtacagatgtggttgtgaaatagttcaaatcatggcacattgaatgtcctcactggatttttaggaatgtgttcactgagacagccaaatcctatttcattttctttggctcattgcattggctgtaaattggagatattcactttaatatgtgagtcaaaatttatttccaaacataatactgcagttgttctgtcacagaatataaatttcttatttatttccttaatacgttgctttctactttttctttttttctttattttattctggagtatgtggaaaggttttccagaaagatttgcatatgccataatctactgatgaatactttttttgggttactctttcatattttgggagatataactatggaagtgttaggaatcatgggttctggaaatagttttattactgcttctgaaatgccctcccaatgataccatatagtaattccatcagggaataatatttttattatagtttaaaatataacttaatatttaggtgctcttgttcagtcatcgtcaagttctttttatttcaccaaccctaccatggcactcctgaaagacttgtgaatgcgacagacctggatttaatcatggctttgccatctgctagccaagagaacttgaacaagtgagtcaacttcttggagtctcattttctgcttctgtaacatgggaactagggtaatctaactcattgcttgtgatgattagatgaggcaaaatgctgagttcacctagcccagcacctggtccatgggaagcatgtgggttctgctgctacccagtccttggcccagtgcatggtgcacagaagggaatctgaacaggccaactttattcctattcttgacccaccccatgtagatgcttcctacatcttcagcttcttcttcttcttctttttttttttaaggcagggtctcactctgtcccccaggctgaagtgcagtggcacaaccacagctcagggcaacctcgacctcctaggatcaagtgatcctcccacctcagcctcctgagtaactgggatgacaggaccacactaccacacttggctaatttaaaaacttttgtagagctggggtcttgctatgttgcccaggctggtctcaaactcctggattcaagtgatgccctcacctcagcctcccaaagtgcctggaaaacaggcctccacacccagccttcaacttcattttaaaaaattgtggtaaactatacaattcatccatgaaagcagaaaccacttgtaccccaaaagctattgaaatttaaaaatatatatattaaaaataaaaataaaattgtgataagatatacataatatgaaatttactactttaatcatttttaagtgtacggttcagtggcattgagtacattcacatttttgtgcaaccggaacttttcatcctcccaaagtgaagctctgtacttattttttattttattttattttttgagatggagtttcactctagtcgcccaggctggagtgcagtggtgcaatctcggctcactgcaacctctgcttcctgggttcaagagattctcctgcctcagcctcccaagtagctgggattacaggtgcccaccaccacacccagctaagtttttgtatttttagtagagacggggttttgctatgttgggcaggctggtctctaactcctgatctcaggtgatctgcccgcctcagcctcccaaaatgctgggattacaggcatgagccactgtgcccggccagctctgtgctcattaaacaatgactccaagttccccttccccacatctcctgctgacctctcttctactttctgtctctgtgagtttaactattctaggtacgtcatgtaagtgcatctatgtgatatttgtccttttgtgtctggcttatttcacttagcataatgtcttcatgattcattcatgttgtagcatgtgtcagagtttccttcctttttaaggctgaataatactccactgtatggatagaccacactttatttatccatttgtctgttgatggacatttggatgatttccatcttgtgggtatactgagtaattttgctatgaacatgggtataaaaatatctatttgagtttctgctttcaattattttgggtctacacctcaaagcggaattgttggaagtggaattgctttccacttgttggaagtggaacatggtctcccacttcattttgacacaacttccaagcttcagaactgtatttacaacagcgtgctgggaggtcgctttgagtttatgacggaaatctcatatcaacaggttttaaattgttccatacgacttcttgccacccctgtcccaattcagatcttttttttgattaatggtatgaacaattttcaaaatatcctggcacaatctattagaatatttgactttctcctcctcctccctttagccctaactatttggcaaagctgttgaaaacttcttcacatcttctctctgcctcatctactttgctactcaaagatgattagtagatgttttggtatgattttttttccttggcataactgtgaatacttttaatccttcatgttttatgacaatcatacattcccacttttgtgtaaaaacattttgaattcttctttctataacaaattctttgccagtcttccttttctttttgcttttagtgagttccaatgatatcattgtttgaacctgttttctaattctatgctgctattcccatactccctctttgctttggttacagtagataatgtgggtggtcctaccaagacaaagcatcactcaggagtcaagggctggggtagatacagacactaggtactgcagaaagtcaatatctttctcagagtgtaaggcaggacaagacttctgttcccttgtaccgttgtggctggggagttggactgtgcatttcatccttgtcatataagtcaaagtattgcccaaataacttaattttggtgtggtcttagtaagtatttgtctcgtagatatgttaaatagaagacagtaacattgggttggctgtgttaattcctcactttttctttcctatacatgagcttcctaagaagcggaacacttggtggtcagacagttgcagagattccttgcatgattgcaatctggaaagtagataccattcttgaatgaagagcttgccctttggagaagctgggctttccatatatggaggttgttagaatgcataagagttcagcttctggaatgaaaggagaccttggttcaaaacccatctgccacttgcttgctgtgtggcttaaatcaggcttttaaacttcaattataattttgcatctgtataataggattaatataattccttcctcataaagttcctagggggttaaatgaaacaatcaatgtataacacacttcctggcatgtgatgttcagtacctagaagactcggtttccttggtagagagaatatttggctagacaagcttatggaattacccccagataggaagtgagcacaagtgtgaaatgaacaagccagagcaggaacggctcttggaagcgtctactcaggcctgggcagttgctggtttatataacagtgctttgaaaattcacgtgcagattcttactattttcccaaatgttacagctcaaaactatgttgtctgtaccttaacacctaaaggataatatagtctttcactgataaaactaaaatgtcataggttttcctttggccaaatatgtatagaaacttgtgatttcacatcagatttaaagctgtatttaacactctatgaaaacatactgatgcttagaagtagaaaggaagtcagattttgacatcttacttgtcaacttaaattatttatagttcctggatgcttcaaaatgtgataaaccatagttaattttatgtaaatattcgatgagtgcctttaataaggagactgtaaaggtagccaagctttatatatgttagctacatttatgggtcaatcgggtataaaaaataggacttcgaaaataaaatattattttgtcggactcctccaatgaggctttttcgcaggattagctaaaattggctcttatttgatgtgtgagtgcttaaacattggagaattcatttttcttttagaattcatttttatttctgagccttaaaatatgaacagttagctaaatgtttgtatatgttgataaggaatgctaagtgtttattccttaatgggacgacaccttttcccggtttacataacttgccttttaatctaaccttatgaaagtctccttgactttaattttttttcagagtactgtatatctctttagggaatgcatttatttaaaaaattataaagcaagaatagatgtgatatattttgaagttttctagtcacaaattaaatccctagatgtgttgtagtttgtggagcactttgaaatgtgccaattcaagatggaaatagcaggaaagaaccattcaagtacgatttctgactccataaagttaggaagttatgataaaggaaaaataactacaccacatacttatggcacagaattgcattattgggacaaattgatcttcaaatttgtaggctatgatggaagcaaatatttgtagtatcttaatattcaactgttaagccaggagacgagtactctgaacttcagcttctcataaaatcagtcagttacatgacagtttatgtagtttatatgtaagaaaccctttgatcaagatatgccttttcttcagccttgttaatacttcatttataaggatttttatttctaggaaaataataccatagacctattttatttaaagctaaagtgtttcctggtgatggtggtgaatggggagatgattcaaggaaactgctaatcttgtagagtttagtaaaatcttggaatagaaattttaaaaagttaaaacacactatgaaaacaaatcattattagtaaaatgaaccatattaaaatgtctccataaccaacgtattatagcaggggaaaatggcattttaattcagaaaaacatttctatataaaacaagctttggaataatttgaatatgttgatttttctttggggcaatcatgaaatacagtcatattaggaaagaggcaaggcctcaaaacggaaagagtagtgaggataattcatgagcaatgcgtggcttcatggatcccttcctggccctcttcatctatgaacatctgctttatgttcatgtctggcctcacccagtgctgaagagcagactgcccctgcttagaaccaagccttgttcttgtggatttgagttttggggtcctgaggtagaatggccatcatattgttcagggtcctcaccttcccactcattacttcctttatagaaccccagtcatccccctcaggaggcctgcgctccacaaatgaagttgggggtgaggggagctttagcatctcagtattgttcagatattggatacttgttgagctccactatgtgtgtgagaatgcgctgggctcaggatcaatagccataaatgagacagatatggcccatcccttgccatgcctaaactgatctgggcattgagacaagcagttaaaacccaacatagtaagtcctatgatgagacacaaactaagcatggctggaagggcagataagatttcacagaggaactgacatcttgactggcacacttagaagatgagtaggagtcagttgggccaagaggagaaaaagtgtgtttccatgaagaagaagagcatgtgccaagtcctgggggtgagaagcatggcatgtgtcaacagaaagacatgatcagagcttggatgggagttagagcggggagagaaggcaaggaaaaacataagagctttgcaaactgtgaaggcattgcatttagatgtcatttttagagcttggaggagcctcaggacattgaggcaggatagtggcctgatggcgtatgattttaggaaaaatcactgtggccaccctgtggggaaggattggcgggggaaggctggaggcaaagggtcctgcggtgggctgtggtaatgatctgggctggagaaggtatggtggtgcccagcgcaaaattggtttcgctttgaaaaataattagaaaatatttgttttgatctgtgtgcctgtggtgggaggtggggagggagggtcaagtgaggaaggagattgaatctagaataatgcccatgtttcaggcttcacgtgcagacatttcttggttcagctgggaagtgaataggaacagactggcgaggaaagaagacagtcgtcagttctgtctggggcacatccatcttgacgagtgtgagagagtcaagtcttgatggacaggggcaggtggacattcaggaaactcaggaaagagatttgatctgaagtgaccaccagaaaatactgacggaaaagaggtgacaaaaggagagacctgcaatattatattggctttctctcaggcaactgcttggcctgtctttatattccttttgaatctctgcatatgtacgggccattatttattttcacaactaacaaatgcagactttctgtgtaatgacaacaaagccaaaccagctgctaccaaaggagggaaaatcagaagagaaggaaaaagaacaagggaagcttggggaaaagctgaatgtgggtccttctgttgctgcaggggctggggtgggcccggtgattcctactgagaggcgttttctctccccgcttcctgtctttctggttccatctcattcacctcctgtcccctccacttcctgccagtcaaaccttagattcctccagaggctttttatttttatcttttgatgggcaagaaaatagtgcggattatttttccaaaccttcacctgaacatcacatcgtggctttggccctatgggcttggttcatccgggcctgcacagaaggacttttcgggccagtctggtcacatacatcgagtcctgtcttttcagttaaaaaaaaacacacacacacacactgctatgtttcactaagacaactggtgtgagttgttttttagaaaatcaactctacttcagtaagattttctcaagcattatcttgagaagaccagataataaaatttaaaaagaatttcttcttttttttttattatactttaagttttagggtacatgtgcacattgtgcaggttagttacatatgtatacatgtgccatgctggtgagctgcacccactaactcgtcatctagcattaggtatatctcccgatgctatcttaatgcaacttaaatcaattgctttaataacacatattgaccaagttacactcattaaggaaaaaaaactactttgttgtttttcttcttctgacgtgagctgaagacttagaaatagttgttaatagtgtttggttaataagaatttgttttaattgcatatatcaaatatgtatttattaaacttttctttttgtcagtttatcaattctagctttgtcacaaaaggtttgccgtatgaacatgattctgttgtacatctatttccatttttgttaagagacgaattcaattgtaaaaatctagtaccttttattcattaaacatgttagttcaggaatttcacttggttctacaaagatacatatctacagtggatggccagtgcaaacatgagactcagccaactggtctctgacccaattcagttctcctgtcttcttctggcttacaaagtaactggctctggggagaaagtgagtcaaagtaatatttggtttgaatggttattgactattttcttctgaaacttaatgtatactaattaattttttattttattcttttttttttagagatagggtctcgctctgttgtccatgctggagtgcagtggtgctatcacagctcactgcagccttgacctcctgggctcaagcgattctcctgtctcagcctcccgagtagctaggattacaggcatgtgccatcatgccaggctaatatttaattttttttttttgtagagacaagatattgttatgttgcccaggctggtctaaaactcctggtctcaaactatcctcccacctcagcttcctgaagtactggaattataggcatgagctgccacacctggccatatactcattttttgttaaaagctgaaatatatcagcatatactgcataaataccacaggagactaaacactgaaagtttctttagggtatcagaagaatacactttttgcttgcagttagcatctgcacagataagttttgtttctggttctattacttcttcagtttgaccctattaataaggacaattctaaaaataataactgtgtctggatatctgaatccgtgtgtggtcttttactgaagttacaggtttataactctgctgactagtttgctggtttctgttatgcaatagaagagtgcaaatgttaatttgatctgaagcccgtgtatacagtgacttttataatgtatatttaaagatggaaagccaagttttatgaggccagcatttcttgtcaagtcctcactccaccctcttctaattgggcctgacccttaagttgaataaagaacaaagagctctgtagttaaaacatttcactgcatgttgcatcttgcccttagtaaatggaaaaaaatagagacttaagcagagaatctgaactagggtgtgaaatatatattcagttttggggtgggagaatgagaaccatgttttacaatagtatacataacttccttagtctaaattcaggacatttccccaagatatgtaagaatttagacttatgcagacagactttataaaaacatgccaatatttattagtttgtgaattttaatattctgctccctataaaccagatttattttgagggataaagggatggaggtgacttctaaatcttagagcagaaacttcctgtgggcagctggacatatgtaccaggagctcagagaagagggttgtgttgggagcgtacattctgagtgatctgcatttggtgatgatggaagccatggacatgcactagattgtcttgtgggagaatatggagtagtaagagaagaagaagacctaggattgagccctgagcacctctggcttaatgttggatggaggaaattgaatctgtaaacaataccgggaggctgcagcctgagaggcagaaggaactggggtgtttgggattatggaagccaagggaaaaagcctgtctcacagcgggaagggaggtatcaacattgtaagctgcttcagataggttatgtaggatgtggactgaaaaatacctgtaaaatttggcaacgcgattcattggtaatcctagggaagttgcttttttggggtaactaaggtggaaaacagattggtgtgggttgagcaatgcaagagaggtgaagaaaaggagatttcatgtgcagacgtttctgagttcagctgggaacaagggataagatagaagatggaagttagagagcatgtggggcaagggagactcttttatgggacagtctcgcatgtgatcaaagccaatgagtaaggagcatttgagggagagagagtcaatcaacaagagagaaaagaaagagggttcatcataaaataacggtaacaacaacgaacatcttttgagtgttttctatatccggggaactatggtaaactcctaacctgcattctcacattcaattcttagaatcgttggatgtggtgggttccatgatttcctctagattagcgaggaggaaagagagatctagaaatgtcaggtagcttgctcagagttctccaggtagtcagtcatggactaatttgtgaactgaaggactgaacttcgtcaccacccagcccaccaagccggcttgactttaggtattctgtgctgcatgtgagtaccgacttaaattatattttaagaagggctactttgaaactctctctctgaaaactctatttctaaaagctctaccctcacaacaattttggcaagcagtcttggtaaaaccaaaccaaaccaaaccaaaaccaaaaaaccttatctgctgagaaaatataaccacataaaatatggtgctacaaaatatagactgtgtgaactgaaggtgacttgcccaaaggactcctgaagcaattggctgctgtagaaattaagtccacgggaggttttttgttctgtttttttttttttttttttgagatggattctcactctgttgcctaggctggagtgcagtggcgcaatctcggctcactgcaacctccgcctcccgggttcaagcgattctcctgcctcagcttcctgagtagctgggattacaggtgtacaccaccatacccaggttttttttgtatttttagtagagacggggtttcaccatgttggtcaggctggtcttgaactcctgacgtcgtgatccacctgcctcggcctcccaaagttctgggattacaggcatgagccaccgtgcccggcccatgagaggttttgtttgcacttcaagaaggacagaaaaaggcaggcaggctggggagcaacatagtaaggctgaggaagtgataggaaaacagcctccaaaaggtttccctgtagattctgactggctaagtttcctgaaataatattaattctgtcctcttgcttttaataggacataacgactatatgtgtccagccaccaaccagtgcaccattgataaaaacaggaggaagagctgccaggcctgccggctccgtaaatgctacgaagtgggaatgatgaaaggtggtaggtacatctctcccaggggcccttggggatggccctggccaccgcccagtgctggctctacccattggaataacaccatgggaattttgtgtttttttcttttaattgttttttttctattcttatttttctttgcaacaaaagtattttcataatccattttattttaaaaaggtggaagtgtctggaactggaaattctaacatggcattttgtgttttggattttcaatgtaaataattatattttaaatcaaaggtgtgtgggaggcggtgatggaaggaaacgaagagtgcttagtaaattattctagaaatatttttcagttactgtttatgttgcaaatgctagaaaatgatatctgaggataaactttccctaaattgagacttgtaaatgtgaaagctgagtagctaatttatagccttccagtctgttatcatcccttaaggaatgtgaatttcaatcaaaaggcagttttctcctttagaacctgagtgaaccagccactttcttaacctcagtgtctagcatggtgctggcatagttgattactgagcactacactaacaagtgtcagagcatgcatggtttgtgactgtgggtttgtgtttttgtggtctttgtggctgtgtgtgtgtgtggttttctgtcttctcatgtatccgatcttccagttttgtcatacaggaatctggaaactgaatcccagttctgggaatattaggagccccataaatgtggttgcctgattgacctcattgtattcttgggagtctcatcttgaggaacattgcttctagtcttggatagccttcagtgtagtggaagagaacaagtagaaaatgtgtaattaaaataaagtcatgaggctgaggtgggcagatcatctgaggtcaggagttcgagaccagcttggccaacaaggtgaaaccctgtctctattgaaaatacaaaaattagctgggtatggtggcgagtgccagtaggcccagctacttgggaggtggaggcaggagaatcacttgaacctggcaggtggagggggcagtgaactgagatggcgccactgcactccagcctgggtgatagagtgagactctgtctcaataaataaataaataaataaataaataaataaataaataaataaataaagtaacggattcatttagtgtttcagaaggatactgaagggagggaagggctgatgatggtgctacctgctgattgtaatagggaaaagcccgtttcttttctgaaggaggtgaagcttggggtgatttaaggagaacaaaatttcaatgaaaaggaatagtgattttgcaaatagtgggcagctaacctttaaatcattcttactgggacgcaggaggaaggagaggaaagaccaagaatggagattatgatgaagacaagcttgattgttaacaagcttacagtgacaggtttcatagtcccggggtcataaatacgccagacaggttgaggtttggaatgcagcatttggaataaattctcctggtgaagagatgcaatgttgaatttacgcattctgtgagctgtgactatgactatacatcttgaacatctgaaaaagcagctttaattcaaagggtaattaattccaagaatttaacagctacattcagaaaatgacacttgagtcatatggattaaatatttaaggaattcatctttctttgtactgttggagaattagtcaggcttaattaaacttacaaaatgcgtcttaaggtaacttggtaagtgacaggaatataacagctgcataagaaaagctttatttgaaacagtggagtcgaggtttaatattcttctttggcgattatatgtaggttaagcacaggctcttccatacattctccttgaaagctgaaataatcaagtcatgaatatgtccaaaacaatttttaaaatgtgaggggtacccatgcattgaccccatttcataaaaccgattctgtttttttttttgtaattaatatccagatacggtctggctgcatgaatataaattacgcattctcatttttaatctaacaaaaattcatatatgcaaagacataataaaagtctccccactgttttctcctaggaatctagataatttgactgtacacaacagactgtggatggctccatacacacttgcacatgtatattgatgactgtaaaatatatatctgtattagttttctagggctgccataatgaaataccacaggctgggtggcttaaacaacggaaattaattttctcccaattctggaagctggacatgcataatcaaagtgctggaatatttggtttctagtgagccctcccttttttttttttgagagatggagtcttgctctgttggccaggatggagtgcagtggcactatctcagctcactgaaaccttcacctcccaggttcaggcgattctcctgcttcaacttcccaagtagctgggactacaggtgtgtgccaccatacccagctaatttttgtgttttttttttttgtagagacggagtttcactctatgttggccaggctggtcttgaactcttgacctcaggtgatccgcccacctcggcttcctaaagtgctgggattataggcgtgagccaccatgcccggcctgtgaggcctctcttctaggcttgtggctagccgtcttctgcctgtgtcctcacatggcctttcctctgcgtccgagcactcttggtatctctttctcttctcacaagccctgttggattaggagtccacccttatgacctcatttaaccttagttaccgccaaaaaggccctatttccaaatatagtcataccaggggctagggcttcaacatacaagttttgtggggacacagttcataacaggctgccctcccaaaataccatagactgggtggcttaagtaacggaagtcaattgcctcatagctctggaggctgaagtctgagactaaggtgttggcaggtttgatttttcccgaggcctctctccttggcttgaagatggctgccttctctctgtgtccccacatggccttttctcggggcatccacagcttcttcttcttcttacgaagacaccagtcatatcggattagggccccacacacaggacctcattgaatcttaatcacctcacttaaggtacaatttccaaatacagtcacattctgaggcccagggggtaagatttcaacatatgagttttaagggtacacaattcagtatgtggcaatatcccataggggttactcagtgattgttcagtatttctttacatgtaaggaaaacatgtatctttctggcagtttttatatgtacataagttttaaatgaagctttaaattcataaaattatagcccgtgagaacatcttattttaatgatatgtataaagtacttgccataaatcaatataatttattgtattttctacaacatggaataccacacatggccacaggataccctctataacaactccttgaaaaatcccattgaataaagccttaatttacaactggaagtacaatgataactaactataaaatgtgcagtcacatggcaaaggccagctgtgactgaataaatctttacaacatgttttcaaccattagggttcacaacaatccactttcttaaccaggctggttaccaactaggatattgaaactctacctatgaaataaaaagtttagtttcagttaaaagagaaccacagacctactccctattttcatagcaaggctgaaaaaattcactgaagatctattgtaaagatccaaaagagtgcatgatttgtctccatgaactaacaattttaatctgttataatacttactgcctctgaaaatcccagcatcattattagatttggttctgaatcatggtagttctataagatgcaggatttgaattgcactttcgggaatgtgcttttctatcctagtacatgtgctggtttctctgcattgctttttcctcttcatttgtctccttcctcttgaactttaggttgtagattacatgtctcttcttcaggaaggcctacacagttacctgacagttcctgaggctcgaagttcaaaatcaaggtgctggaaaattcatgttctagctttaatggcaaacagctcttctcttagctcttatcaccattattattagtcattcaatgtctgtctttacatatggtccataaactccatgatggcgcgggggtggggggtctctgtgtcttgtttaccgatcttgcatgaaacaagtcacaaggtaggtgttcaagaagtatttttttgcactaattaatgaattgattcaattcatttaaatagttatttgtgtagggcttcttatatgcaaacccttgggaataaagcaaatatgaataagattgtagtcccttccctcaatgtcctcacagtataaagagaacatttgcatgggaagcggcaaataaaaatctcaacggcaagtggagactgggttgcaagatggctcaaatattgaatgatcagaatgggagtctagagctttaaacaaccactcccaggtttagtccaactcagagtattactcagacacctgacatccaagacatatattattactcaagaatgtggcctttttgctgagtttggtagaaagaggaactcttccaaagataaatgtgttcaaatgctggctcctcctcaaacttgctgaacaaccttgttaaagtcacttttatgagcttcactaatttcaaatatgaaatggagataaataaattttattgtccaagcacggtggcttacgcctgtaatcccagcactttgggaggctgaggtgggcggatcacctgaggtcaggagttcaagaccagcctggccaacaaggtgaaacctcgtctctacaaaattagccaggtgtgatggcagaagcctgtaatcccagctactcaggaggaggaggcaggagaatcacttgaacccagtaggcacaggttgcagtgagccgagattgcaccactgcattccagcctgggcaacagagtgagactctgtctcaaaaataaatatataaataaacaaataaataaattttacttaatgagtttgtcatgaagatgacaaatcgtaacatgggaaaatataaatctaaagtgccacacaagtgttagctattacatatcttttttgtcttaaaaataattactatcttagttaaaaatttcatcatatacgagcactgctgggttttttttttcagctgaaagaaagagaatggcaatttcatcacttctacaagatataaatttctaatttctttgtggagaataaaaacttggcttaaacacctaagcttttttttcttttctgatctcatatgctgaatatagctgaatgacaagtgagatgtgttatttatcattttatgatgccagagatttacacgaatttgtgaaaggttttttcttaccatagattcagaggcgtgtttgaggcaaggttttcattgtgcagtgaggaaattggcacatagaaatcaattgatgtgcaggactcttggactgactattctggttatgtttccttataacacattaagaagaaatttgagataaagtagtaattgtcaactagtctttatttattttaataacaaatgttgcagtataatttttagaaatattccaaaataacaaataaatccaaaaattaacgggataattttaaagtgagaaaataacatactactaatatagacagggaaatatacatgtgtccagaatgattcagaagcccaatgaaacactggaaaataaaatattttcctgttgcttgggtttaatatttatcactatgagttatcgtaatttgctttattgatggataaactcccaacctggggactgcgattggaatcctctttaatcctacattggctatcctttatcaaaagtaaacaaccggctggccatggtggctcacacctgtaatcccagcattttgggaggccgaggcgggtggatcacctgagatcaggagtttgagaccagcctgaccaacatggtataacctcgtctctactaaggatacaaaaattagctgggtgtagttgtgcccacctgtaatcccagctatttgggagcctgaggcaggagaattgcttgaactcaggagacggaggttgcagtaggccaaaatcacaccactgcactccagcctgggtgacggaatgagactccatctcaaaaaaaaaaaaaaaagtatacaaccaattattaatgttcatgatggtagaatcaaattaataaattaaaaatgtagatgtgaattactttttttggattgccgaataattgtggaagatttgtagctgcatgtgaatccaagtttcctcaaaaggtaggttggggtgctcctatttaggattgaatttaagaaaaatgttaaagaaaagctagctgctctttaccaaagagagactggttgttttaagcagtaatctaatctatatatttatgatattgaaactattattttattaattcatataatagatatttattaaaaactccccatattataattttttatttgcaaacaaatatactgaatcaagtaagtgaatcacatatggaccttaaagactaatgaatccaatgtttgacagtattttatatcaatcaagctctggtttccacaagcagaagcagatcgtcatctatgaaacagataaaagttgatttggcataccctctctttattcattatgatgttcatgagaaaccttcttagaaccctagggctccaaggaacacagtttgcaagccactgatctaatctaactccttcatcctctaggtatgaaaatcaaggccctccattacctattagggatgaaggcaggtcagcctctgtgactgtcagttcagctggaggaagcatgagtgtaggcagcacaacaatccctataaggaccatgttcttaagctggttttttttttcctagtagtttttacagtttcaggtctaacatttaagtctttaatccaggttgagttgatttttgtatacggcatgagataagtgtccaatttcattgttcggtgtgtagatatccagtttctctagaaacatttatcaaagaaactgtcctttctccattgtgtgcttttagcagctttgtcaaaaattaattggctctaaatgaatgaatttatttctgggttctctattctgttccattggtcaatacatgctgttttaattactatagctttatagtatattttgagtcaggtagtgttatgcctctagctttgttcttctagctccagattgttttggctattcagggtttttttgtggttccatacaaatttttggattgtttttccacttttgtaaaaaatgtcattgcaattttgataggcattgcattgaatctgtagattgatttgtgtcatatggatatttttaacaatattaattcttccagtctatgtatggtatatctttccatttatttgtgtcttcttcagtttcttttattgatgtctatagcttttagcatacaattctttcacttccttggttaaatttattcccaaatattttgttttatttttatagctattataaatgaaatttcttcttgatttctttttttggatagtttgctgttagtgtatagaaacactactgatttctgtatgttgattttctcttctgaaactttactgaatttgtttattagttctaatagttttttgtgtggagtctatacttacatgatctatgtgtaagatcatgtcatcagcaaacacgggcaatttaacttcttctttttcaatttgcatgcctttattttttttcttgcataattgctctggcaggaactctcagtactatgttgaatagaagtggtgagagtgggcatccttgtcttgttattgatcttaggggaagacttttcaaattttcaccattgagtatgatgttagctgtaggcttgtcatatatggcctttattgtgttgaggtacactctttctatatttaatttgttgagagtttttgatatgaaaggattttgaattttgtcaaatgcattttttcctctattgagatgattgtatggtttttgtccttcattctgttaatgtgtgtaccatagttatagatttgcatatgttgaaccatcgttgcatccctgggcaaatcccactcgatcatggtgaatgattctttttcatgtcatgacaatcaattttgctagtattttgttgtggatttttgcatctatattcatcagggatattggcatgacatttaattttcttgtaatacccttgtctggctttagtatcacagtaatgctggccttgtaaaatgagtttggaagtattccctcctcttcaatttttgggaagagtttgaggattggtattagttctttaaatatttggtagagttcagcaataaagcccattaggtcctgggcttttcttccatagaggactttttattgctgattcagtcttctttctagctattggtctggtcagactttctatttcttcatgattcagacttgctaggtttatgtgtctaagactttatccatttattccaagttatccaagttgttggtgtgtaattcatcatagtactcttataattttttgcatttctgtgctatcagttgtaatgtctcctcttttatttctgattcagtttatttgtgtcttctcactttttttcttagtctagttaaaggttaatcaattttgtttatctttttaaaaacaaattcgtagtttcactgatcttttgttttgtgtttttagtctcaattttatttatttttcctccgatctttattattttcttccttctactaacttggggcttagtttatttttatttttctagttatttgtggtataacattagattgtttgagatcttcttctttgatgaagacatttattgctataaacttccctcttgaaaatactcttgctgcatcccacaaattttggtatgttgtgtgtccattttcatttgtttcaagatatttttcaacttttctttttatttcttctttgacccactggttggttctgagtatgttgttttattttcaagtatttgtgaattttccaaaattattcttgttgatttatagtttcatattatttatggttggaaaaaatacttgatatggtgtcaatgttcttaaatttattaagacttattttgtgtcctaacatatgaactatactgttttttttctttttttttttttgagacagagtctcactgtgttgcccaggctggagtgcactggctcaatcttggttgactgcaacctccgcctcctgggttcaagctattctcatacctcagcctcccgagcagctgggaatacaggagcacaccgccatgcctggctaactttttgtattttttagtagagatggggtttcaccatttgggtcaggctgctctcaaactcctgacttcaaatgatctgcccaccttagcctcccaaagtgctgggattacaggagtgagccaccgtgccaggccatgatctatactgttttatctaacattcagtggataatgttccatgtgtatttgagaagaatgtgtgttctgttgctgttggatgaaatattctgtatgtatctgttaagtccatctgtgctaaagtatagtttaagtttgaactttcattattgattttctgtccgaataatctgtccattgctaaaagtggggtactgagttccccaatattattgtattacagtctatcttccctttcatatcaattaatatttgtttcattcatttaggtactccaatgttgggtgcatatgtatgttcacctgttatatcctcttaatgaattgaccctcttgtcattatttaatggccttctttgtcttattttatagtttgtgacttaaagcctattttatttgatataaatatagctgtctctgctttcttttggcttctattttcatagaatgccttttttggtcccttcgccttcattctctgtgttttcttaaccatgcattgaatctcttctagacatcatataacagggtcttgtttttttaaatccatttactcactgtatctctttcttcctatcttgctgtcttcctttgtgattaggcgattttctatagtggtatcctttgaattcttactttttgccttttgtatatttgctacaggattttgctttgtgattaccataaggcttacataaaagatcttatagttataccaggctatgttcaactgtttataacataactttgattaattttttaatactcaatttatttgattgcttatttagagataattttgattcctatcagaagaaaactgaggtatctttatgtaccttttcaggaatgaccacgtctcaccttaccttgaatgttacaagaaatgctggcagtgactcaaggccaggcaaaaatttcagaaagggtttatcttgtttgtacaattttcttttgcaaaaataaatgattcttgatatgatgtaaggactttttccgtagatagaacctataaaatgcagaactttggggcagtaattatatgaatgaattgctactttaaaattctgtaagtccccaggaatttccatatgcttttttttgtttgtttcagtggttgtgatcaggctaatgggtagtttttagagctgaaaagaacttaaagatcatctagtgcacctttttgtttttcagttggattgttcttgtccaaatcactaagctaagttaactgctcagacaggaaaccaagtctcctgacccatggtttaatgctcctttcattgttatgcgtctgcctggctgacctgttagtaacataaagtgtcatgagagatagacatatgcatgagtaagatattaatatcccataaaccaaaactgtgacttaggaaatgttacggtgggcacaggatattactcctcttcaacaaaaacatcaatcatatgttggcttagttgcacagcagaagtaccaaaataaatttatatagacggtgtcacagatactttaaaaagacctacttaagatttaattacctaatattatttaatatttaatataatttaaaaggggcatttttatctttcagccaaggttttaattgtttttagataattctatttttgaaagtctgattttgttttaaaatgcccattctggtatataaaaacatcattttgtcaaataggagtcccagctaagggccaagcgtgcaattaaacttgactctttacctactacctaggaaccttgggcagatcacatactttttcttcactcagtttttacttctgaaaaatgccagctgaagtatgtttcaaatcttaaattttatgttttatgatctaagttcagattaacaatggaatggttagaatccaaagctaaaggtagtatatacaagtgtatattgggggttgggagcaactgccgcagctatcatatttacatttcaagctcaatttagaacaactgcgggcaactgtaaaaaccggtaggaatgggcagagttattgtcttcactagtcattgtggaaagtgaatctcttctgaatggagagtcacaaaaatgagtttgatgctttcatgatagtgaaatgagaagatggccatatattgctataaatcaccagcaacataaaagaaaaaattcaaaaatcaagtttgttgaggcaggactctgaaaagataactaagcttttttttttttttttttctgttagagatgtaataatcatgactaagactggaatcccaagagctggtgagactttctagtttctgccttgtggaaagagaaaggaagaggccaaaaaagataatgaattttggaaagttcctgattaaatatcgcataggctagtctggttatgtctgcttgaaaacttatccagtaggtataaaccaacacacttgaggccagtctttttggaaattacagaaatatatgtcagccttaagagacatcctatgatgaagagcagagggagttgtttataaagaaatgttctcattggctgggcatgatggctcacgcctgtaatcccagcactttgggaggccgagctgggtggatcacttgagatcagaagttccagagcagcctggctaacatggtgaaaccccgtctctactaaaaatataaaaaaattagccgggcatggtggcgggcgcctgtagtcgcagctactcgggatactgaggcaggagaatggcgtgaacctgggaggcggagcttgcagtgagccaagatcgtgccactgcactccagactgggcgacagagcaagactctgtctcaaaaaaaaattagccaggcatggcggggagcgcctgtaatcccagctactcaggaggctgaggcagggaaattgcttgaacccaggaggtggaggttacagtgagttaagatggcaccattgcactccagcctgggtaacagagctagactccatctcaaaaaaagaaaagaaatgttctggtcatgcctggagataatacatggtttagtttatgcttgattcagcaaataaaaattggtgaggaacatacagaattatatttaggtgattatattttttatattttatatataaaatttatattttttatattttaggtgattatatttttaaacgcttgctttacaagactaatcattattacttttttaagttttgtgatatattttatttaactaatataccccaaatagtatttcaatacagaatcaacatttaaaaattattgatacattatgtatgtttttttccttcactaagacttccaaatcctccaagtgtttcacacttacatcttattttggaccagccagattttagtgctcatttgaccatgtgatctgtgcttaaggaggctgctggagctgaggctgggctgcagtaccaacatagaagtctttatctgtcaaaccaggagtttgagatccctgagggatatgggaaccataaaggatcttaagcagagaagtgactttcttaattttgaacctatcctggtgttctcatagattagaggagagagatttaggagtgagggatcaagcaagaaggtggctccacattgttttccatagtagttgtactagtttacattcccaccagcagtatagaaatgttcgcttttcactacatccacaccaacgtctattattttttgattttttgaaaatggccattcttgtgggagtaaggtggtattgcattgtggttttgagttgcatttccctgatctttggtgatgttgagtattttttcatatgtttgttggccactttgtatcttcttttgagaactgtctattcatgtccttagcccactttttgatgggattgtttgttttttttcttgctaatttgtttgagttccttgtagattctggatcttaatcctttgttagatgtatagattatgtctccttctctgtgggttgtttgtttactctgctgctgctccttttgtgcaaaagctctttagtttaactaagtcccacttatttatctttgtttttgttgcatttgcttttgggtttttggtcataaaatccttgcctaagcccatgtctagaagggtttttctgacgttaacttctagaattttatggttccaggtcttagatttaagtccttgatccatcttgagttgatttttgtgtaaagtgagagatgaagatccagttgcattctcctacatgtggtttggcaattatcccagtaccatttgttgaatagggtgtcctttccccactttatgtttttgttggctttggcaaagagcagttggctgtaagtatttgggtttatttctcggttctctactctgttcctttggtctacatgcctatttttataccagtaccatgctgtttcggtgactatggccttatagtatagtttgaaatcaggtaatgtgatgcctccagatttgttctttttgcttagtcttactttggctatgtgggctcttttttggttccatattaattttaggattttttttctagttctgtgaagaatgatggtggtattttgatgggaattgcattgaagttgtagattgcttttggcagtatgatcattttcacaatattgattctactcatccatgagcatgagatgtgtttccatttgtttgtgtcatctatgatttatttctttgagaggtgttttgtagttttctttgtagaggtccttcaccttcttggttagtttttgttttttttggtttttttttttttttgcaactattgtgaaaaggagtgagttcttgatttgattctcaccttggttgctgctgttggtgtatagcagagctactgatttgtgtacattaattttgtatcctgaaactctgctgaattcattaatcagttctaggagctttttgggggagtctttagggttttctagttataaaatcatatcatcagcaaacagcgacagtttgaattcctctttactaatttggatgtcctttatttctttctcttgtctgctccggctaggacttctggtactgtgttgaatagtgagagtgggcatctttgttttgttccagttctcagaggaaatgctttcaacttttccccattcagtattatgttggctgtgggtttatcatagatgccttttattacagtgaggtaccttgtataccgattttgctgaaggttttaatcataaagggatgctggattttgtcaaatgctttttctgtatctattgcgattattgcgatggtcatgcgatttttgtttttaattttgttcaggtggtgtgtcacatttattgacttgcatatgttaaaccatccctgcatccctggtatgaaacccacttgatcattgtggattatctttttgatatgctgtttgatttggttagctagtatttcgttaaggatatttttttgagatggagttttgctcttgttgcccaggctggagtgtagtggcactgcaacttccactttctggtttccagcgattctcctgcctcagctccctgagtcgctaggattacaggcacctgccaccacacccagctaatttttgtatttttagtagagatagggtttcgctatgttggccaggcgggtcttgaactcctgacctcgtgatccacctgccttggcctctcaaaggactctcaaagtgttgggattacaggcgtgagccacagcgcccggccagatttttgcatctatgttcattaggaatattggcctgtaggtttctttttttgttttgttctttcttggttttggtacaagggtgatactggcttcatcgaatgatttagggaggattccctctttcttcatcttgtggaatagtgtcaataggattggtaccaattcttctttgagtgtctggtagaattcagctgtgaattcatctggtcctggactttttgtgttgttggtaatttttaaattaccatttcaatcttgctgcttgttattggcctgttcaggatttctaattcttcctgacttaagctaggaggtttgtatctttccaggaatttacctatctcttctaggttttctagtttatgtgtgtaaaggtgttcatagtagccttgaatgatcttttgtatttctgtggggttggttgtaatatctcctgtttgtttctaattgagcttatttggaccttctctcttcttttcttggttaatcttgctaatggtctatcaatttcatttatcttttcaaataaccagcttctttttgtttcatttatcttttgtatttttttttcaatttcctttagctctgctctgatcttggtattttctttcttctgctggctttgggtttcgtttgtttttatttctgtagttccttgatttgtgaccttagattgtctatttgtgctctttcagagtttttgagtaggcatttaaggctgtgaactttcctcttcgcattgcttttgctgtatcccagaggtttggatggttgtgtcactattattgttcaattcgaagaattttaaaattttcatcttgatttcattgttgacccaatgatcattcaggagcaggttatttcacttccatgtatttgcatgttttggaaggttccttttggagtcgatttccagttttattccactgtggactgagagagtagttgacatagttttaattttcttagtttttttgacacttgtttgtggcatatcatatggtctatcctagagaaagttgcatacgctgatgaatagaatgtatattctgtggttgttgggtagaatgttatgtaaagatctgttaagtccatttgttccagggtacaatttaaatccattgtttctttgttgactttctgtcttgatgacctgtctagtattgtcagtggagtattgaagtcccccactattattgtattgctgtctgtctcattacttaggtgtagtagtaattgttctatacatttgggagttccagtgttaggtgcatatatatttaggattatggtattttccttttggacaaggccttttatcattatataatgctcttctttgtcttttttaactgctgttgttttaaagtttgttttgtctgatataagaatagctactcctacttgcttttggtgtccatttgcatggaatgtctttttccacacccttaccttaagtttatgtgagtccttatgtgttaggtgagtttcttgaaggcagcagatacttggttggtgattgcttatccattctgcaattctgtatcttttaagtggagcatttaggctatttaaattcaatgttagtattgagatgtgaggtactattctgttcatcatgccatttgttgcctgtataccttggattttttttagtagtatttttgttttatacctccaatgagatttacacattaaggaggttctgttttgatgtgtttccagcatttgtttcaagatttggagctccttttagcagttcgtgtagtcatgtagtgctggcttggtagtggcgaattctcttagcgttgtttttatctgaaaaagactgtatctgtccttcatttaagaagcttagttttgctggatacaaaattcttggctgctaattgttttctttaaagaagctgaagatagggccccaatcccttctagtttatagggtttctgctgagaaatctgttaacttgatgggttttcctttataggttacctggtgcttttgcctcacagctcttaagattatttttcttatcttaactttagataaccttatgacaatgtgcctaggcaatgatctttttgtgatgaatttttcaggtgttatttgagcttcttgtatttggatgtctaggtctctaataaggctaaggaagttttcctcaattatccccccagatatgttttccaaacttttagatttctcttctttctcaggaacaccaattattcttaggtttggttgtttaattctgtcccaaacttcttggaggttttgttcatttttttttttttttcttttcttttttttttttaattgatcattcttgggtgtttctcgcagagggggatttggcaggatcacaggacaatagtggagggaaggtcagcagataaacaagtgcacaaaggtctctggttttcctaggcagaggaccctgcggccttctgcagtttttgtgtccctgggtacttgagattagggagtggtgatgactcttaacgagcatgctgccttcaagcatctgtttaacaaagcacatcttgcaccgcccttaatccattcaaccctgagtggatacaccacatgtttcagagagcacagggttgggggtaaggtcacagatcaacaggatcccaaggcagaagaatttttcttagtacagaacaaaatgaaaagtctcccacgtctacctctttctacacagacacggcaaccatccgatttctcaatcttttccccacctttcccccctttctattccacaaaactgccattgtcatcatggcccgttctcaatgagctgttgggcacacctcccagacggggtggtggccgggcagagcggctcctcacttcccagtaggggcggccgggcagaggcgcccctcacctcccggacggggcggctggccgggcggggggctgaacccccacctccctcccggacggggcggctggccgggtggggggctgacccccccacctccctcccggacggggcggctggccgggcggggggctgacccccccgcctccctcccggacggggcggctggccgggcagaggggctcctcacttcccagtaggggcagctgggcagaggcgcccctcacctcccggactgggcagctggccaggcggggggctgaacccccacctccctcccggacggggcggctggccgggcggggggctgacccccccacctccctcccggacggggcggctggccaggcggggggctgacccccccacctccttcccggacggggcggctggccgggcagaggggctcctcacttcccagtaggggcggctgggcagaggcgcccctcacctcccggactgggcagctggccaggcggggggctgacccccccacctccctcccggacggggcggctggccgggcggggggctgacccccccacctccctcccggacggggcggctggccgggcggggagctgacccccccacctccctcccggacggggtggctgccgggcggagacgctcctcacttcccagacggggtggctgccgggctgaggggctcctcacttctcagacagggcggttgccaggcagagggtctcctcacttctcagacggggcggcccggcagagacgctcctcacatcccagacggggcggcagggcagaggcgctccccacatctcagacgatgggcggcagggcagagacgctcctcacttcctagatgggatggcggccgggaagaggcgctcctcacttcctagatgggatggcggctgggcagagacactcctcactttccagactgggcagccaggcagaggggctcctcacatcccagacgatggcggccaggcagagacgctcctcacttcccagacggggtggccccgggcagaggctgcaatctcggcactttgggaggccaaggcaggctgctgggaggtggaggttgtagcgagctgagatcacgccactgcactccagcctgggcaccattgagcactgagtgcggttttgttcattttttaaattcttttttctttgtctttgttggattgagttaatttgaaaaccttgtctttgagctctgaagttctttcttatgcttgttttattctattgctgagactttcaagaacattttgcatttctctaagtgtgtccttcatttcctgaagttgtgattgttttttatttatactaactatttcactgaagatttctcccctcatttcttgtatcatttttttgacttccttaaattggacttcacctttctctggtgcctccttaattagcttaacaatcgaccttctgaattctttttcaggtgactcagggatttcttcttggcttggatccattgctggtgagctagtgtgattttttgaggggtattaaagaaccttgttttgtcgtattactgggattgtttttctggttccttctcatttggtaggctatgtctgagggaagtactagggctcaaggctgctgttcagattcttttgtcccacaggttgttttcttgatgtagtactctcccccttttcttagagatgtggcttcctgggaaccgacctgtagtgactgttatttctcttctggatctagccattcagcagggctaccaggctccaggctagtactgggggctgtctgctcagagtcctgtgctatgggctgttttcaggtctcacagcgttggattccagcacctgctctgatagaggtggcaggggagtgaaatggactctgcaggggtccttagcttttgttgtttaatgcactatttttgtgctggttggcctcctgccaggaggtggcactttcaagacagcgtcagctgtggtagtatagggaggatcaggcagtggccagggccttagaactcccaagagtatatgacctttgccttcagctaccaggatggatagggaatgaccatcaggtggggcaaggctaggactgtctgagctcagactctcctcgggtgagtcttgctgaggctgtgctgtggggcaggggggtgaggttcccaggtcaatggagttatgttcccagaggattatggctgcctctgctgcgtcatgcaggctgtcaggaatgtgggggaaagccggcagttacaggcctcacccagctcccttgcaacccccaaaaccggtctcactcctgtgccctaccaacagcatcaagtttgtttgcaggcagcggatgagcaaggctaagaacttgccgcaggctaccagcctcccagcaaagaatgtaagtagggctttcatgcctcccttcctgttgaatctgtacaccaaattcactccctcccccaagttctggccaggtgacttcatgtttggttggaattgttacaaagttcagctggaggtttccttctcgctgtggtcttttcccagttcctctggccaccctccccaaggacccctgtgagacaaggtagaaatggcttattaggggacccagagagcccacagggcttttccccttgctttctctaccctttatttcactcagctgtctaattaaatcagctccaggtaagttcatatccttctcccatgatctggagctgcagattccccagtgagggtgtgtgttcgggggtgggctatccccctttcctactttcacagcttgggcactcacagtatttggggtgtctcctgggtcctgtaggagcaaactgcttccttcacagggtctgtggattctcttggctttcctggtatattcctgtagtagttctggagcagaagtttatggtgtgagtttccacacactgctctgttcatccaagtgagagctgcaatctagtcctgcctcctttccaccattttttggccttgacgtattacatttattttatgtttgaagttttggcagttttattttgaaaattttacataacaaatgccaagccaaatccaaacttcttggcctaaatcatttacagataacctttactgagcatttactacatgaaggtgttgttgacacaggggatttaagatgtgatcactgaccacaacatccaggcaacctaaaagtgaaaagaggtcattcacaaaaaataggaccaaacttcctccattcctcaagggacctaggactggagttggcctaaaaattcctgctgtatcacctcacccaccagttttgatcttgctctcagggatcaaggaagctcaaggtttctggcccttttggctcatgttcttggaggtatattctattgtcaagttaaagtcgtacccatcctagatctgtttctctctctttgtggttccagtctcatagaaaacataactatgtgaaaacaccaactaccccataaagctattctgagactcaaagacatgaactctattttgataatcacaaattgatgtatagatgtcagatatcattcatgtattatgtagcattgtggtttaagtcttagctgttggaatcagactacttgcattcaaattttagctctgttgataggtgtgtaaccttgaacaagatacgtaacctcttcagacctttgtctctttgtttgtcaaataacgacaataataatactaacttagtaagtatgtataaggaggcatgtaaagcttctattgtatttggcttatggtgagcccttcatataaattggttacaatgggtaatgaaaagtacgttcaatttttcccacaaggatttaatctaatctctaaataaaatgccagttttagtatactgtcatcattataaggaaactataattcttaagtaattaattactttggttccctttggataattagtgatacataaaatgcagtaccttgccctgaggaacctacaagttagcctccctctaatcctggcattcaaagtcctccaccttccgaattacacctgttttttcaggcattgtctcccactttcctagcaagcctttggctccaggaaactgttctgttcattgacgacagaatgtattttgtcccgtatgcctcccttcaatctgaagttcatttttagtaattttttttattagtagtgactttccccatttactaatgcctttctctttagctcatttagaattccctggaagtcatcatgttttccttctgaattgctatcatattctgtctctgtgtctaatcagaaagttaggtgagctgctgtctcagctcctgtgttaatccaggtactgagctctttgtaccctgccagcttgagggcaacttggatgcgctggtgtgtagtgatttgcaactgtgagagagccgtttccatcaacaagtgacagcttttggttctaaacactgcttgacctcattctggtttgaacatatactttggcctctgccctctacctcacctccagttctgatcttgggcatgccacagaaccccatctacactaggctttcattttggacttctaagtcctttacttgaccacttattttctttaattgctagacttaatcatccatgcatatgacagccactcagctctgaccccaatacttcattgaggctcatgccagtctgacctctcacagggaagagcacccctgccggtgagcccctggcccttggattatgctgtcccaccagtgcccagctggctgcttggcactgcatgtgatgtatctttgtttattgatcgcttaattgaatgggatataggattatattccatgttccagatcaagttgagccaagctgacaacttagtattaaaaaaatatatttatctcctatctgtccaattaaaattttaatttctagaggtagagacagtcacattgctatttaattcctagcacagcagtatttttgtcaatatttgttattagtggtgagtttaaattataaaggaaaaaagagaagtggtgatttatgtcagcgcttggctaaactattcccttgatataagtctattattcaggtcacataagcatgactgaagtaatatcacaaccataatatcataattatctctcttgctgtctctgtcactttctcacttttgtttgtgcatagtgcatagacctgtagaaaatttattagtaatctgaagcataaaaccaaatattacaactatcataacaaataaataaaactgtgcactcctttagggagtagtaaagccatttctaaaattaagtcaaagtaagattcccttattattgagatattttagtggtatacactatcataagtaagatgaataattttgttagcagctgacactgctatatagatatttatcttgggaagttctcagtgtaacatctttactgtgtttttctctttagattatacttttatgtttattattttgtttcgtgggggattcaaaaatatgcattttatgccatacttggggattccctataaattattagttgtaatatgacagttccatcatgaattttccaggtattcttttatgcaagcagataatagctcattttggtttttaacacattcatgcatattctttctctctcaataaatatggttttaatttattaaatgaaagatttaaaaatgtgctaagcattttaataataatcgattttggattaacttgttatgtttactctagggctgtagttcaccatttattcagttaagtccttccccaaattcaatattgaacatgtggaattgattcgtttcacgtggatgtatcatttactcccaagatgttggtttttggcatttagtactggtaatgggccaggaaagtgctcatctatatttgttgttattcactgattgcatcttgcccttgcacccactgagacgatgggaaagtagcaacaatactaggtgatttctttgatttaaacccaattaaaagaattagagagttgtctgatacaaggccaaagaactaagaacagaaacaaaagcaaaacaacaaacagcagcacaaactccagtgagataaatttttaaaacattgggaatatttaaaaaataaaaacactccaatgaaccacccaggttttattaaagagtagagaactcaaacagcagaaggcagagctggtggaggaaactcagcaactgctcagaaatgaaacaacctaggaaggaggtgcgagtgacctgaaactccttttaaaaacagaaaggacaaaaagaggtatgggctgacaaaaggaaagtggtagattactgatgtattgcattatgcttagaatgtctcagaatgcgagaggcagtaaacacaccagaagaggatacaatatccggaccatgtgcaactgcaaataaatgtttgggttaaaacttggttgattctaaattacatgaagagctgatgataattgaggcagaactgatagacctaacaatagaaaaaaatcgatttaaattcagagaagaggtcatttaagaaagtataatgaagccacttaataaaaggaaatattcctctaactaaagtttgagatttagggcataatcctcaaagacaggctaatataatctattttttgattaaaaaaaggaacttttggtttaaagtaagatgttcagctgctcttagagtttatttctccatatttgggcatataagaatttaaggaaaaatatagaaatataagaaagatttcatgagaatcacaagcatagtttataggcaagatagccttttctgtttgaaagcgaaaaatactatttcaacatgtaaaaacctaagtcagttttcactggcatgtcccacaatcatgcctgaaataatggttgaagacagatgtgagacatttcaagggcaatagattaatacatgaaacccacttatgcctagcgttccattattggaacgctaagcatgtgggagttatttatatcctattgctcaaggtcatctccaaggtctgagttttcactcatgcaaaaattcaaaaaattgcaacctcggcgtaaatgggttaacaaaaagttaatgctggacagtaaaataaactactaaattagacacaccatattttttaaattataagagattaagaactatgagatatttaaaaagccacccacagaagtagtaggacaggtagagaaggataaattctaacaatcaactgtatctccaccccaccttgtaaatgacaaattagtttacttagtcaattcaggaaattaaacgtatacattttgtgttaaaacagaagactttttttaaaaaagtgtgttagttaaggttaattttgacctagttaagaaaaagcagtttagagtcttgaaatggaaatgagaaatacataattacccttaaaaataagttgatagtgaattttatctaggattcttaagacatttttaatatttaatgaaaatgaactacacaattattaaaaaatagttgcctgggtttagaaaaatgatcccttaataagacatatacaacagcctgaatttttatttccaaatactatagcaacaaaataccggcaagaaaaatgcacagaaacattggatagtctcttcttactaatcttttacagatatttatatattctgaattctaacttttaatttattttatgtattataaatgtcatctagtatgcagcttgactttgctttatggtatcatctgtttcacagaaaattttaagttgtggaatttatcgtattttttctttatagtttgtgctttaagacctgtctaataaatctttccttccctggacgctataaagttatttgtctatattctgttaaaaggaataaaactttgctttttttcacattttgttacttatttcacctgaaagagaattttgtttattatgtgaggtaggaatataacttaatttttttccattgaataaccaaattgtcccagagcaattaagcaatacattctttccctgttgatctgtgaagctacctccattaggcatgaagttgtcctgttgaagagaatctgattctgagctctcttcactatttctttatttgtctatgtctacactaaaagcaatttaatttctgtgtctttataattactttgactttataatccttgaaagggactttgttcttcttcaaaattgttttggctatttatggctacttttgctttcaaatgagtttttaaatcaaactttaatgagattgcattaaacttataaattaatctgaggaggattgacatcttcatgatatttagtcttcctacccattaacattatataactctccatttattttaggtctttttgaatgacttctaataaagtttttcaattttctccaaaatatcttacatattaaaatttactcatagctgtctcatcttactgatattttaaagacatatctttttaaaaattatattattaaattgtttcaggtatgtctttttttttgaagttttacaaatttgggattatactgcctcttcattcaacattttcccatgctgttggggatccttcaagtcaaaattattagaggagctgcattaatattccagcatggacatactataatttatttaattatttcccgaattgtatgtttttgtttctaacttcacagttttcaacatgactgggaacagcttttcttgctaaatccttgcacgccacagtaattatctcactgggccaaaagataggtactttttcatgactttcgccatatattgtcaaaatggaaccaatggtgatttgttcagaaatcatggtacatcatataaaaagattactctgcaagcatcacaaactgtgatatatagaaatgtgtttattgacatgaaatagatcatgaagaaagtgattacaaatggtatttaagcattttaagttatataggcttatactgagcaataacaaagagggtgaataaatgaatgaatatgtgattctggaagggtatgtaacaaaaggttaacaatggttagccctgggtaaggggattatgtatgacttttatttccttctttttttcttcctttccccttatgtttttaacaatgtacatgaatcgtttatgaataaaataaaaaactttgatattcttatataggtttagtaggataacatttctccttcatttctttcatttttagaaatctttcttcacggaaattcttttttttaaatgtttatttctgtctttgaggagtgagattgactggctatcttttaatacctgtgtgtattatcattattgtatcttgctgataaatttcacaacagttaattattttattccccatttcatacttagctctattttaggcaagttcacaaatatcattgaatgagttcattcaatgtcatcatgatgatattgaaatgtcaatagcagatgacttgtttctggggtgttaatatgcctgttggttacatttgtgttttttggtgatggaaggcagccactgaggcaaacagcaagaatacagctaagcctctaactgcatactcttctcactcgttgcttaaaactgaagcgtggataattggtgtgcattccctaaaaagttatgtcatgatgcagtagagaaataagttaactttcctatccctgtatcaaagtttcttttgaaggtaactgagacagcgccaaataaggagcagagtttctgtgaatcatgaaatctttctaaacaattgagaaaaaaaaaactgttctgaaacaaaaacttgtgccctatccttttatttgaatgtgttttcttaaggccacaactggcagagatttgatgattttatgtttaaagcaattttttttttttttcatagcaaggagtcccactgccatcaggttttgtttttggagagattctgtaactgacatagggtaacttactctgatggcttgctccacattcactacaagtacatactgttctgaaaaatctcaaagttgaaatatttttatttgggcaacttctgcaatcaaggtaattcactctatctttggagaataaaatggaaaagggcaacccaatctctgtgaccttaaacttccactgaaacttagagacggttagcttagctggtgagagcgtgctgctaataacaccaaggtcgtggtttctatcccattacagggcagtcaagctcaagggaaaaaccctgttctttggcacagcttccatggcctgctagccgtttacagcgaggcaaaagagtagagatgttttagtgaactaggccatgacttggggagtctccaccttgaatctggttgtgggaccaaggaagagaatctgctgaggctgggtagagagactctagagcaccttaggccacaggacagcagaggatgagaataacagaactggcttcagaaagtaggtgtcagtccaaggcactgtattcaatacatgtagcaaagaatgagcttctgacaccaggaaagtcttcagatggcagtgactgcataaaccggtgtcaggatgtctgactataaaggatgggacaccttccatcaggtgagagctctggaggtggagtctgttcctggaagaagcatgggtaaatgtcatcaaaggttccctcagccaccactgggttcagggctgaggtgcacctaggaaggcttgggcagaagcatgacccctggaacttggccaactgagccatcagagagtggtgcaggtgaggagtggtagatgtgtagtgaaccactcagctgtctgcccaggccttgggtgtggaagtagagtcttctgtgtctttgggcagactgaattataagcttcaccagatcgccaagctaggaatgttgacatacctggcttggggtcagggagggactgaactgtaggtggggggccccaacaaatctaatcataagaatctatgagcgtggagacagaaggaccaaagaagggatgctgtaaccaattatcattattgaaaaactaggcagagattacattcaattggcagtaccaccctttttatctctgacatagttccagaaggatatactatgtatctagtgtgacactgtctgatagaattgtctgaaatgatggaagtgttctgtggctacccattttgatagccactagccacaggtggctattgagcacttgatatgttgttggtgtgactgaggaactaaatttttaattcaatttaaattaaatttaatttaaatttaagtagcaacatgtggctggtggttactggattgaaccgaacagatctagatactagagtaagtggtagcagcaaatcctatattggaacaatgtaaattaacaattataaatatatgagcaggacaaagcccaaatgggcctgtactcttagttttgctatatattcaaccataactagcactcattttttaaacttataaaatgcaaactcatttggttgtgatgatgaatgctcaggtaattgttgagtttcaacacagtgacagccaggaactcattttggagacttggattgtgccacagtttgtccctctataaaatgatgatgaaaattttatcagtatctgtctcaagctgtagttaatgggccaatttctaaatattcctgtcaaattgtatagccattgttttcaaagtagttttgaaagtaggccattggtaaagcaatctattaaagtgcaggaagaaagtaatagaatctcttactttttaaagtctcattatgaaaattatatttcagtttgtatgccttcgatgtacataatatattaatacacaaatatattaatgcagcggtccccaaactttttctcaccagggactggtttcctggacgacagtatttccatggattgcagcggggatggtttcaggatgaaactgacccacctcagatcatcaggcattattaggttctcataaggagcacacagccttgagcaggtgcagttcacatatagggtttgcgcacctatgagaatctaatgctgccgctgatctgacaggaaatggggctcaggcagtaatgctcgctcactgctcacctcctgctgtgtggcccagttcctaacaggccatgaactggtaccagtctgtggcctgggggctggggagtcctgcattaatgtaattaaatatgtacatttcttgagagtgtttgttcaaatattttttcctaatagagacgtataacttagaaagtatggaaccctctggtcagtagcatattttatcaaaaaggctatccgtcgtgctaaccaatgtgattaaatgttcattttagtctcagatattttgataacataataatagggaagttatggttattgcatggcttttctttactgtattttcaataactatattaatgggttcagttgttactagttttataattctgttttattctcaatgagtcttcctgtttctccccacgtctttcctatggttcatttccctgcatctttacagctccctggaacattctctcaaatcaatcagaggcttcaaaactgggcagtctcattttgtaacctgctctgactcgcctctgggaggcctccctccccactcacagctgccttcctgcatgatgtaaaatgaatacagtgccagaaagactgatccttggaacctcttccttacttagtttctttatagttctgattttagaaatgaccattttacttccagtgcccttccccacaccagttagctgagactctatgcaggaagttcccagtgatcagaactgttcccatagctcccaggtgattctgacatgcacccggcattgagcaccatggacatggctgctgtttgttatcctcgagctctgcaaagcagtgtcggatattgcttgattgttgcacattaatctactgcacggtccggtaggtagccactagccacatgtggccatttagatgtaaatgaatttaaattaaatagtattataagttcaacacctcagttgcactctctgtattcaagtgctcagtagctacaagtggttggtggctaccattttgggcagtgctactatacaacatttctatcaccacagagagtgctgatgaataatagtactaacaactggaaacattgaaatggagaggtgaaggagagaaggcagaatataagagaaacttcaaagcattcagcgtgtctgataggcgctgtatcttacattatgtttggagcatagtttttgaatttcttaattttcaaattcggttgaaacagattttggtcaattgaagtgaaggactatgcctgctttaatttgcgtagcttacctttgtttcacgtgtctcccttattacagtgtttgtagcagcatctaactcaatccctaacttctttttggtgcagggaccatttaaaaacaatttgatcatagaggttatctcctttgcaatccatattgttttatggaacaggtgaacagctggtgacaatagcctcaaggtttctaatcccaccaaaggaaaatatggtgtcagtaattaccttgtactatgatatttgtgaaatccaagagagggctagatctcaggctctaataatacatccgtataaacatctcagtagggcaccacggaagagtcttaggatatcaggaacaataagagcgggagaatatcgaccttaatattctttacacttattaaaaagtgaaaagacagccataaagcagaatgagttcctgtcctttgcagggacatggatgaagccagaagccatcattctcagcaaactaacacaggaacagaaaaccaaacacctcatgttcgcactcataagtgggagttgaacaatgagaacacatggacacagggagtggagcatcacacaacggggcctgtcgggagttgggggactaggggagggagagcattaggacaaatacctaatgcatgtggggcttaaaacctagatgacgggttgataggtgtagcaaaccaccatggcacatgtatacctatgtaacaaacctgcacgttctgcacatatatcccagaactaaaagtaaaataaatgaaaaagaaataaaaaataataaaataaaataaaataaatgaaaagtagccattttaccagttgagtatttactgacttttggtgaaaatcactttctaagattactagaaaccttatgaccctcggcctctactcccaccacgtgcggattttcacctccacctactttgtcacgtcacatgcccttctgctctttaggacacttgtattgggttcctcccccacacgtaaacagaacacacaggtctgtgaatggacctcattatgctcatttgtctttgccaagaactattgaaaatgatcacaaatgactatgtaattataattaagattttgtacatgcatacactttatttttaacaagtttgtcctgttaaatgtcaccccattttgaatagtaacattcactggtgcaaggaagaattattaaaatgacaatttaactgatatccttgacaggtaagccagttattgtatttcataattgtgattattacaatacctatgaagattaattaggacaatttattctataggacttggttatcaaaatgatcttttttcccattttagtccatacatcttcagttttaatttccttcttccaaagaactctgagtcttgcccagtgtgatacttcagattttgtaaaaatataatgaagaagaataacatgtatcagatcttttttttaatgtactgggctaaaaattataagcaccatcaaattactagaaaattcttttaacactctgcttcttagttaaaaaatgattcctttttgtgataatcttataattttcaaagtatcattttagaaattttaaaaaattattcttgttttcattcagtccatttcatcagaacttagattttttcttccctctacagtatgtggtcttgatgtgctttctccttgcaaaataaaatctttagtttcaggatctctgtgttctattccttcaatttaaaatcataggaaaaataactatcatttccttatgtctgtctccaattcccccatcattttctgtgagccaattttcttctttttcttctgtctactgtaaggaactttttactctgctctattctctgcaattcagggctcacaatttctttgacttctcagattatcctttgtacttgtgtctactttttcattaaaaaaaaaaaggcttcggtcttattttgactttatcatctttatattgccatatttaaaacccatctgcttattgattgaaccaaacttttcatcttacttcatcatactgaatgtataacttctgaatgacttaaaaatcatcacataatgtgagagaattttctatcatattcaggtgactgcattgtaagcaatgaagttgaagaaaaatagcttataatggatataataccaagaaataataagaatgagaatctgcgtatatcatatactgggttaacaagctcacaaggcaaatcaccattttattagatatttaacaaatcatactagtactggaggaagtatagcagaaaaaaggagtatggacattgggattagctgccttgctaatcttttgtcagtccctagtgacatgcttttgggttgagtcattgttacctccctgagctgtttgtttataaaatgggggtaaatatctcagatgtttcagtgttgtgacatataaagcgtcctccatagtacataataccgtaagcactccataaggtaattcttgtccttttaaaaagtatacacttttgagttcaggacacgtacactgtaacctagttgtaaccattttaataaaagaaggttttgatcatttttgataaatgtactacatgaatagttaacttgcctttcacttcctataccaacggaaattttggtaacaaatttaaagaaagcattaggttgaatatcccatctgattaaatgtcaactaaatattgtttctggcttttaaaatatttctaattcagttataaaacaggtctattactcaggaggctgaggcaggaaaattgcttgaaccagggagtcggaggttgcagtgagccgagatcatgccattgcactccagcctggcgacagagtgagattccgtctcaaaaaaaaaaaaggtgaaatgaaaaacaaaaaagaggggtgaaatttctctgcattctccctttctgctgttgggaaagccctttcattaccaagaatgcatggaattctgcttattaatttctccatctatgtgtctctgtgaaaaatactaattatttacaattttgtaagctatgaataaggtctatgttttctctgaaattatagcaacaggagcatttcccccttatttgggccgcaatcttttcattctgattcttaccataacttctgacttctgactttatcatgtcttctgatttctactaaacatgaacagaatgaatgacttctagaaatggatacaggtgtaatacatataaggccagggaaccacttaattatctttacaaagtactaggacttcagaaaaatcaaatgatgaaatggagctagctttagtatgttctacttatcattggactattaatcatgtctgtctgatgagttacctaggacttcaactgtttttatagatttaaagaaaatattataaatgtatcttacctggatttaagactggacagctgattttggatttttttctgctaccctgttgttgatatcactgacatcagcctttgcattttgactggaggctcctttctctctttctctctctctctctctctctctataggaaaccagtagttatgtcaggttgctaagtattttcccactgaaggacaaatattctggagcagtatatatttagcatttgacatttgataaacaagcttgtttgagatattttcaatacaatttcagctttggcaattgtaagcaaaggatccagttggtaattggtgaaatgaacagatgtggacacgctgcctgcatcgagatgcattaatttttctgaaaagtggataagatcttgtgagaatgaataatggaattcaaatcagatggggtgagatatttgatattcaggaacaaatcacagtataatagatctgctactttgtttggttttaatggggagttgctaatgctgaaatatagtcagagaaaaggaacgtggaatttctatagaggagagcctggctctggggtaatactactgtccttggtggaatgttgtcttttctgaagacattggttcaattcaatacatgaaacattcatcgattattatttagaaaagctaatctactgacaagacacagagttaagtagtgaaaatacagagacctagacacagttcttattaagaaattttttaatttaggtggcatatttcagagagaaattctctgcttggggcaataggtacctcctttggaataagcatggtgagaaagaattgcttctggcagattagtgagaagagtgagatattttctttcgatgacctctctattaaaatttgagtggtaaaactttgtgatgattcaggctcttcataattcttaattttatcatcctctaataccaggacttgcccagatcaatattttaggaaacagtcatgcttgctaaacccagggatttctattaaccactagataagacataagtttgtcatgcaacaagtatttattgagtccataatttgcccagcactgggctttggtactctgggccttgatactctaggttgtgtcagagatgtctaatatatttaaggtgacagagttcacaaatgagactttatgaaaatgaatatccctttttaagtctcgagaaatatgatgtgcacccgcttgaggctttattaaatctccagcgagcatgaacttgtttgtgacccaattgtagaattgttgtatgatgactatcccactggcaggcacttcttgtccaagagaatgtaattggatgttggtgactcaagcaatcctgggaagactcctccatgaccaaattaaagacaacaggggcttggtttgtactcagctctacaccaatcagcatgagacaaagaagagatccatggcaaagtggggagactactgtttattttacaagctagagaaggaaaactgcagttcctgagttgcaaaactgctaagaaatgggagaacacagaactttacaggctgaaccttggtgtcttagttattcctcttggctacagaatgccaaccagtaggagattcatcactgagatattacagggaaatgaagccaggcaagaaaaatatgtattccctttcttctcagcccataaattttgttattaataaatcagactcttatagaacagcttgccacggctgtctctagaaatgtttttattagcagaatttttattaaaataaaatacacagtagttttaagagtgaacattatagttttaggtcataaggggtgtcatggagaacacatgtggatgctacttgccagttacttgatctaggccttgactcttggttttctgttgctcggataagttagcatgatttgacatgcagttaaaggtgtggtaacctgtgattgatttcccattcttgatgctccctgcctggacttctcggaaaatttcaaaacaattcattcttctatgagggctgcctccttggttgcttcggctaaacagtgttgagcaacaagttgggaaaggaacgttgcagtaacttttaaaaattaagttagaaacaaatgtcatcaaagtaaatgataatttgccaatatgattgagcaaaaagatgaagatgcacgctccctacgtatttgctttgcagaagaattaatttgaaaaataataacatattttaaaatgaattgtaaatataaacacatgctaattgcagaggggaatccctgtgattattcagcagtttgtgtttgtcaagtgcttttcagtcagtccattccagctcagcagggcagaggcttgggctgttgtaaacttgtgggcagatacccagtgatggggcagacatgagcaggtagggctgacagcatgtgaattgagttttcttcagtcatgctgttgcagctgctcccttccctcattgctgagtttgccacagcaggtaggaacctaactctggagcctgggatgaaggagaacccacattgggcttgaggaacaagatctgccaccctggtaggccctggttaaatctcatgcaagtgtagcaatgagagagggtatgattgagttctaatttaggaggaaaggggataatgtgccctttgcacccccaggagaaatcattgctcatctgtgcctaagtagacttatcaagggcagttggttcacaatggtgtatcaccccaaaggactatagtgttatgagaacttgccagtgtatttgaatttgggtgctggcagatgacatcatgaggtattatggttacccataaatatgctagtttattgagaaggtggtagacatgctagtggatgagagggaaggacagaagcagttagtaaacagcatctgcaacaattcagttaactggtggttgtcacagtagcatggtggaaaagttggcaattaataacttctaagaaaactgaactaatgaaccaatcctgcgtgtgctatgtgtataacctccttctcactattaacagatttgttccaaacttatataagacaatgaaaataaagcttggcaatatagggaagggatggagggataaagctgtaaatcacgtcacaggcaaattaagatataccactggatcaagggatttaatgcagaaagactgatcctaacttatttcttttatttagcaataagatttgttacttacattgattatttaaaatgagttgcattattagaaaggactattttgaagacaactataataaaatgtcagtaactgatagtagccaagatattttaaatatatcaaagttgtgtcattaatattaatgtgtcccttaatatgaagtcctgcccaggcttatttatgtattcaacagacacatacctgttgaagtgtaacagatattctggacacaagcaatggtaaacaagacagatgcagtccctgctttcatgcaatttgcaattgaatggtctttgacattttattgtgattgttttagttatttaattggagaagtttttaatttaaatttgtgttatattcagtgttaaggaacaaaaatgtaatgtgcatttctgagactcagtaacacttctggtttttcctttttcatttaaagaaaaatttagtgcccaagataagctagaatttttggaatcaagtaattgatgacctgggagccaattttattacaatagtgtttttagtggtcttagaacttttcagaggtggtagctctgaaaataacactgtaataaattcacacatacatctatcatccaataaatgttaattgaggcccactacagcattgtgttagattctgaggttacaaattgttgaccccatgtcgaacatgttgaccccatcaatgtaatcagtttgacattacacagtcatttaaacattaaagtgtcagcggatattttagttgtaattttgataagtgctctgaaggagaaaacagtgggtgttgtgaaaagcagtatttggttgattgattattatagaggatctgagaaaacttacttgaggaaggaacatttggctgaactcaaagagatgagtaggagttaagtaagcaaggaagaaaagaagacacatgaaggaggaagaatgttctagaaacacacacacacaggtatatgtatatgtacatgtatatgtatatgcatatgtcttccttagaaacatataaacagctgcaacatgattgaacttatttacccaattaccaaagcttattttgcaccatgaaggtggagataaaggctttttaagcagcaaggatagaatctttgtagtttttatttataggctggttcttctgacaactttaatttttcatctttaccaacttcatggtcttcagtacatacaatgcaatcattattataaaattatattttgactcaaactctaaggtaggatgattcagctgtgcgccatcaacatagcagcatgaatggtagagactagtcattccaaacagtgaaggggcaacgtaaaactaattttaatattatatgaaagtacttcttgcccttgactgcttttttttttttttgaagaaagcaaactttaaaaatttattttagatttacagaattattgcaaggatagtaagagagttctcatatatgcctcacccagtttcctctattatcgacatcttacattatatggtacatctatcataactaatgaaccaatattgtttcattattagtaactaaatctatactttattcagattttctaagttttcctctaatgttctttttctgtcccaggaccccatcaggatatggtatgtatagttgtcatgtcttcccaggctcgccatggttgtgacagtttctgagactttcattgtttttgataccccaggtagtttaggcattttgtagaatgcctcccagtctgaatttgtctgatgttttcctcatggtttgactggctttaatgtgttttggggaggaagaccacagaggttaagtgtgattgtcatcacatcgtatcaagggtacatgccatcaatatgacttatcactgttgatattaaccttgatcatctggcttgagatagtatttgtcaggtttctgtattatacagttactcttctccctgtccatacagtactttttggaagaagccattttgtgcagctcattttttttttaattttaattttaagttctggggtacatgtgcagcatgtgcatgtttgttacatagttaaacgtgtgccatggtggtttgctgcacccgtcagctcatcacctaggcattaaagccaacatgcattagttgtttttcctaatgctctccctcccccaaccccaatctgacaggtcccagtgtgtgttgttcccctccctgtgtccatgtgttctcattgttcagctcccacttctaagtgagaacatgtggtgtttgggtctctgttcctgcattagtttgctgaggataatggcttccagctccatccatgtctctgcaaaggatttgatatccttcctttttatggctgcatagtattccatggggtttatgtaccacattttctttatccagtctatcactgataggcatttggtttgattccatgcctttactattgtgaatagtgctgcagtgaacatatgcatacatgtatctttgtaatagagtgatttatatttcactgggtatatacccagtaatgggattgccaggttgaatggtatttctagttctagatctttgaggaattgctacaccatcttcctcaatggttgaactaattaatttacattccgaccaacagtgtaaaagtgttcctatttctttgcaacctcgccagcatctgttgtttcttggctttttaatgatcaccattctgactggtgtgagatggtatctcattgtggttttgatttgcatttctctaatgatcagtgatgttgagcttttttcatatgttctttggcctcatgaatgtcttcttttgaaaagtgtctgttcatgtcctcttccaactttttaatagggttgtttgtcttttcttgcaaatttgtctaagttccttgtagattctggatattaaacctttgtcagatgtatagattgcaaaaaatttcccccagtctgtaggttgcctgttttctctgatgattgtttcttttgctgtacagaagatctttagtttaattagatcccatttgtcaattttggcttttttttgcaattgcttttggcagttttgtcatgaaatctttgcctgtgcctatatatttattgcatagattttcttctaggggacttcaaactatgctacaaaacttcaataaccaaaacagcatggtactggtacaaatacagacacatagaccaatggaacagaatagagaactcagaaataagaccacacatctacaacgatttgaccttcgagaaacatgaccaaaacaagcaatggggaaaggattgcctatttaataaatggtgctgggagaactggctagccacatacagaaaattgaaactggaccccttccttacaccttatacaaaaattaattcaagatggattaaagacttaagtggagctcatatttaaggagtgagaagatatgctctacctctttaagggtggagtagctctataaattatttggaagtgtctattctcctccattaatttatttagtcaacaattagtatcagccatctagaacccatgaatatttatgctttgggtacagtccaatactattttattttgtagctcatcttgttccagctttggccatttggagatttttcagttggctcctgtatctctttggcttcttacatatcattgtagggttttttaaaagccttttcttactttctgtcactacaagatagttcagacttatcttctgtattttttgccccagttctatgatcagccacttctccaaggagcaataatttccttcaatgaaaaccaagatatgggctgttggtgtacttgttgttattgtgtgttgttacttctagatcctctaagctgatagtgcaaagagatatatgtgtgtgtaccaacctatatatctacacacatataaaaatatttctatttgtaaccatctgtatctatcttaggctaaacctgagtacctactgatgtctccaattctaacctgcaacagcatggaacattctagccttctcctcttacttatctgtcacttcctataccaatagtgagaaacctggctcctaccatctgctatttatttacttaattatttaattccactatacttctatggaagtttcagaattgttaatctgtactcatgtacgaaacaactttatcaactagagtatagtgtttatatacagttcctttgcctttattctaacagattccacttactcattttccgagtcacttaggttagcgccttattttcctaagtccattagtgagtttgcttcatgtatttgtcatacatttaaattcttttgtaatattgtgcattccatcccagtttcccctgacatcctaaattaactttttaagtttggatacattgtggtctattctttgttctgtaaagctttatggattttgacaagtatttaatgtattgtatcaccattatagtaatatagttcctatggaatagaatagtttctatcgctgtagcatagaatagtttctctactctataaaatatcctgtgtttctctaattcaacccctccttcccaccttgaactcctgacaacccctggtctgtttaatatctttcttttgtctcttctagaatatcatataattgaaatcatacaatatgtagctttttcagactggctactttcacttagcaatattcatgtaagtttcatctatatattttcatggtctgatagctcatttctttttaatcactgaataatacttttatttatccactcactggtgaagaatctcttgattgcttctaaattcatggcaattatgaatgaaactgctctaaacatttttgtgcaggtttttgtgtgcatgtgtattttcaaattagttgggtaaatatctaggaattcaatttctgcatcattgtggtaataatgtgtttagcttcataagaaattgccaacctatcttccaaaatagctgtaccattttgcattcccaccagcaatgaatgagagttcttgatgctcgacatccttgtcagcatttgatttttgtcagtgttttggattttaactattgtaatagatgtgtagtagtgtttgattgttttaatttgcaatttctttttcttttttgagatggagtctcgctctgtcgcccaggctggagtgcagtggcacgatcttcgctcattgcaacctctgcctcctgggttcaagcaattctctgcctcaagctcccaagtacctgggattacaggcgcctgccaccatacccggctaattgttgtatttttagtagagatggggtttcaccatattggccaggctggtcttgaactcctgaccttgtgatccacccgccctggcctcccaaagtgctgggattacagacataagccacggcgtccggcctgcaatttcttaatgacaaaaaatattgaggatattttcacatactttttttgccaactgtattttttttaattaatttttatttttattttattttgtaacttttattttagatttggggtacatatgtacatttgttaatacaggcaaatttgtgtcacaggggtttggtgtacagatcatctcgtcacccaggtactaagcatagttcttgatagttctttttcctgatcctctccccactcccactctgttccctcacgtaggccccagtgtctcttgttcccctctttatgcccattggttctcattatttatctctcacttaaaagtgagaacatgcagtatttggttttccactcctgcattagtttgctaaggataatgtcctccagctccatccttgttcctgtacaggacatgctctcgtgttttttttctttctttttattttaatggctgaatagtattccacggtgtctatgtactacattgtttttttttaaaccctgcataccattgatgggcatttaggttgattccatgtttttgctattgtgaatggtgttgcaatgaacctacatgtgcatgtgtctttatggtagaacaatttatattccactgggcatatacccaggaatgggattgctgggttgaatggtaattctccttttaggtctttgagggatttccacactgctttccacaatgggtgaactaatttacactcccaccagcagtgtataagtcttcccttttctccataacctccccagcatctggttttttttgtttgtttgtttgtttttttagtatttaataatagccattctgactggtgtgagatgatatctcatcatggctttaatttacatttctctaatgattagtgatatgtagcattttttcatttgttgccaactgtatgtatttttcaatgaggtgtacatcagatcttttgcccattttaaaagtggggttttgggctgggcgcagtggctcacgcctgtaatcccagcactttgggaagctgaggcaggcagatcacctgaggtcaggagttcgagaccattctggccaacatggtgaaaccctgtctctactaaaaatacaaaaattagtcggacatggtgtcgggcacttgtaatcccagctacttgggaggctgaggcaggagaatcactggaacccaggaggtggaggttgcagtcagctgagactgaaccattgcactccagtctgggcaacaagaatgaaactccatctcaaaatacatacatacatacatacgtacatacataaaattgggtttttgttttctttttgttgagtttgaggagtttttttgtatattttgattacaagtcttttatcagccatgtgtttcacaaataatttctcccagtttgtggcttatcttttcactctcttaattgtttttttcaaagtagaaatttaaattttaatgaagcccaatttattaatttttttcttccatattgtgctattggtgttgtatataaaaacttactaccaaattcaatatcatatagaattttttctgttttcttcaagaagtagttttataattttgcattatatgtttagatcaatgattcaccttaagttttgtttaaggtgtaaggtttgtgtataagtttttctttttccacatcaatgtccagttgcttcagcaacattttctttttatatatatcttaagggtaatcagcgcaatattttctgaaaagatgacctttttctcatttaattggctcttctttgtcaaagatcagttgaccttatttgtgtggatctatttctggacttcttactctgtttcactagtccatctgtttatactttaaccagtaccatactgcctttattactgtagcctttatggtaagtcttgaaatgaaatagtgcaagtgctccaccttcttcagaattttgttcttcttcagtattaaaggctattctaggtcttttgcccttctttaaacatgttggaatcaattgtcaatatctacaaaatagattattgggatttggatttagattactctgaatctgttaattaagttgggaagaattgacattttatcaatattgaataatatgaacatgtaataatattgaactttcaatctctattatctcttcatcattttaagatcttctttcatttttcattgttttatagatttttacatataggccttgtacatactttgttaatttatatcttagtattgaatgtactattataaatggtattttctaaactttgaattcctgttattcatgatgatatgtaggaaagaaattgacttttgtatattgacattagatcctttaaccgtggcatcattacttattagttccaggggagattttgttgttgttgttgattcattggaattttctgcatagataatcatgccatctgtgaataaagatgttttatttcttccttcccaatctatatatcttttatttctttttttgccttattgcacttgctggtatttctagcataatgtataataggaggaatgagataagatatcttagaattatcctcatcttcaggggaaagtggttagttttttgtcattaagaataatgttagctattgtttttttaaatttcctatatgaaattgaggaaatttctgtctattctgaatttgctgagtttttaatcataaatagctgttgaattttgtcaaatagttttcctgtgtcaattaatatgatcatatgacttttcccgttttcactgttaatgtggcagattatattgatttattttcaaatgttgaatttgccatcagacatggaataaatcccatttgttcatgatgtataatttattttatgcatcgtttgttctgtcttgctaacattttgttgagattttgtgccagtgctcaggagagatattggtctctagttttactttcttataatatctttatctgatttgggtattaggataattctagactcagaatgagttaggatgtgttttctctgcctgtttactaacacagattgtagagaattggcacaatttctttcttgaagatttgttagaagtaatcttgccaccacctgagccagatgatttctttagaaggtaattagttattgaatcaatatatttaatatatatagagatatttaggctatttatttctccatgtgtgagttttggtagtttgtgtatttcaaggaattggtccatttcatccaaattatcaaattcgtgagcatagagttgttcataatattcctttattatccttttaatctccaagagaccagtcgtggtgacttctctttcatttatgatattggtaatttatgttttctgtctctcttttttttttgccagagtctaactctgccacccaggctggagtgcaatggtgtgatctctgctcactgcaacctctgcctcttgggttcaagtgattctcatgtgtcagcctcccgagtagctggtattacaggcatgctccaatacacttggctaatttttttttttgtatttttagtagagatgaagttttaccatgctggccaggttggtcttgaactcctggcctcaagtgctctgcctgcctcggcctcccaaagtgctaggattacaggcgtgagccaccgtgcccggcttctttttcttaattagcctgaatagaagtttatcaattttattgctcttttaaaataaccagtttttgtttcactgagtttctttatcatgtttctgttttcaattttattggcatctgctctaatttcagatgctccttgacttatgatggggttgtgtcccagtacatccactgtaatttgaaaatatcataagtcttttgacttatgtaatgcatctaacctaccaaacattatcgcttagcctaacctcccttaaatgtgctcagaacacatacattagcctacagttgagcaaaatgatctggcaacaaaacacactatagagtattgatggtttaccccgatgatcacatagctgactgagagctgcggcttgctgctgctgcccagcattaagtgagagtattgttccatatattgctagcacagaagatctaaattgaaaattcaaaatacagtttctactgaatgcatgcatattacttttgcaccattgtgaagtcaaaaaaaataataaatcaaaccatcttaagttgggaactgtctatattattctttctcttctgcttgctttaagcttatctagtttttttcttctctagtttccttaggtggtggcttaggttggttattgatattatatatttttcttatctaatatatttacttaatgctatgaatttttctctaagcactgcttttcctgcatcccacaaattttgatgttctatttttatcttcatttagctcaaaatagtttaccatttattttgaggctttttctttgactcatacgttctttaaaagtgtgttgttcaatctctaaatatttcgatattttccagctatctttctgttgatttctaatttatttccaatttggtgtgagagcctactttgtacactttctgttcttttaaatttgttaagggtgttttgtgacccagaatgtggtctatcttggtgcgtattccatcagaacttgagaagaatgtgtattaagttgtggtttgatggagtattctataaatattaattagaccatgttgattcatcataccgtttaggtcaactatatctgtattaattttctgcctgcttgcactagcaattactgacagcggaatggtgaggtttctaagtataataatggtttgggcttgtctatttccccttttagtttcaatcattttgcttcatgtgttttgattcacttttgttaggtatacacatatatacacatatttatgattgttgtatcatcttgaacaactgacccctttatcatcatctttatccttggtacttttccttctttggtagtctgctttgcatgaaattaatatagccactccagctttatttttgtgaatgttagcatggtgtatctttctccattcctttacttttaacatatcagagttattacatttaaagtgggcattattactaggataaataccaaataaagtattttgcatgctgggcttaaaacctagatgacaggttaataggtgcagcaaaccaccatggcacatgtatacttatggaacaaaactgcacattctgcacatgtatcccagaatttaaagtaaaataaaaaataaataaataaaaattaaaaagtaaaaataaattagctgggtgtggaggcagccagctactcagggggctgaggcaggagaatcaaaataaataaatcaataagtggggctttttgtagacaacatatagtttggtctttcttaaaattcaatctgacaatttccatcttttaactggtatatttaaacaatttatatttaaagcaagtgttgatatatttgaataaaaataaacctgtgtttattaactatttcatatttgttgccaaacgcttctttttggtctttcgtagttttatttgagcaatgtatgtcataccattttatcttttctcttagagtattaactatacttcttttttttttttttgagacagagttttcctcttgttgcccaggcgggagtgcaatggtgcgatcttggcttaccgcaacctctgcctcctgggttcaagcgattctcctgcctcagtctcccgaatagctggaattacaggcatgtgccaccatgcccggctaattttgtatttttagtagagacggagtttctccatgttggtcaggctggggtcttaaactcctgacctcaggtgatccaccggcctctgcctcccaaagtgctgggtttacaggagtgagccaccgcacccggcttaactatacttctttaaagaatttttgtagtggtgccgctaaagttcacagtatacatttttaagtattctaaatacaccttcaaataacactattcctttttacatgaaatatagggatattataacatagtattctcaattcctccttactgtcccttgtgacatagctgtcatttatttcatttcacttacctatatactataatcacctatacattgctgctattatgattttaaacaggcagttattgtttacgtcaattaagaatttagaaagaatttagaatcctgtgtaaaataaatttccttttattttaccttaattcatgcattctctgattatcttccatgctttatgtagatccaagtttctgacttatatcaccttcctcttgcttgaagaacatcttttaacatattctgcagggcaagtcagctggtgatgaattctctgaatttttgtctgatttttttttaatatttccttcacttttgaaggataatttccctgcatctagaattctaaattggtcacttttttcaacattttatatattttacttcactttctttattaatgtacggtttctgaagagaaatctgctgtatttcatcctgttctctatggttaggtgcttccctgccctggctctggctttttcaagattttctccctgtctttggtttttctacagtttgaatacaatatgcctaggtgttgtttgttttgtttttttgtaaggagtggcatgtatttatcttcttgatactccctgagcttcctggatctgtggtttggtgtctgtcattaattttgaaaagttctcagccattactacctcaaatatttcttcttcgcctttctttttttttctttctggtattccaattatgcatatgcttgttataccttttgctttttcattcttttgattctttacatttcagttggggacgtttctgttgacttatctttcagctcactgattatttccttggccgtgttgaatcaattgattagtcctcaaagacatttttcatttctgttacaccatttttacatttctagcatttgcttttgattctttcttaaaatttctatctttctgcttatattacccatcttttattgtatgttgtcttctttttccattagagccctcaaactctttttttttattatactttaagttttagggtacatgtgcacattgtgcaggttagttacatatgtatacatgtgccatgcttgtgcgctgcacccactaactcgtcatctagcattaggtatatctcccaatgctatccctcccccctccccccaccccacaacactccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccgtggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggcatatacccagtaatgggatagctgggtcaaatggtatttctagttctagatccctgaggaatcgccacactgacttccacaatggttgaactagtttacagtcccaccaacagtgtaaaagtcttcctatttctccacatcctctccagcacctgttgtttcctgactttttaatgattgccattctaactggtgtgagatggtatctcattgtggttttgatttgcatttctctgatggctagtgatgatgagcattttttcatgtgtctgttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccctgttgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagatattggtagcttgatggggatggcattgaatctgtaaattaccttgggcagtatggccattttcacgatattgattcttcctacccatgagcatggaatgttcttccgtttgtttgtatcctcttttatttcattgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgacatacgtcccatcaatacctaatttattgggagtttttagcatgaagagttgttgaattttgtcaaaggctttttctgcatctattgagataatcatgtggtttttgtctttgtagagccctcaaattcctaatcacaattgtttatctctttcctgacattccacatccaatccatcagcatgtcttattggctttactttcaaaataaattaaactcagccacttctcagcatttttaaaatcaccctaatacaaaccccctgctacctcatcaactgcaatggcttcctaacttattttgtaacttttgatctttgagttcttccaagagccaagagttcttccaaagctataaaccctatcattggcactcctctgctctatggaaagcagtggcttctcatctctttcagagtataatgcaaagctctcaccttagctggcatggccctgtgggattggcctcccttgtcttactttttccttgttcaggctgctgtgacctctctggtctttggctcttactagaaacctttgaacccgtttccttcccagtgtcagtatttgtgtgttgttcgttcacccttctcacttcattctggtttctacagcacagagaagtagtagtccctgatctaaacaccctctccacctgctttccactttgttttttcccctagcacttaccattatcagatatcatatatttatttgtttattgtctaacttcctcacaaaaatatgacgttgtgaggatagggatttggctttttgccccagagcagtgcctgactctcaataactttgttgtattaagtgaatgaataaaataaaattaaaattgattcaaagtgtatgagcatgtgtacattttacataagtgatacatgacattcttccattccttgggggctcttttaaccattctcaaccagttgtagtacctttaaaaaatcatgatgaagatgattttgagagctaattttggtaggagacagcagttttagcctgtccgctccatgtgcagaataatagcctattttattacatctgatattcaagcactagaatctatcaataggtaaataatttccaaaaataaaagcatcagtgggaaaacagggaaattatttttaaaaaagaatttctagaccaggatgtgtgcaatttgtaatctctaataagaaacgttatagctgataattccagcaattacagaatcatgatcatatccataatggatcagtagaggctctggcttatataatagcttgccctctcaggattctagagccccatatgtaaacacagaacacatttatattgattgacagtgcatgtaggtttctacagattgtgccagtcagtgttttctaaggcagttatgccatggtaattaaaattatgggctctgaaatcagcctgcctgggttcaaaccccagcttcatgtgtcagcttccttggctgtaataaggaatactaatagcacctgccttgtggctttgaaaattacatgatgtaactttgtcaagagcttagatgagcacttgggatatggcgagtgctcaataaatgttagtttaccatcatcatcatcattattattattactgattgcaagcaagacaaactggttctcacttcagcagaaaaagaaattactgaagtaattttggttagatcacagatttaacgtgaaggatgaataaccagacttggaaaacaggtggaaaccaagaggcagtcagcatggcatagcagccagcacttcaccagtgtggtgccttgggggcagcctggcaggagccactgccttcactcctggactgcagatctaccacaggacagcagactgaattgtcctatgtccagacttcacagtcacagggagcaggctgcatgcaggtggggcccaggtcacctaccttcaccctagagtctggagccacagaaaacagtaattgtccttgtagcttttgtgatggaaagcaagtcctgacacccaccaactcacatactagggaattcaccaaatgtaggacggcagctaagatgctgggaaaccaagaattaacaaatgagtattacaccaattagttaattcattacagatttcaatattttccaaaaaacatcctacaaagaacagctcactttaatatactccaacaaatgatgaaatctctccttggtcatcagcttttctaaatttctgtaactttaggtgattctgaatttcttagtgattctgaacttctagaagattctgaaacagaacagtcttactttgggatgtattcaaatcctagagatcagtcacatcaatctgtgccctttttcattatgtaacatgaaacaggaggacctttccaacttgccttgggaacctgctcctacaacagggtatattatcacatttaataaagaaagagtaatatttgcattgtgacccttcatctgaggtcatcgggactgtgctgtcctcccaagctccactgtaaagggatagacaacaaccttgtctcccagtcattgtaatctgtatcagagagcatcattagatgaatgaagatggaaatgttctcacggtcagcaggtggggaaggcaagacttgctgattggaagcaatgaaccatagttcattctaaggcttggggagagcaactttgaggaaatgaggcccctaaacttgccatgtaggagaagttggggggtggtaaattgggcaccctttatctactaaacgtaatctttacttccccaccctctaatttttctcagttgggcttgaaattgtttttgcttgttacactttatgggaaaagaaagggaaatcctaataaggtccatgccagcaaaactctagaagaagaaactaagaatttcaaattgacagtttgttaatgagaaaagacaaggttaaaggattttgttaaacagatgaccaaaataattattggaaacttctgcttctggccaaggtggaataataagggctacatttaccttcccaccagaaaatataataacaaacaaaaactggacaaaacactggacatgacactgttgtctttaaaccttggacatcaatcagtgcaggatgttattttgtaagaaagggaaaaaaattggggtgagccttctgattgtttccagactggagagaagtttcaggccacagcaagtggggaggaacctaggtgtaagtatatgtataaggtagcacatcatagtggccaaatgaatggcacaggaaagaaaaactacaagaacagaggaggtagggccacaaaactagagtggggtccaagattcactatggataaaatggggtgttaatttggttttcaaggccaatacaagaggaggcatagaaaaagaacaaggtggtgttgggaagtagtataaaaaggggcacaggcttatccttgttttataaaaaacaaaggtttttggaagggatttgtagagataagtttgaaaagtagtttgagactatgtgtggaaattcatgaatcttagagtttgattttattcaggagatcagtagcttttaaaatgtaaaataaaaccagtaaactctatctaaaataaattcttcccctaatcccaatataaaaaatacatataaaagcgtagctgctctagacaaaatggcgggtatgagatgaccagaaacctcaacagcactacctctggtagccccatagaactgccaagagttttcagagtatagttaattcctgctgacggctaaggcagtcattgagtgattggaaagaagacggaagatagacaagatcagttaattgggttggagggaagactgaagataggcaaggtgacaaattaggaactgttgcaatgatctaggcaagaaggaacctatgaactaggagggaggcttaaagacagcaaggagggaactataggcagggacatgtgaggaaatgcttagtagttaaggtgagtttgtaggtatgaaaggagagaaggaaagaacattaagtagcattaagtgaaccagataatttatagctccttgacctgaaacatttagaggctgtgataacactaataataataatctataattacataaattacgtagtgtaatgatatatcatgatataatcatcttaccaatgctttacagtcaatgacattgtggtacagagactttggaggcagatagacctcgattgtaacctctgtgctgcccgtggtatgaccttgagcatggtagttaatctgaacttctttcttttctgttaaattggggacaatgacagtacttaaccttatagtacttgaagggagagtgttagaattgatactggggagtctctccacagaaagttgtattagttattgtctttatttcattcttaatgaattagcactcccgttttctttaacatgttgaatttaaaacctcttagtgtatttctttgtcttgccttttaataccccatgaattattgagaaacaaaagaaagtgattatgcaaatgtttgaaatatctaataatacatgaacgtagtcatgggaaactggagaaataactttactgatattatactagttttttttctggaagcatagcatattaagaaaactcatttcaatgaaagaaaatttaaaaattagagtgcattagaagcataatccaatgaattctattcctaatgaatactcaggcagtatgttaactttttctgagatacaatagccaagccaaagaatttaaagaatgaaaaaaacagatgattaaacaaactgtgaagtaattagaggtagtctttgaaaatgcctcattaggcatttgactcattaggacagatccttttattttagggccaggacataattatttaagcagttgatgtgtctttagctcctttcaccttgccacaagttgtcgcctgtactgcctttccacctagcttccaagtccaggccgactttgaagagattccttagggctcacctcccctggagagtgccctctgtaccatctctctccctttcctcctcattcctattgcctgagtttattgttttaataaattcccataagttaacacctcctagggtggattagaatcattcaaatccacattgattgttactaagtagaaattttatactgagcctttctaaatccttacaacaacgtgacgaggatattatagttgctttaacccaaggagatgaaattcaaactggtggcattgcacacttacagtgggcttgcaggatgaaagagagcttggtatctcgatcccttatacaaaacaggtgggtcttgttagaaaaattcttcaataattgttaaggttaaaattttgaaaagtggttcaaagaaatttgctttgatgcaaatattgtctagtcagttacataacttgagctataatgacagtgtacactagctatccagggcacgacatctctattgtgctgttgaatatactgctcaaccattctggaaaatggcatgttcatgtatgaatgacaatgtatcttgtgtgtatggcattccaagccaacatgttggtccctgcaagtaaacttcttgactgtcaagaggctgcctgtttaatatttgcatgatctaaactaattgtttcctttgtttttttcctctgctttatgagctggtagtttgaccttttggcttttcccctgagagttaacaaaagttagacagttggggggtgaacttaagtaaaatccatatcactctatgttgctgctctactaacaattcaagaaaatgtcttggtagaaagcaaggaatgagttttaaattttctctttgaatttcaattatccatgccactcctgtggtccaccattctatataattaagaataagctgtatgttccatagtgacacaggctgttatttctgatttgcagttttcacttaacctagggtaaaattgaaatagaagtcgcatccttttttttttaccttcttccactcaattctagttagatatttttgaacttctataaaatgtctatgcaatattatcaccaataatgtgcaaaattactactcccatgtagaagaggatccattcttcattgaaccatacccttgggatcctatcacatgcagttggccatataatattttatattattgtttttttgttttgtttgttaagtttgtacctacataatggattaaattcaaaatctctgtttaactgaaacaaaatctgtttaactgaagcaaaaaaacaaaatctctgttttttgtttgtacaaaacaaaaaacaataatatttttgttttgtttgtatacttcatagggactttggaatttggaaaatatcgttcatttagggtatatatattagtccattttcatactgctataaagaaatacttgagactgggtaatttataaagaaaaataggcttaatgaactcacagttccacatggctggggaggcctcacagtcatggcagaaggtgaaggggaagcaaaggcatgtcttatatggcagcaggcaagagagtatatgcaagggaactgccctgtatgaaaccatcagatctcatgagacttatttactatcatgagaacagcacaggaaaaacctgcccccatgattcagttacctcccactgagtccctcccacatgtggggattatgggaactacaattcaagatgagatttggatggggacacagccaaaccatatcagtacattaaagaaaatatttgttagcgctaagtgaatctactttcacctacttgattatttgatgattttataaatagtcatctctttcctcatctttccagtcgtattttgttgttccaaagccaaaacctgtgtgtcttgtattcaacaacctgaatcatacagttgtgagacgtaaatgggtgtggtggttccacttacttctttacatagtactacaactaagccatctaagtagtctgctcctaaattcctccaagaagggaaatatcatgatttgatttaaatgtgacatcctttcttagagaagttttctttgtctccttcttccccagtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattgtaagtattgaacggatttttactaaatgaacaaatactttgataaaatatttttgattactgccaatatcagtttctgaattgattctaaaattcttctgctggaaagtagattagcgttagtatgactgctgaagccttttaaagtgggtggtaatactacgtttcgttttgtttcattaacctaagtgctgttctttggaatctttttaaagtaagataaattacattcatgaaagaagcatattatttttaaagtactttattttggaaaggtaaaatgcttgtgtagttataatttggttactcttgatttcaccttaggaaaaacaatatcaccttctaaccatttcttttttagtcaaatctcttgcttctatttctctctgtagatccgctattaaagactgtaatcactgctgcatctttcctgtaaggcttgatcgcattgttaatttctttctaaacttgtagagtaggtgtataaatcgtatttgggtaatacactgactaatactgaagaaccaggcattttcttaccccagtcctcacacgaagtagggaaatacaagtcagaacttatcttctcaaaactctgacctcagaatttcctgagaaatctgaacctaaaaagattctttgcttttgacattttttctctggtgtccaccgcaaggctcttgctcttacattttttttttttttctaatgtttcaaatagaagatggtagagtcatatagtacaagctcagcatcggaggggctactggaggtcaactagtgcaaatgctttctgaataatggaatcctttgggaatacccccttgaaagtcttcatctagcctcttcttggaaaccctcagtgatacccctcatcgtctcctatgatggcagcttctatctttgtcgtcagctctgactattacaaactgcttccttacattgagctgtaactaactaaaaagtttccacaccctgcttctattttagcctttgggctcataaagaacaagttgaacccgtcttatgcagaacaacccatctacgggagatgctcaggtttcctccatgttttcctttctctaggctaacccttcgttgttcctcacttactcactatataacctgatttcatgtctccttacccttcttgttactctaacttgagtaggctagtttcaggatccagcaataagtgtgatacatcaggtatgctctgatgagttgagagtagagtggacatagcatctcccttaattcagatattgtgatctaattggcaaatctggcaataaaagttgaaatgcctgatccaggacaatggctggtcaggtgccattgttctcatcttttacttttaggtgtccctcaatttgttaagttagtacctacgtaatgtcctgaaacttgttaagtttgtacctacataatggattaaattcaaaatctctgtttaactgaaaacaaaagcaaacttcttttcagagccagaatctggaatcatacgtaacagagaatgatattgtacaagttgcttcatctctttaagtaacggtttctcaaacttacaagattattgtgagaactaaattagttctaaagtgcttccatgtaaagtgtatgtaaatgcttaaaatatatagtaagtgctgaatgcatattagaaataataataatctttattataatttttactatttcatgagaagtacttattttaatactgagcaaataggaagagttcatggcttctctatgtttttgaagtgtcatttaatatattatatatataaaacatatatatatttcagtcacacatttgtccaaataccttgacaaattaaaacaaaataagacaaaattctcacgctagttatttgttataaagtaatagaacaagtgatatgttataaagagcatttatttctcatgtctttgatattaaaaatagttgtattaactttttatcaaaacgattgcttccttcatataaatctaagaattatgctgtctgataaatattggagagattaacttctttgaaaatatagaagctttttgtctttttaaaatagttgtttttttgcagatgttaatacatttcagcagtacagtatggcctttttcaggttaaggtgctgagcccaaacctcaaagaatcactgcaaaaagattggatcccccctcttcaccccatttcgtaatttagttagtgagaaccacaactggctaaacctttgtggggggccgggcactgtggctcatgcctataatcccagcactttgggaggccgaggcaggcagatcacaaggtcaggaaatcgagaccatcctggctaacacggcgaaaccccgtctctactaaaaatacaaaaaattagccgggcatggtggcaggtgcctgtagtcccagctactcaggaggctgaggcaggagaatggcgtgaacctgggaggcggggcttgcagtgggccgagatcccgccactgcactccagcctgggtgacacagcgagactccatcttaaaaaaaaaacaaaaaaaaacaaaaacaaaaaaaaaaccacctttggggggaaattatcaaataaaacaaactctttttagaattttacaacttttatgttaggaaaaaacaaatacatttgtgaaaagcttaaaatccagtaaatgacttgagggacttggggcaatcctagggtgatgaggagcaggttagtaacagtgaaggacttagcaccccagggggccagaggctgtaatataccttatgagcaagtcattcttatttagtcttgcccattaagaagtctacttggactaaatgcttttaaaaatgcccttttaatttactattaaaagaatattcctagcagaagtagtcttggatgctaaattctattttaagaataactaaaattagaattctgttctttttataacacctgttacacacacacccctacctagtgtgtcggaatcagtttgtatgggctcaccaaagcctactgttcaattttcaggagttttgtaagccatttgatgtcagacaagtggcctgaagtttgttatggtggtggtatttacaccatgaaaattggcatgttatggtggtagtatttacaccatgaaaactgctacaaatagaaatctttttcttcttctcttggagagccacttgttgaacacttaccagctcacctgtgcttgaaagtatttcttcaaataaaatgaaagctggttagctttgaaaattttttgtataaaagtttacacgggaaaaaaataaactaatttttttttccacctgtgttttcagggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggtaagaatgcgaagcgcagcttttaagagtcaatagcttttcaagaacttgttgtgatgtcatgggagaaatagtgggggaaaaagaagcaataacatgttatgtaattggtttcaaggttacaggagatgtgttcattttcagtatcaatacactgtaattttccaggagattaggaaataatatttttaaatcagaatctagaagactgaaattcttaaattgacataatttatttttaacccatctcatttaccaaaaagatttagggtggacactacatggtaaaactatttaatagtgtatgttcacagtagcagaaacttttaacactaaatgaactacaaaagtttgtaatattaatgacctttgttgaaaacatctcaattattaatcaaacgattttatcttaaaaagatttttaagattcggtgtggtggctcgtgcctgtaatcctagcactttttggggctgaggtgggaggattgcttgagcccaggagcttgaggccatccggggcaacgtggcgaaaccctgtctctacaacaaatttttaaaaattagctggatgcagtggcacacacctgtggtcccagttatgggggaggccgaggtgagaggatggcttgagtccaggaggtcaaagctacagtgaaccatgtttgtgtggagtgccactgcactccagcccaggtgacagagcaagaccgtgtcataaaaaataaaccacacaaaaaaagagaaagatctttatggattaaaaagataataataagtgtatttactgaatgccaattatttatccaacctggtgtatgcttagtgttttaggagaaagagaaaggcaatggaaaaataaattaaggtatcatccctgaaagaaacttttagaaagacacagtggctgaagtgataccttgttccttcagttgattctctcagaactggtgttctggtaaaattggactgttactcctgttattcagggagaagaactcaagtttgtatggcaacaagactagaaaatgactttctccctgccccagtgtattcgttcaggagctaatgtagataaaccgaggcaagaagaagctaaattttttttctgggcttataggttaaatgagtgatagatttagttggaggttttctcatttggtttcttttaatagatgaaattaattgtttcctatgaagcatgaaatgttttatatgaaactaaaaaaatgtggagtttgtacttgcatttcaagggtcactgctctgttataggccaagtgaacttatgtctggccttagagaatcttacatgtatttgcatctatcagtatataaacatgtgggccgtagaataaggagccagcagtaccagaacccagccttgttagaggccaccattttggtggttgagtggttattagtttacatggaagcatggagaataataggcaaatgtaggttttcagtgtcagtcgaactggcaaacaaaaatttctggtcatcttcagaatgaaaagttttcttgagtacctacatattttagcattttcatatgaagcagatacattataagttaattgttggaatctaattgtaatatggctgtaagttttttctttatatttgttattgccttgttcttatattatagggaaagagaaacaaacaaacaagcaaagaaactaatggtcatatatttgagagccaactcttggttgctgttcagttttattttcctgtaaacatatattttcccttatgaaatcttgggaatattagctctggagcactgctgaactcaagtacagacattttcatgtgtatcagtagattcccatcatgacatttttataataatgttgaagagcattttaaacaactggaattaagctcaaatacattaccagtggttgaagaattcacatcaataatcttctgaatttaggaataaaatggagaagtcaaggaaaggaaaatattatacacaggctagcaatagttaaaatacaattattaaagccagagctagacaaaattatggcaatgagatgtgtaacaaaaccactctgtaacttcatcatgttcgtttaaaagacctgaatgattccaaaatccttagaccaataaactatgtcttcttacttgataattaaaaaaaagaattataaaggcaaaaatgaaattatatgtatgtgtgtttgtgtgtgttccatgggaatacagctgttgtaaatcaaaggcctacttgcctgaccaagcagaataaaaatagtcattgattttaaagagactaaaagtgagggaagaaaaaagtcttctgcaaaagctctacagatggttgtcaaacttttcagaaaaatagacaaagcaacattttgaaaaggatttatatcttttatatattcaaataccatctgttatttaaaaaacatagcccacactgaatatctgatatagacaatataacgtttatgagataatagtttgagaatgacaataataatagtaagttttaaaagaggaaataagccgggcacagtggctcatgcctgtaatcccagcactttgggaggccgaggcgggtggatcacctgaggtcaggagttcaagaccagcctggccaacatgacaaaaccctgtctctacaaaacagtacaaaaattagccaggcttggtggcacacatccatagtcccaggtacttgggatgttgaggtgggagaattgcttgaacctgggaggcagagactgcagtgagccgagaccccacaactgcactccggcctgggcaacaatgagactctgtctctaaataaataaataaagaaggaaatagtaaatgtcattagtaagaagaatagcaaaatttcagttctagaaatacccagaattagctatatgatacaaaaaccctcatgaaacatttggataatcctcagaatacctatcaatataacaaaaactatgaattgacttcattttgaatgatgaatttttaacaaaaatagtcaatactttgggcttagtagctctagaagtgcttctttcttctttcttttaattaacagaatattgtcagaattttcaaatgttgatgattataagttgaattttccttttcattaacccctggggcttattttttgacttgatatgtttctctactcagaattaagatgtgaagagctttgggatagaatgcatcatacaagtgtgagagtcaagttccaatccataaagtacttctggtagacctggataaagatgaccttaagaaatgattttttttctctttgcagtttaaaaacaacagtagcaacaagaatgataaaacctatgaagccagctctgacaaaagatgttttttttataacacatactatgtatctactttttgatatttatctatcgagaagacttttctccttattgtttgctctgaaatttgtttatatttaataggaattttatagccttatccctgggtagaaattcagtttttttaaaagtagataattaaatcttaatttactattattttacacatggtgaaactagtcaataaatgtaatatcattgagctgaaggttaaaaaggaaaaaatatgactgcaagagtggttgtatttttgatttcagcatcacactcaattgcatcattgagtggttcattcttagtttcagtgttaatgaaatacatctgagtttttttccccagaagcttgaattgtgtcaccaaagtgtcattttgatttattgaaagttaagccctttccaaaattcaccataattttacatgtctcgaaagcaattttatacttcaagtctgtgctatagttctatatattttatgaagatttggatagatatctagccctgagttttttattgcctgttaaatacttataacccaaagtgtagcagcctcatgaactgctgctgggcacagatctgggagagtgcactcagagtgttggcccaggaagaggaaaagaggaaaaggggcagttcagtggcagcttggcttcctgtgaaacatgtcaccttaaccacttcctcattcttttagtggcaaactagacgaccttctccttcccctttcctgccgagtccccctctaatcaacactctagaaggcccctcttcctcctcagtcctgactccctgtcatttacttcaggttgcctccttgctcagttttggccccaggggtaggcaatctcctctttctggacatgtctcccaccagccccaagttcagatttcttggaagtttctgtgttgtctcgaggatgcatggttgtgtgagttattccagggctcaaggcctcttctgtgtctgtattccccaggaatccaggaattcacttctctgcctctcatcctcatcctcatcattaaaatgagcagatttgagctcaggaagtgcttgaataaatgaataaatgaacaaatgaaaggtgatttttgaaagtcttaattttaagaagtctctgagccctgttacagctcaattttcccataaactagaactgctctctaaggctgtgacatttctcctttttcctctcctcaaaatctacctgctgttctgatatctccctgacagccaccatagtgagattctatttccatttccaatctctcttttgtaagggacagagaaacagctagagaaatatggagccatgcgctctgaggactttagcaggcttcaactctatctgcaagtgagtttcacttagcgaatgaaattggaaacttaaagtgggtagggatgagggttcccggagaaggtgtaatacctcagtctgggaattgggagcatctacaaggaacacactcaattctgggaggttcctgtagatttcagagatttagcagggcttcccagcactctgcttcccaacctgtcattggaccagtaaaccctgctctcaaactgttgtggtgtccagcatgctttggcaaggtaatgaaagataacatgacatggacatatgggtgacatcctggagagatgacagaagcctctgtttaaggacaagatttgccatttagattttgcacccactgtataataagagccttaggattgggctggaatcgccctagcaggcatgatggcagcccctctggactggcaatatgcagcttttttgcaagtgttccatgtccaagtcaccccacccagctttctactgctcccgtggaagctctggtgaaacgcaaggaaagcagctgctgttgactggatttttctttcacatgaaactttgaagcctcatagatgcttattggcctggatgctattaaacctttaaaaatccctttctcatcttgagagtatttgagaaacatgtctggggcattttgcccaccctcctccaggttctgtgtcagtgagtgatatggtttgcctgtgtccccacccaaatttcatcttgaattcccatctgttgtaggagagacccatggcaggtagttgaatcatgggagcaggtctttcccatgttcctgtgatagtgagtaagtctcaagagatctgatggtgttaaaaaggggagtttttctgcacaagctcttcttctcttgtctgccaccatgtgagatgtgccttccaccttctgccatgattgtgaggcctccccagccacaatggaactgtaagtccattaagcctctttcttttgtaaattgcctactctgggatgtgtctttatgagcagtgtgaaaacagactaatacagtgagtctgggtcagtgtgtgtttatgttgaacgtagtggacttgtggtgtccccagggcaccctgtggggaatgttggcctgtggctttgctacttccagggggatttggcatggagaatgtgtgttttaagtaatagatagattatgattgaagtgtgttatgggctgagttgtctctcctcaaaaagacatgttaaagtcctaacccccagtatctcagaatctgaccttctttggaaatagtgcctttatataggtaatcaacttcaagtgaagtcattagcacaagccctaatccaataaggactggcattctaatgaaaggggaaatttagacatagaaacagacatgcacagaagaagatgatatgaagagacacaggaagaggacggtcatgtgactggagtgctgggtctgcaagctgagaaatgccaaggtttactggctaacatcggaaactagaaggggcaagagtggactctccccctcagagagagtatggccttgatttcagacttctagcctccagaactgtgaggcgtacatttctgttgtttttgaagccacctagtttttgatactttgtatgggagccctaggaaattaatacaaagtgtattaaaaatagaattttcttctattgtatttttgaggcaaaagaaataaggagctattgatttaaggaggaaggtttggctcatctagtatagacttggctaatcatttactcttgtatatttctcttctgcctgcccaagtagttcactgaacaggcttagaagttgatttataattgtaagagtttacacatcagaagttaatttataattgttaacagtttcatgcatctacctcataaataccttgtaaaagattttacccttcagaataatgttttcctctggtactttagtagtttatcctttttttgcatctttgatgcatttgaattcatcctggtatgctgtgtgagctggggctccaatgtcgttttcctacagatggctccacagttgtttcggtttcattcgaacagcctcctacagaagtatttttcagacttcttttatacttgacttccaagtttactactggttaagagcttttaaagtagggggaaagatatgacccattggcctactcgtttgattattttttccaattctgaaatcaaaaattaaaaaatttattcaaagttatagtttcacttaatttatattaactgcatagatagtgtgattcatctgtcctgcttggacatatttagtaacttttaattaatcttagagataaaagatagaaatctatgagacttgagacattcaaataagaccagtactgataagaggtaatcaggtgaagtgccatttggttgtaataggacatcaaaattgttccccaagagtgaaggatgttccattctcacttttcccatctgtcctcccaaattctttcactcttcctgatgctttgaaccaacttgaaaagttagtccactcagaacctcagctgttaaacttttagcctctgcaaacaaactagccgttttcctctttgtccctttaccatcaagctcagttgcttctcctactcctctcccttctgccaggggctccacccttgttcctcattcaacagtggaatcatctgtgtgcctgtctcctctttactgtgtaccattgggtcctcttcttcaccatctctaaatttatgcttcttccctgttccactgtcaccagcttggtctacatcctactttgatcatttggatttaggtcccaccctaatcgagtatgacttcatcttaacttgattgcatctgcaaagacctgatttccaaatacgaccacaagtaaaggttcaggtggacatgaatattaggagagacagcacttcaattaacagtttggcattaggactttattatctagcttagtaattgttttaacagataaataatagtatcccctaaagtttaaaatgcagaaccagattatgcctcagggtgcctaacctgagaggaagagtctttcttcaacagactctgggaaagacctttgtaaaaaggctggtgaccattctatttgatttctactttccaatattaactgcttaagtcagacaatctccttggcccacgctttcccctgccattctccccttcacataatgtcttcattttatttttcccttgttttattccctgaactcccttctctctattcagattccctgcccattttttctcctaatgagacgcctgacttcctacctcctttttgaaacttcaaactgcttagcaaatacaattttgaattgagtttgctgtcacagaacaaaaactagtccttggtccagagtatcttgcaggactgaatcaactgtggtctaagacacaataataactcttaattattttcttgtttccttcatggtatatttgttgctggatgatgagtttatattatggttgaatttcctttttgaaatgaaaagatgaatagtctttattggctgggtatctatttttatccagaagactttgcaaatgagaaatatttctacaatctgagtttaatttgcttaagcaatgaacttgttctttaaaagtcgtatatgtgcaaaataaatttaaattaaataaatcatattttaatgtagtcagggtagctttcatttaaataaaacctatgacaaatatccacgtgaagttatcactcctttaacaaaacaagtgttctccttttttattgaaatactagttttcacaaattgagattccttaatgtgatgaccgcttggactgactatagtatagctgcgttcttagaatggccctgaaaccacaaggcctctccaagatgcatgtggctgactttctgaggtgactgcattgaatctttctggcttagcttattctgcatccagatccctggaagctatttatccccaaacagtggtatatttagacccattgtgtgctaacctctctgtgccctaagtaccaacatagccaagccaaagttcgaactttgctgccttacaatggaggttacatcgtagtgatgaaagaggttaattttctttaggagttgaagaccagagaactgcaaaaaggggagaaaatcagtgtggcctctaatgagagctaagtgagtgaggcaatagaaaacagtgaggaccggccagtgcggtggctcatgcctgtaatcccaatactttggaaggctgaggtgggcggatcacgaggtcaagagatcaagatcatcctggccaacatggtgaaaccctgtctctactaaaaatacaaaaattagctgggtgtggtggtgggtacctgtagtcccagctactcgggaggctgagcggggagaatcgcttgaacccgggaggcagaggttgcagtgagtcgagattgcgccactgcactccagccggagtgagactccgtctaaaaaaaaaaaagaatacagtgaggaccttggagggaatcttacagtggagcagaattaaaagagaagaattcacctatttcctatataactccctctgtaaccgataactttctagagaaagctcactgaatatatttgaaatttgtttcataccacttttatgttattgccttctttcacaggaaccagagagctctaacctgtagatttgctttgttgtctttactttagactacagcctaaactgactgttgatttttggcacaattattacatctctcctttcaccccgcctctagccctttcttaattacccccattaggcatttttcttgctagcgtgaactaaatcccctgtctcaagcacgcgcctgtacattgaaatagaatgttaattcattgacgaaattaactgttcttgattgggaacccctagttccagggaatcttaaggtttcaattctgttgccttggttactaaactgttccatgcagtttgctcaactttgaatggatacttctcttaggaacattctcccttgtaagtaaattgcttgacgtgttaaaatctaagttctgttttacaattcttgagacaaattcaccatgatttagttttaaaaacaagtggccttgtccttttagtctaggatttatcacttagctgtatctagcaaagcccctcacacaatagtaggaaaaagcagaagtgtgattgctaaatgaaggggaaatgtaataaaatgatggaagtgcccttttttagggggaattaaagtttctctttgtagtgttacatgtattcattatgtgactttcataaatacaaaccccaataaaacggtgggcagttccgtctctggagatgttaagtgtctcttcatagaataacatggcacatcataacatttgattccttttacctggtcaagatgtttgcttatggcatttgaaatgcatattttcaaactaggtagatgaatggtttaaatataaaaattcattcaaggccctgagctatagaagaatatcttccaaaacatgcattcaagttctatctgtcagtgtttttctttttgcatcaataaggcagcaatggaatacaatcagatttattttttctttattgctgtctacaattcagagatataacctgaaaaatatgttgtctcttcccaagtagatcttgtaattctctgaactgtgatccagaccaatgccgcctttacattgggtctgtggaagtgggagggtccactgaacctggttatgagaggtttcaaattgaaaagatttacaagtatgtaaataaaatcaaatagtcaattagtatctaacatatacatgtcaaaacacatagccccaatctcataaaatcaaagagatctacctaaatagatttgtttgcctaacaaatagcaagaccactttgacagaatctttagcatgacagtgattgtcaaaatgggtaaatggttattattgcccagttaagtaatttctgatttgctttgccttgattactcttaataaactaaacttaacataccatagaagcaatattttttaaaaagagggtatattctagagctagatagggtgttgtgcaacaatgtgaatgtacttactaccattaaactgcatacataaaaagggttgaaatggtaaattttatgttatatacattttaccaaaataaagaaaagttataatactttccgtagcatatataaaaaagaaacagacatttcatagcaaaaataggataaaaatgatattaaattcataggggatttctcttatctaaaactttagatttgattcttagataagaatataaacacattgcaagaagataaatcaataagccaatgaagtaaggtggaataaataaatagaaataggtgatacttgcggctctgacagcatctgataataatagtacaaacagtttcatttcatttaacagttatttgatgaactcctgtgtgctaggaactgttatttaaaaaaagtaacttttattttaggttcaggggtacatgtgcaagtttgttatataggtaaactcatggctcggggcttggtacacagattattttgtcacccaggtactaagcatagtacccaacagtatttttttttccgaacctctcctcctctcaccctccctcacgtaggcccagtgtctgttgctcccctctttttgtccatgtgttctcattatttagctcctacttataagtgagaatatgcattatcaggttttctgcttctgtgtcagtttgctaaggataatggtctccaattccatccatgttcctgaaaaggacatgatctctttctttgtttttatggctgcagtgtattccatggtgtatatgtaccacattttcttcatccagtctaccattggtggacatttaggttgattccatgtctttactattgtgaatagtgctgtaatgaacatacgcgttcatgtgtctttatggtagaacgatatataatcctttgagtatatacccagtagtgggattccttggttgaatggtagttctgtttttagttcttttagttctgtgtgtgaaaacacaccagagaacaaaattgaccagatctctgccttcacagaacgttcattctactgtaccagttatttcatgaggaatatgaatactgttattactctctgcccatttcacacatgaaggagcagaaatggagcagagtttactaatttatctgttgcagatagtagctaattgtgtgccaggtgctgttccaagcattttacccctgttaactcagctgagtgcttttattttccccattgtatgcccaacttatggatgacagcactgaggtagagaaaggttaataacatagaatagtttagtattagggaaacaatttgaattctaggacacttttactgaaacttagcataggctaaagaagtgatcgtgcatgtttaaagagttgtatcattttatcattatttgactttcttttccaaaaaaaacaacccttctcctttctctctcttccatgtgacaaatacatgtctgtatacatacatatatatgtaaatataaatatatataaaaatatatataaatataaataaatatatatatatatatataaatatatatatatatataaaatttttttttttgagatggagtctcactctgttgcccaggctggagtgcagtggcatgatctcggctcactgtaagctccgcctcctgggttcatgccattcttctgcctcagcctcccgagtagctgggactacaggtgcccgccaccacgcccggctaattttttgtattttttagtagagatgggctttcactgtgttagccaggatggtctcgatctcctgacctcgtgatccgcccacctcggcctcccaaagtgctgggattacaggtgtgaaccaccacgtgcgacccacatgtctgtatattacagccgttgaaggacacaacttttgccattgggcgacccagtcccctagtaagtgttcaaaaatattcgctattatcattgttggtgatttcgaggatttggatataattaatttgagcctaattttttaagactattacataactatacaaaaaaatcatgagagagcctggaattttgcaaaactaggatagaaaccagtttctaaaaagcattttaaacattcagcttgtgtatttcttttcacttgtattttgtgatctgcctccatgctttcatgcctttctcttcaaacaatcttattaccactaaccaaaaacaattaaaatttgattgttttgtttttacatgttgttacagttaagaaaaaaaaattctaggtattgacccctgccagttttcggagttaatactaactagtgatttggggctacatttaagtgctttaagctatcctacaagcttaaagtagttatacatgcaaatacttaaatgaattaggtacaagaatacagaggtaagaaatagaatctattgtagaataaatcctatttcagatgtgactgttttaggatttgaatcaaccacatattacagaaaaccccaagataaagccttggcataaccaagacaaagtttatttttttctctcacataaaattagtccagacttattttaccagtggtatggcaactccacagtcaaagggacccaagctcatctgaccttcgattcccttatcctgggacaggcttacattctcaaggtcgactcctggcctaatggggctactggagcttcagccatcacactctgtgcttcctgttatatctactggtcagaacttcagatacatctgtctaaaaggaacgctgaaaatacagtctttaagctgtgcaattgtacctggaataaatgagttcttttaataaaaagagttgaatggatatttggtgggcaaatagcagtccatgctacaataataaacttcacaattttagaattagatatcttgtaatgaatattctgacgtggtgtcaacttataccatagatagattataactttgaaaaggaattagaacacaataataataaattcacactaaggctcttttggggaaaaaaaatctctaccatttattgagtgtttattatcttcacaacatccctatgagttagggattatttttgtggacattttacagataaagaaacagaggcattgagatgataactagcttgactaaggagtggcggagctctgggcagtgtggttcctgtgtgcccataaggccattgcacaatgctgcttcatcatgtaattcagaaagtattgcaggatgtggcagttggtcatcatgaatgttcattgttatcttgtggctttgtgaaaaattctggtcattcaaacgatttgactgttgagattctgtgcacatgagattgtactgtgtacatgtttctaaaaatgtgtgttatagatcaaaatgcacacactcatttacctctaagaacagttcttatattgaagggaaattatctgtacgtgagagaacaacgtggttttgagtacaagtggtgaacagacattgaatagttgttttcagaaagcatcactcccctgtacctcagaacccagcctcagtgctggttgcgagccaacagctttgatgtcctgaagtttttgcatcacttctcttttgcccctctttgggattcaaagatgataagtttgaagtggagttctaccgcttccattggaagagaaaaagtttccgtgtgtgtgtgtgtgtgtgtgcgtgtgtgtgtttacggagaggagttctatgcatctgcagagggtgctgccatcaacaaggagaacagagtgggatgaagggtttgggaagccaggatgggcatctctgacgagctccagaactctccacctaagtgtgcaagtgtaaacactccctgatgtgtgaactggccatctcaagactaagtatttagcaggaaatgccccctattcaacccttgccttctcaggtgtagaggttgggttgtctcttccatctttgtttgaattatgtcattaatcaaccttagtgaaagatcacttagtcatttgtgacagcataagttcttaattgttaggaatcactggtgcggcacacatctttttctatccatgaacaacgtcaaatgcttattttctcatgagcttttattttttccttttaaaaaaagtttcttaggataaacacagcctttttccttgtctctcccttgccctctcatctttttctcaatctttatattcctatatgtcactgaagagtccccgtgccaacgctgtgcagtgggaggctcctacctccaccagcttttgaggaggttgtagtcctgcaaccttagaggttccacagccaagctgggggtctttctggagcatgggtggtgaatctgagatctatgcacccaggaagcctgacacattattgtggtgtctcaattcttttttttttaattagaaaaattgtatcaaattgcatttggtgagagcaaaaataaactgaagttggttgagctttggaagactacaagccactgtaatatttaagatttcttgacctccagaactaacatttgtcctgtcagagaaaataattactcctgttgagaatacatgcattaaagtaagatgttcactactctatatgatcaccaaacattaaataatatgttttacacatgtatgtactatgtgttcaagtgtttataaatccatggagccaatagaatgtaagttctatgagggcagaaattttaatccattttgttcctagaacagttcctgacacatactggtgttaggggtaggtcttcagattttatggatcaaatggaatctccacacttaaaaaaacttagagaaaaactgccttaatgtgcccatagtctggttggaaatggcagctccaggttcattgattgctttgttcattcggcacttttcactggacatgctatgagcccagcagtgttctgggtttttgggatacaccaagccctgcctccccggtgcttaacattctagtgggggagacagaaagaaagcaaacatggtggacaacttaattatctatttttgaaagttgacaggaactgtggacaaaagaaaacaagagctggagacagcagtgccagggcagggtgagggtcaagttagagtaagcctcattgagagatcttttgagcaacacctgaaggaggaggtgagaaagttagccatgtggagggagcagcattccaggcaagtggcccaccaagtgcagagtcctgacagcaagagcagttctggaatattctagaaacaggaagaagaccaatgtgactagagcagagtgaggcaggagtgagagaaaatgtgatcaggaaagtaaggtcctgtggccactaagattttggcttttattctgaaggaaatgaggactcattgcaggactttgagagcatgatctgacttgtcacaagtgttctctttgtctactgggttgagaagacatccaaagggggccaaagattgaggcagggagagcagctaggacaggctctagcaatctaggtgataaatgaggaccgatggtggctctgacaagggtggtaatggagacatggtgaggagtgaccacatttcaaatatatcttgaggtagagctgacaggattttcccgatgggctgggcgtagtatgtgagagaaagaattcagttatggatgattattttgtcctgaacaatgataaaagttgagtcaacaactgatatggggaagtctacaggtggaacaagtttttgaggaggaaatcagttcagtgttggctatgttgaatttgagatgtttttagaccatctgagtggagaaatctggagtttaggagagaggctggacttgatatgatgttatgggtcctcagcatagagatgatgaatgagattagcaaagtagtgagtgtaaaaaggaaagggaaggagaccaaagattgagccttgggacagtcagaaagaagagagggaacccgcaaaggagattgaaatggaatccatctcactgtggcatcgtgaaagacaaatgaagatggtataagatgaaaaagtgatcagctgtatcaaatgctgctattgggtcaagtagggtgagaattgataattttccatcttgtcaagagcagccgtgatagagggagggggtggagatatacttggaatgagttcatgaaaaaatgggagggaagggattagaagcagcaagtataagcagctctttcaaaggagggagatggggaatggctactgggatgccatcacatagataggaaggtggaaccctgtgcactggaggagggagtgtcctcacagaggaggacaggcaggaaggtagagtgggctgctttgggcacatgtggttctgtggatgttctcttttgacagcttcagttcttcagggaattgggagcaagttcatcagctgagagtgaacatggggcagacagtgtgagaggtcaaagcggcaagagtagttgtgccacagtcttttaggagagagggaaagtaaatggaatggggaaggaaagtaaatagcatggctgctgagctgcgttacaagcccacccggtgttgggttgtgaggtgtagttgtgggctcttcttcagtcggattgtcagcatgggcggctggcagagagttgaatctgacagggcagcagttctggaaaatgagtatgatgagtcaagaaagggaccaggaagtggaaactgtgtgtgaggcagtgatgctgatgaatgactgtggaaaacaatggaggtgaggagggagtggatgttgagtggctaggggacagtgaaaagggagtaggatccactagcttgctgcttgtctcttataattaggatcaagagcttctgccgtcttctaggcattctgctgcttcaagggagtctctgagattgggttctgcatggatgtattgaaacatgcacctaggtgtgtttggagtcctgccagagacctgctttctctttattcttatcctgaggccctttaggaggctcagatggaataatttttatggtttcttaaaacccaagtgggttacctaagccatcatagttctgccccctgttccctgagaggaccacgggagcaccctgaaatgggttttccactctgccatcccccacttgcctgcttgggtgttgacctcagccatctacacatatcccggatgtagtgttgggcccctggttgatgtcattccttttcaaatgggatcttttactacagcaatccagcaacaaactaaatagcgatagagttttctttcccttacaaaccacaaccacaaccaagggaaaaaccaaaccaaaccaaccaaacaaacaaaacaaaagtatgtggcttcttaccacagccccctatctcgcccaagccttgtggctctttgatctctggtgttctgaaattgcgtaatcatgtgcttgctctttttcattcattgtgctgggcacacacttaatggaccctttcaagttggttttcttttatggggtaagggtaggcaggactattttttaagatttcttccactttgtcttccaattgttctaatgagttttttaaaattgtgcctgtcctgtttttaaattccaagagatattctttgtcctctaaatgtttcttataaatatatataaaatgaataatataagcatatagttttgcatagatttgagttcgctgttacagtgtccttttatttctctgaggatattcattataggttttttaaaaaacactttttctggtccccaaattatctcttctctctagacttcctccattcatgccttccttcccccctccctcccttcctttgctcttgctcttgattttggaggcttgtcataaatatttgaccatccattcattttttaaccataacgaactaaaaatgttaattggagccctgtgtgttccttgagcagaatgtttggattaatgagcttccgtgcaatgttttctctggaatggattaatttctccagatctataatttttcaatctctttccagggggtaaaagcctggttgtctgtttcatgaaagtaaaaatgtgggtaagagtgatcccagcattcagaatgcagacttagtagctgcttgttttcagtcctgggacttcacccaccctcaccacagttggtatcccaaagtgtgaaactccttagattatctttctcaagaaaatgaaactcagatattcgtgtcctttggccatttttgattagcttatttgttttcttccttttgaattgtttgaattccttatgtattttgaatattaaccccttattagatttatggtttgcaaatattttcccccactctgtgggttatcttttcactttgtcaattgtttactttgctgtgcggaaagctttttagtttcatgctatcaaactaattttgcttttgttgcctgtgcattcaaggttgtatccaaagaactcattgcccagatcaatgtcatggagcatttctcctatgttttcttctggtatttatatagtttcagtgcttttctttaaattttaatccattttgaatggatttttaatagggcataagtgtcacttccatttttttatatgtggatatccagttttcccaacaccatttattaaagaggctgtcctttccctattgtgtattcttggcacttttgttgtaaataagttgatcttacttgtgcgggtttatttctgggccttctaatctgttccattaattcatgtgtctgtttttatgccagtatcacactgctttgattacaatagctttataatatatcttgaaatcagagagtttgatgcctctagctttgttctttttgctcaagattgttttggttaattggggtcttttgtggttccatacagatttaaagattattttttctatttctgtgaaaaatggcattggaaatttgataggaagtgcattgaatctgcagatcactttggatagcatagattttttttaacaataataatttttccactccatgaagaggtatacttttttcatttatttttgttttcttctatttcttttatctgtgttctgtagtttttagtattcaggtgtttcacctccttggttgaatttaccccaagtattttgctgttgttgctattgtaaatggaattgttttcttaatttcctttttggataattctttattattatatagaaaagctatggatttttgcatgtttattttgtatgcttcaactttactgcatttgtttatcaggttttaacagttttttgataaaagttttggtgttttctgtatatatgatgatgtcatcagcaaacagagacaatttcatttccctattttctttctttttttttttttgagatggagtctcactctgtcacccaggttggagtgcagtggtgcgatctccactcactgcaagctctgcctcctgggttcacaccattctcctacctcagcctcccgtgtagctggggctacaggtgcccgccaccacgcccagctaatttttttgtatttttagtacagacggagtttcactgtgttagccaggatggtctcgatctcctgacctcgtgatccacccgcctcagccttccaaagtgctgggattacaggcatgagccaccgcgcccggcccctattttcttaatcacgcgatatatacaggcttgttgaaaaacatgaaaatgataaagaagtttatgtattaagaggcaaaagctatgatgttcaactcctctaaaaccacttcttagtaggtgaacattgttaaacagttttgtgaatctgcttccagattttttctaggcatgttcatacacatatacacacataatttatttttacccagttgcgatcatgtatcatctgatccaaaactcgctatttttcagttaatatgcagtgactgtctttccaaaccatagtatatatatatatctctaagaatttttcaaatctgctatagtttttaaacatatttattgttacatacatatgtgtataagttacttatttgcttatttctttgaatatctttgtctagctttggaatcacataaataatgagtacaaatggtaaagaaatttcatgtggaaggatatatagaaaaagtacaagtctctcttctcatccactctatctcattacctaaaaggttatccttagagctttatataatacatccctgaagtttagatcattttattgcctcccaattgttgagagtaaggaatttagtacatatacctttcctttcactttcctaccctctacctacttaatgagttcgattatagtttttcagttcacccactgttaaataatatacctatatttataatatacctatataatatacctataataaacctatatttttgacttatcaactttggacatatctattggtgacttgtgatgagagatgaaataatttgtacatttacccttcttttccattcttttcccctacccattctcccctttttggctaaatgattgcttttaggttgataaggtttataatagctactgttctgtggttataaaatttgtttcatattttatgtgaaatttgattatacaactagcattcaaaacattattatgtaaatattagttactgtaatcacacagtgacgctcaaggaggtatttactaagcatacagatcattccttctggatccaactcagcagttgctttgctgtgccttacctcatctttcgtggattccttttcttttgattgcaatatatccttgagtaatttttcagaatcgatatgtactgtctgaactctcttatacccaaaaaatttgctttcacatttgctaatagtttgacagagtatcaaattctgctttcaaattctttccccttcatggctttgaagatactgccccactatatattctaaaatccattgctgctaatgagaaattctggtgtcactctgactcttatttctttcatatcacttggcattttcttccgagaaaatattacttatcttcagaatgatgaaccttctctatcatgtctctaggtgttagggcttctttcatttaatcctgtaggtcctcaataggctttttaattaaagtctcattttattcgggctctgtgaaattttttgttatgttttggcttctttttctcttttgttgtctctcttttctccttgaatgtctttctgatagatatagcattcccattatctatcatgtctttcagattatcctacatttttctctttgttttctttttctaccatgtttagaattctcttacacgtaagacatcacttactagatcttcagtcatatcctttttattattcagtctgtgcatttttaattttcaattttggcaaccacatttttaatttctaagaatctattttgctaatagtacttttgtcctgaaactttttatatcctgcaatatttagaaagagcacacccttatccacagctgattaggagtacactctgaatgcagggcacgatgggcgaacattttgttactggcctcctcaagcctcaatgcccagaagttattgcctccatcagaaacccttcttttgttctatccctcacttccaaatgaagttccagcttaatttttgctgtcactgtagtgggacaagcaaatccctatttcacgtgatcattgctcaaacctctattgacaatcctgctttgcattcccttatttagagtgggatggaaaataaaggctatgaagggggaagaatctgatcccaccattctcctttttcattgcagttttctccttttttatggatgcaataagctgttgcaatctctcaggatggaaaagaacattttaaaactactctactgccagaatgatctcttttttttaattatactgtaagttctgggatacatgtgcagaacatgcaggtttgttacataggtatatacgtgccatggtggtttgctgcacccaccaacccatcatttacattaggtatttctcctaaatgctatccttcgcctagcccctcaccccttgacaggtcccagtgtgtgatgtttccctccctgtgtccatgtgttctcattattcaactcccccttatgagtgagaacatgtggtgtttggttttctcttcctgagttagtttgctgagaatgatggtttccaacttcatccatgtccctgcaaaggacatgagctcatccttttttatagctgcatagtattccattgtgtatatgtgccacattttctttatccagtctgtcattgatgggcatttgggttggttccaagtctttgctattgtgaatagtgccacaataaacatacgtgttcatgtgtctttatagtagaatgatttataatcctttgggtatatacccagtaatgggattgctgggtcaaatggtatttctggttctagatccttgaagaatcaccacgctgtcttccacaatggttgactaatttacactcccaccaacagtgtaaaggcattcctatttctccacatcctctccagcatctgttgtttcctgactttttaatgattgccattctaactggcataagatggtatgtcgttctggttttgatttgcatttctctaatgatcagggatgatcagctttttttcatatgtttgttggcctcacaaatgtcttcttttgagaagtgtctgttcatatccttcgcccactttttgatggggttgtttttttttcttgtaaatttgtttaagtaccaaaaacagatacatagactgatggaacagaacagaggcctcagaaataacaccacacacctacaaccatctgatctttgacaaaccggacaaaaacaagaaatggggaaaggattccctatttaataaatggtgttgggaaaactgactagccatatgcagaaaactgaaactggaccccttccttacaccttacacaaaaattaactcaagatggattaaagacttaaatgtaagacctaaaaccataaaaaccctagaagaaaacctaggcagtacaattcaggacacaggcatgggcaaatacttcatgactaaaataccaaaaagcaatggcaacaaaagtcaaaattgacaaatgggatctaattaaactaaagagcttttgcacagcaaaagaaaccatcatcagggtgaacaggcaacctacagaatgggagaaaatttttgcaatctatccgtctgacaaatggctaatatccagaatgatctctattttattttttatgacatattaatcatgtttgttctcttgtgtcctctctttctttctctcgattttccagtggtccatggtggtctatttgtagggttcatatttacaaatgggagtcaaggtgactccactacagttatgtgaaaaagtttccctgccatgcctctccctacactgggcgagctgatctggttccgggtcagtggatggagcatttcctctcgcaggcacaccttcaggctggtgggagcaacttgggccatggactggaaccatgtcaatggagaagacttcctctgtgccaggtcctggtcagagctgccgtcttgatttatttgtatccctctttccgtctgtggtaaagatctggaggttcttaagctctctctggcctcaaaacccacagcaggaaatttcctcactcagatcacccacatttttagcaagcagagcttcagttttgagtggagggcaggagtattgggcagtagggaaggacacagttctctacgccgttctgaatgcagtgcattaataaactctcttcacagttgctccagggtgctttgcattggtgaacttctggcttccaggaagaacctggttacctctgatgtgttgggttgttgttccatctactctaaattctgtgccaatccatcccatctgtttcctaccattggtttatttttaaaaaatattttatatttatgtagatttatgaacttgattattataccatcattagagtttgggtccagagtcaaacttctataaacctgtaatcaaaaattggcctttattttcatgtagaaggaagtagcagaccaaaatggagttctatattccatttttctaaatgagccattgagatgtagagcaagcaagtgcccttttgagggaatgtgtgtgtgtgtgtgcacacatgcaagggcattttcccatgtctcccatcctttaattattccagtagacagtgggccagcagcaggtggtggcataacttctccatttgcagtgctgtggctgtggtgggatctgaacaggaggcaaccttggcaacagtaggaatagaatgtggagtcagcaggaagcgcttttccctcccacttacctgtcttcttgtagcagacagcagtgcgggcagcttcggctgacttgcttagcctgtttccattgtgagcataaacaccttagacgttttttcatttcaggacactggagcttgatgaaattaaactacactcattgtctcaggcaaatctcctaatcctattctgtgcttttgttgttgttgttgttgttgttagtggtgtgtttctctctccacttcgctttccttttaaaacacaacaaatttttttttttaattttaaatgaacttattcattgcctccctatgtgtcccctcctttctagtgatattgccgctgttcattcccagctgttcttgattcttgtacaagactctttgctgggcttctgccttctagacgcttcaccttcccgttatttcttccctctgcccccggaaaggcccttaccatggctctgatgatgatgacagctgacccttttccaaggtggaatccacgtttgattctctgatcttgtactggcttagcacagtgctcggcattcagtaaataaggttaaggaaggccagtgatatagagtagtagaaaacagcagttaatgaaggcttgctttctgtcacaggttcctctcctccaggactgcagcatctctgtctttctgtcgtagcatacaagacagcatctctgtctttctattgcaacttccaggtgagaagccctcccacaagcatatacaaattttatggaaacagacaaaaatttgtagggaagcaaatcccttcaaggttgagtctttctggtcttctagaaggtaagcttggtgatggggcagtcacagccctagtgcttatggaacttggccctttggggacagatctcagttaactaaagaaatgctatggcacagagtaccttgaatctcctctaatttatgctgtacagggaattattcacactttattgttaataacacattacatgggggaacaccagacagctgaccaggactcctgtgcttgaaagcttctgctcttcagcagggcagccagcctcttctcggtttagcacagagcttttattctcctcgctctctctaaactcctgttcaagacagtttccaattctgttgaattcactcatttacctcatctgtgcctttccccacctcattctctccccttcagagtgcccatttctgtgtttcaaatcccacaaggccaagcttagatgctattatgtctatgacattctccacctctatcccaataaaaacctttgatttcatcttgctgtttgtatctttactctgttatatttcacccataccagagttgtttgtggacatgcctgatttccttcaggctgtaggcatatttgattcatttttgtactccatgagtgcctaacatagcatcttatacaccatagataattaatagatgcctcttggctgcatttgtattaaatttttaccatgtacttgtcctagctagcagagacttggggggaaataatgatgactgatttttacttatttatttattttttattcccacaggtttttgaggaacaggtgatgtttggttacatgaataagttctttagtggtgatttctgagattttggtgcatccatcacacgagcggtgtacactgtatctagtttgtaatttttttatccctcactcctttccctccctttctcccgagtccccaaagtccattgtatcattcttatgcctttacatacccatagcttagctcccacttatgagtgagaatatatgatgtatggtttttcattcccgagttacttcactttgaatagtggtctccaattccatccagaaccctcaaaaccatgcaaaaccgtggaaacaaaatagcctgctcctgaatgatcattaagtcaacaatgaaatcaagagagaaatttaaaaattctttgagctgaatgataatagcgatacaacttaccaaaacctctgggatacagcaaaagcagtgtcaagaggaaagttcatagcattaaatacctacatcaaaaagtctgaaagagcacaaataggcaatctaaggtcacacctcagagaactagggaaacaagaacaaatcaaacccaaacccagcagaaggaaagaaataacgaagatcagagcagaactaaatgaaattgaaacaaacaacaacaataaaaaagataaatgaaacaaaaggctgtttttttgaaaagataaataaaatggatataacactagtgagattaaccaggaagagagaggatccaaataagctcaattagaaacgaaacaggagctattataatcaataccacagaaatacaaaagatattggaagctactatgaacatctttacacacataaactagaaaacttaaaggagatggataaattcctggaaatatacaaccctcctaggttaagccagaaagaattagaaactctaaacagaccaatagcaagcagcgagattgaaatgataataaaaaaaattgccaacaaaaaaagtccaggaccacacagattcacagctaaattgtatcagacattcaaagaaaaattgataccaatcctactgaaactattccacaagacagagaaagagggaatcctccctaaatcattttatgaagccagtatcaccctaataccaaaaccaggaaaggacataacaaaaaagaaaactacagcccaatatccctgataaatatagatgcaaaaatccttaacaaaatactagctaagtgaatccaacagcatatcagaaagataatcaactatgatcaggtgggtttcataccagggatgcagggatggtttaacattcacaagtcaataaatgtgatacaccacatgaatagaattaaaaacaaaaatcacatgagcatctcaatagatgcagaaaaagcatttgacaaaacctagcatccaattatgacaatttttaaatatggggaatggtcttcatggaaaagtagatgttaatggcacctgtattagggttctctagagggacagaactaataggatagatgtatatataaaggggagtttattaagaagtattgactcacacgatcacaaggttgggttccgcaataggccgtctgcaagctgaagagcaaggaagccagtccaagtcccaaaacctcaaaagcagggaagccaaaagtgcagccttcagtctgtggttgaaggtataagagtcccaaagctgaagaacttcacgtcagaaattcgagggcaggaagcatccagcatgggagaaagatgtaggccagaagactaaaccagtctagtctttccatgttcttctgcctgcttttattctggccatgctggcagctgattagatggtgcccacccagattgagggcgggtctgcctttcccagctcactgactcaaatgttaatctcctttggcaacatcctcacagatacacccaggagcaatactttgcatccttcaatccaatcaagttgacattacatattaatcatcacagcaaccaaaagattatctcatttaatccttacaatagctctgtgtagtgggtatatattttccttttgctgaagaggaagtaggcttagaggggttgagtaatttgcccagaatacctaggtagtagaagatagtagagccattatattctgtctgcattcaagagtgtgctgctttatttgttcctgaattgcacacaagctaaagaatacaactggatgttcagtctactcctattttgataacttggctaactttactgcagagtctgcagaggtgaccaattttactctgggagataccagggaatccgccatgtaattcctcaggctgagtgttttggaaacacaaagctgtcactgctattaagtgatgttttttcctgagagtctactatgctcccagtaccagcctccgcaggccctctgtctaccccttttctgtcctgatgtgttctagcaggcactgagaaagtcattgtagaagttaccatgactttccaaatgcttccagaagcagaacacaatttcacaggagggccaataagtatgaatgccaccttgatagaaagtgaagttttgcgtcctgttgaacactcagtaaatgcttcctgaatagatgcaggattggcaaaacatagctccccagctttcataattcagactcagaggcccttcgtgctcctgttattcttgttacttcatgtcaggtacctaaaagggttgtttttcagttttcgtcattgatttaaagcagaggttagtaaactttttctgtaaaggccaggtagttagtattttagcctttgtgagtatttggtctcacaaaagcagccatagatgatatgtaaatgaatgtgcatggctgtgttctgataaaactttatttaaaaatgaggggtcatctgggctgtggtttttcaacccctgatttaaaacaaaaacaaaatgtgctatgcctgttagatgctactacatttgattctgtgttttccatatttttctaaaatgtactgaacaggaaatgaacaaactgatgacacaatgatctaatttaatcattgagataagagtggcgccaactcttattgagtatttgttatgtgtcaggcacttggctaagcactttacatgttttctatgatttataaagcaaatattgttattatcttcattttttgctgagggaaggaataaagtcacagccagcttacagaggctgccggaggtcacacatcaccagtacactgaaacacgtggtctgattacaggatccatgatctcctgtacagatcatagtgatattgacctgagaggaaagagcctaggacttacaatcagaaatctgggttcacatttcaactccgttccatgccaaattacattaaaactgggcctcagctttcccacctgtgaaagaggaataatactaggacttgccctcccaaccttagagattgctgtgaggataaaagcctatatgaatgtgctttataaactataaacaccatacaaatgtttgttataagtctgccatttgaatacatcttagtctttttttcctatgtgaaataaaacattttaagacaagcaatgaaattcttgaaactataacaggtttttaagggtgttgatccccaaagccgtcttcactattttgctccctctctgactcgctctgtctctgcctagcagcgctagtcttttctacgtgtttgatctgttgttcctgtgtttaggcccatccctactacacagcggaagtcagctattttttctctttcctttgctctgctgagcaagattaaactcttttcacctggacttttcctagattactcaggctgggtggaaatggggtagctgtgaggctgggatgttactgtacaattcaaatttatgatctgaacttaactagatcttgctgaagattgacctggctagcacagttttgaggcacctatctttcagtcccttctgtcctcttggcctggccactggccacatgttagtagcttacttctaaggatggaatgccatgcatctcctacaaggttgtctctatgcttcacacaaagtaaaagaatggaggcaactttgaatgctgctcattttcactcaggcaatccctttacaatattgtgcttagtaaactccccccactctttttttcccttagcttgttttttttttctaataaaagtctatatcaatttgatgtattagttagggttctctggagaaacagaaccagtaggatcaattgattggtcaatcaatcaatcaagacaaaaagagattcatctggaaggagttgattcatgccattgcggtcattggctagtctgaaatctgtaaggcaggctggctgactggaagctcaggcgggatttctctgctgcagtctcaaggcagaattccgtcctcttggggaaacctcagtctttgctcttaaagctttcaattgattggatgaggcctacacacattatggagaataatctgttttacttaaagtctactgattgtaaacattaattatatttaaaaagtactttcacagcaacatttagactagtgtttgaccaacaactgggcaccacggtcaagccaagttggcatatagaattagccagcaaacttggtattcacaatctgtcattatagtcttatctataaacctaaggtttagagaaacgctggtcattctgaacaattccctgtgaatgcagagatcaaggagcctccccttaactgggtaggcagtgtgaaatacctgcagtgtacttgaccttactgttcacccactggcagctgttcctacagcttggcttcagatatataatattacattggctaacttcaaagagcattgttttccaaggatagagatggtgatggtgtatattacttttaccagccccagacctgtaagaggttctcatctcttttgtttaagattttgttgtttttttttaatgctcaataaaagaagctttattctttcattaaaaaacaaatctcagaagaacagggaagaagagggtagcctatgaaagtgtgattgttatttgataccatcgtgacttagcttgttttcacctaagactctgagattctattctgtttatgtgagatttgggctgagttcaactactatccatattaactgaatcataaaacaattaatccatcatctggttacattttggtggggagggagcatttaacacaacactaagccacatatttcactattttttttttttgcagcaaattgacttaactgcttgctttcacaccatgcctataaaacctttttggttttagaggttctatgtgtctggaaagtacagtgaagtatctcatcagaatagtattaatatttcttatgacatttcatatgtcctgatatgggttaatggagaaatatcataagagtagtaattctcttgctgttattatttgtcctatttagacaaacagaacatagaattaataagaattcaaaaactttaatcactgatagagattaaatgatgtttatattagtcatcatcacctaatatcttaaatatttaaccttttatgcagtgtttgcctctctacttgggtatgcccttaacagtaaaaagtgttgataatgctctcccttttggcactcacagaattgctatacatatatatgtataaaatatatgtaaatataaaaatacatagttaaaaaaataaatctaccactaaatatagtaagggagttttaaactgaggtttttgaagtctttaagaatttatttagagacttcttttgttggaagtatggtggctagatgccatgaaaaacccactgaaaacaagtgtaagtgctaggtaatatgttgaaacatatcttttgaaatgtattactgagctggcaagaaagtatgccattgtagagagtgaaaataagtgaaggcagaatcctgggaggtaagccagcctgaagatattgatgacactggatggccttaagtttccattttgactggcatgtaatccagccaaagattcccacagaaatccgaggttccaaatggtaaatccgtggtgacattggggtgaccgagaaatgaactctgtgcagaaaggaatggtaacaacacttgtctcgtacaactttggctctgggtaggggaaaggaaaacagcttcctagagaaatgttaaccacaagctagccctcatgagagatttcagctaggatggatgctatctgtgtagtgcaaaaaaaaaaaaaaaaaatccatagccagattttgtgctttaatgtggacctaggtcaatagtgactgcaaagccagaagcagtggctcacccctgtaatcccagcactttgggaggccgaaggaggtggatcgcttgaggtcaggagttcgagaccagcctggccaacatggtgaaaccctatatctactaaaaatacaaaaatgagcctagagtggtggtgggtgcctgtattcccagctacttgggaggctgaggcacaagaattgcttgaacccaggaggcggaggttgcagtgagccaaaatcgcaccactgcattctagcctgggcaacagagtgagacaccatctcaaaaataataataataaaaaaaagtgactgcaggggactgggaagaggaaacacaaatctttactggggaatggaatttcaagtgtatgcaccaacccttagaaatcacaaaacatctgacccttctgaaaataaccaccatgagtgagacagcaggaaaaaaaaaaagaaaaaaaaaaaaaaaacaaggaaagagagggacaatagaatcagactcatacctacaaaacttaaaaattaaataaaatgaatcagactcagaggcttcagagtttgatttaaatacattatacaaaagttctgtgtgaaatatgtttaagatgtagaagggtgcttgaaatgcacaaagtcaacagctgaaaaattgaccaagcagatatgaaaataaaatccaatagagggcatctggaaataaaaaagtataataattatagtgaaaaaagttattagatgggttaattagtagaatggatatagcagaagaaagatttagtcaactgaaaaatatatccaaagaataggtccagaattaagcttagggagataaagagatggtcaatacgaacattaggagacatggagaacagtgtacgaaggtgtaataaattctaactggagttaaagaggagatagtaaagaggaagaaaaaacacaaaactcaaaaaatgtagtggctgagaatcttccagaagtattgaaagacaccaatccacagattcagaaacctacaatttgcaagaaaaagtaaaaagaatttcacaccaagatccatcttcatggactggcagagcataagagatgaagagcttatcttgaaaatgcagccagagagaaaaggtctatcgcagttaaaggaagaggcaagcagatgactgagttctcaatgccaactgaaaatgagaagccagtggcacaccttcaatatgttgggagaatataattttcaacttaaaatagtgtacattgtaaaattacatttcaaaaaaagagggtagtataatgacattatcaaataaaaaccatcccttataacaaatatcactaaagaaactgttggaggatgtagtttaggtttctagaaaggatgtctgatatgcaagaaagaatggtaagtcaaatattgagaaatatgtgaggaaatagaaacaagaataactaatgaatcaatgatactgtctaatttgaaggttaaatgattaggtagaactaaaatatgaaacaataatagtatgtaagtcgggaggaggaggatgaagcttgaagtgctctatgcatcttgcatctctggtgtctttcttgtgtccaaactttttcttctttcaaggacaccagttagactagattagggtccacctaatgacctcattttaacttatttgcctctttaaaggttctatctccaaatacggtcccattttgaggcactaggggttagggtttcaacgtataaattttggggggacacattccagccgatagcaattataaatacaacttttatagtaaaagcccatcttctagaacaggtagagaacaaggttacttattttttttaagaacaaaattggtttaaattatcctaaaatgattttaggagaaaatggacattaaatatacaacatttcctcctttattattttattgatgacttgatatgttttttaaaactcagtaaaataaatgattagtctcataatcataagagagttatgcccttattttaatgccataaaactgtgacttctgaagaaatacaatcatataaaatcatattttaatttacttttgagaatgtacagtaactcaggaaggcagagtgtggaacctgctttaatgaatagataagaatgactagcaattaaaaattaattatctataattcttctgaagttcttgaaaataatctcttctaacctgggtaaatattcctccttttcagaaatgtttgcaatgttgcttttttttaaattaatctctttttcttagataatggaacataaatcttaggcacatttgctttgtaaataccaaattgcacacagattaaaatttaatgagcttttactgctgtaatctcaacaagcagagtctttgctgttggtttttcaataagaaatactttattttgttatacagtggtcattaagaaccttaaagataatcaggacagattttccaaattgcataatgctattgcctagctatttgcatgtattttttttaaatgacaagacatttcgttaaatatttacttgcctgacgttgaaagatttagacaaacaatgtacttctagttgtcactttttcaaaaagattcttagggaaaagttagccgttttgttggttggtaagtgatgggttttcttggaacgtgttgcttgctaattttaccagagaagaaaataaattcaaatggtaagctacattccaatttgtattcttcttctaaagtcctccctgtttgcattctcggattttgacactcctacacaccagttaaagcacttgttagagtgtccaaaaaattgttgcaattaatttcccagtctcttctctctttgatgtgtcactataatgctttgagtaattttcagtgtctggcatctgttcaaggacaatttctggattttaggagggggagaagcaataaaggaaacaacatatgttttttcctaaataggaggcattttttgtttgtttgtttgaacaaaaatcaaaaactttcttttctatataggtgacaaaaagatacacgactcattggttgttaactaccattgcattcttttctctttggagtagcccttaaggaccagattagaccagccatctgcatcatgtagcatgtctgggttacctttcccaaaagaagttcagatagatgaactttgcaaaccagagccatctgaagtttgttttttctttttgagacagagtctcattctgttgcccaggctggagtgctgtggtgcaatctcagctcaatgcaacctccgcctcccgggttcaagcgattctcctgcctcaacctcccaagcagctgggactacaggcacgtgccaccacgtccagctaatttttgtatttttagtagagacagggtttcagcatattggccaggctggtctcaaactcctgaccttgtggtccacccgttttggcctctcaaagtgctgggattataggcataagccaccacgcccagtccatctgaagttttaaaatggctgcaggtatcttagtaggagactaattttattttccaatgattagaaaaaaatgaccagaccaagaactctagggttatgtttcatctcatatcctgtgcaggatgttctgagaagtttctatttgtatctgtggagtggttctagtcttgttcatcttgcattttaaggtttggaggtattttatcttgccttgcttctttaccaccttgctttaatttccccctatattgccatttctaaagtaatgactcattttcaagggtgggtctgaaaggaaagaaataataaaaccagagatctggagaagtttctcgttcatggtcttattcactttttaataagagcatctagaacagtgagtggtgccccagcagatatctggaaatttttgtggaattgaattgaatttgttcttagagtaaatgacaataaagaaaatagtattatggaaactttcgacccaagggaaatatcaaggctaaagttgctatattatttttcttctgatggatgctgagtttttctccttaaaaaacaaatccacatttaaacataaggcattgtttgatggcctatcacattcagtagaatggatttgagaaatacgtgtaggatgcctattaaaaactctgttttgaaattaaacctaagactataagattgtctgtttaaaaaaattattgctgctgtaatttgagcaaatctgaactatattgaactttagaaattcaaatgtatgcaatcttgtaatataacttactccatcggtagacatagttctttgtcccacctggcttccagcagtttgtctgtctgtcattaggctaaactcttcatgttcctaaacatgttttcctcaaaaggggacatatttcttgggtcagatgtaaacatcaagctaaggagttctgctgtgcgtctagacaaataaggttcattttcatcctctacatagtgttaaacttgaatttaagatcacacagattcctttacacgttaccaatgtaatgatatagacaatctcactttattcattcactctgtttaattcattcaataaaaacgtatacattggctgcctactgtgtgccagttggtgaagatataaagatgattaaggcaagggtctgtgctgacatgcctaatgggcaggctgacacacctaaacgccagggaaaaagagggatgagacctgggcctctgaagccctggccacctggctcgaagctcactttaatgtgcttctgggtgtattccatgactttttaaaggcgcttatgtttcctttctggtaaagcatgtttaacatgcaaaatgcttatttcattgagtagcttttaaaaagtgttcatagaatgtctagaacagtgcttgtctaatagaagtataattcaggtcacgtaggtaatattaaattttctagtagccacattaaaaagtaaaaagcaacaggcaaagttaatatttttttttttcctgagatggagtcttgctttgtcacccaggctggaatgcagtggtgtgatctcggctcactgcaagctccgcctcccgggttcaagccagtctcctgcctcagcctcctgagtagctgggactataggcgcccgccaccacacctggctaattttttgtatttttagtagagacggggtttcaccgtgttatccaggatggtcgttaattttaataatatattcattaattttaataatatattcatttagtcctatataaaaaaattagcatttcaacatgtaatcaatagaatatattattagtcaactattttgcattctttgttttgtaccatctttgaatttcaatttgtattttatacttacagtgcatctcaattttaatgctaaatgtcatcggagatattcgatctctgtttagctttaatatatttttgggttgaaaaagtaaattcacataaccaagttcttccaaatatacttgaaagtgtttctgataactgagttatcaacttaaaaatgtaagttaatgacaataaatgaaagaaaaattctgttccttagctgcactgaccacattttagtgttcaatagtcgcaggtggccagtggctatcatattggatagtacagctttagaatgacagttcagtgcaacaagtgctataatagactcatgaactggaagctccgggaagttaagaatgggatcaatgaagtgggtcttgaaaaaccaataaaaattcaccacgtagagaggaggagggcgactactccaattcaatcttttgaaagcatgtgaaggagcaacagtagacttctttaattatttaatagtaatttattgaacatgaattatgggaggtgcatggtgtgggtgctggtgagacatagttcctgagctcaagtagcttggtgtctaaatattcatgggcccatttttcagaaaggatggatatatgtgtgatcctgggtgtgccaaatgctgtggcttcctgaagcttagatttccagcttgtcaccttcaaggttaccttgtgaataggacttttttgagctgtaagtaaatttactttgcctatttatttccaatggaaaaaaagcttttttaaaaaataaatctcatcttattgcctatgattggccaagacaacatggcccatacagaaggtttttgatggcttctgaggtctgttatcatttgcttattggcatttcagctgtcaaccagggttctgtcaaattccattcctgcctttagctcttttacttgaatacctggggcaatggcagaagtggttgctatttgtcacctttccaggatgttagtcgtgtccttgagacaaatagaaaatttaaagtcagatgacttgattcctctgccagttaagacccttagagagtcctcagaatgttgcttatttttaaatttcaagtccctggtaaggatcaagtaaactccccaatttgcagatttctatccagttgactatggattttgcctgttgctttgtttccaccaactctccctgaagatgaggcgcacagacagacaactcacaggcaagaacagcctggtccatcttgaaagattctcaagactattctccacaagataattgtctacttttaaaaatattcagtaaagggaatttttgctgttatccttggttgtgtttttagtatctcatcatccttctagttgtaggaggcttttcctaacatctaacccatatgtctgttgtctcatcaggtgtttctattaaggctacttccccatcaatcttaattttttttttaatcttctgagatgtataggttaagttgaaatcagagactttcataaaatggtaagatggccatttaaacgcaactatgaggaaataatgtaagcaggattccattggagaaccaaacactagcaacaactaacttggtaatcaatgttgggacttgaagttaggctaaaatcaatagtaatggcactcgtatgtacaaatgcagaactttttacacacaatgatttttccctctgttattatacactagctgtgtctgagtagacagtccagctccactacctgcagtccaccctgggctgtgtaatctgagcactgatgggctgttatttgtacgtattacttctatgacactgttttttcatctgtgttagaaatgtctttctttcttgaataagctgcttcaatttcttatagacagattctgcttttatgacccttgtttctacaaagtaatctctactcatgctgaaatctcagacaattttaacaaatatttagagtacttaatttttctttgaattctaaatattatccttctttagttcaccatagttggatattttgagataactgtggaggaaacagcactgatcctggggccatgaaacctgatttcaagatctagtcccttctttaattttgcacaactaatttaatcacattcatccttaatttcatcatcattaaaatagcagagaataattcccgtttcatggagttgatatgcaatgaaatagcatatcaatgtatgtatgaatgtcccccaacatagagtactacacaaatgaaacgtgtcactcagcataacgttatgtgctccttcctgcaactggattgcactccagtgggatttcatgctggtgagatggctgtgctgctggacttcatgggacaccaatctttgaaaataagcctgatctggctgggcgtggtggcttatgcctgtaatcccagcactgtgggaggctgagacgggcggatcacctgaagtcaggagtttgagaccagcctggccaacatggtgaaatcctatctctactaaaaatacaaaaaaattagctgggcatggtggcatgtgcctgtaatcccagctacttgggaggctgaggcaggagaatcacttgaacccaggagatgaagactgtagtgagccgagattgcgccactgcactctagctggggcaacagagtgagactctgtctcaaaaaaaaaaaaaaaaaaaaaaaaaacacaaacaaaaaaaaaaaagaaaaagaaaataaacctgatctatagatgaggccagtggatcttgtgaagagttgaaaggtcaggtatcagtcttataccatgtcggatggggcaatcgtcataactttttaaaaaattatttatttattttgagacagtgtctcacgctgtcccccaggctggagtgcagtggcatgttttcggctcactgcaacctccgcctcctgcgttcaagcgattctcatgcctcggcctccctagtaactggattacaggtgtgtgccaccatccctggctaattttttgtatttttagtatagacagggtttcaccacgttggcccaggctggtctcgaactcctgacctcaggtgatccacctgcctcagcctcccaaagtgctgggattacaggtgtgagccaccgtgcctgccccaattgttacagctttttaagtggattatatgcctgcttcaggcattagacataataagttaatctgttgataagtttcttcatttcttaattttcagttgtgttttgatgtgtgtggtctgggtgagcggctcagtgctgctgctgtggagaaggcgtgatatggaagggatgtgactgtccttcttcatcttcataacggggccaggactggggtgaggtgtgtgagatgaatgaagcactggttttgatacaaaatttaagaaaaatcaaattcaagaggtaatattttaatacgatatttgtaaaaaatcaaaattagtgcaaaaatttgtgatgagcaaaatgttagataaaggcattgttgcttttctttttctgtgtattgtaacacaccatcacttagtggagaaacagctctcactttcctcctccccagatacaaccatttatgttgaattaaacttctagttctcctatacctgtgagcatcccccaggccccttggtatggagaaagcagtttatttgtcttagtaagattataaaagtggcaataaaatgtgaatgtaatgaacaaaatgcacattttgtggaccaacttgttgttttagatctatttttgaaaactcattaggtatgtgcatgaggcaaaataattcaagtgcagttggatattaaatgaaaaagtgtcaggtccccttttctgccatattctcttctgtgtcttcattagtggaaaccattttgaccagttcttataattctaatgatttgctgatggctctaattcttggtttatcaacttcaagcagaatgtcttgacatcttggtatgaaagttaaagaatatgaatcatttgttctctcccttctcctttcctctttctctgcctctcagtttttgttgtatgctcacggagtatgtgtgtgagcatgtgtgtgtgtgtgtgtgcacgcgagcacgtgtgtgtgtgtgcgcgcccatgggtccatttttgcatggcaggctttgttttagaaagattggttacaacagctgccccaccaatctcctctacagggaaggattcctactctgagaccttggtcttttccaggcagatcacttacatttcctcacagattatttctcatcctgcagcctgggtccaaatgggctttgctgtgaacagtgactctcaggcttctggtctctgctgtgcttgagtgtcgttgagatgctccatctcctcctactgcacccacccagcaatcatctctctttcaggaattcaccaaagtcttttttaaaattattcttttgttttgagacagagtcttgctctgttgcccaggctggagtacagtggcgcaatctccgctcgctgcaacctctgcctcctgggttcaagtgattctcctgcctcagcctcctgactggcagggactacaggcatgtgtcaccacacccagctaatttttgtatttttagtagagatggtgtttcaccatattggccaggctggtctcaaactcctgacctcaggtgatctgccggggtccattttacgtggcagactttattttagaaagataggttacgacagttgctccacccatcccccctgcagggaaggagtcctactctgagaccttggtcttttccaggcagatcacttacctttcctcacagattatttctcatcctgcagcctgggtccaaagtgctgggattacaagcgtaagccaccacatccggctcaccaaagtctttgggtggttgatgtcatatgcctccagttgatagcacttttaagaatttttcctttttgtatgctgttattatttttagaaggcttttggattattattgttaaagagtatgccatgtctatcttttaacttttaagcatctattgctttgttacttgtactttatatatatgtatatccttcccccaataagacaaagagtgcaaataatcacctcccttgcctgttgtttgggtttaattcaggagtcagtggaattaaaagcctaaactcagtatagttttaaagcagcagtccccaacccttttggcaccagggactggctttgtggaagacagtttttccatggaccagtgtgggggctggaaggtgattccaggatgattcaggtacattacattaattgtgcactttatttctattattattacattgcaatacataaggaagtaattatacaacttaccataacatagaatcaatgggagccttgagcttcttttcctgcaactagacggtcccatctgggggtgatgggagacagtgacagattatcaggcattagattatcataaggagtgcacaacctagatcccttgtgtgcacagttcacagtaggattcgtgctcctatgagaatctaatgctgccactgatctgacaggaggtggagctcaggcagtaatgcgagcaatgggagtggctgtaaatacagatgaagcttcacttgcacgttcactgctcacctcctgttgggcggcccagttcctaaccagggttggggacccctgctttaaagaatatgtttgtggattcatagagggaaacaacacacactggggcctttcggagggtggagggtgggaggaggcagatgatcagaaaaaatattaataactaatgtgtactaggcttaatatctgggtgttgaaataatctatacaacaaacccccatgacacaagtttacctatgtgagaaacctgcacgtgtactccagagcttaaaataaatgttaaaaaattccctccaaaaaggatatatttgcatcggagttatatttgtatatgagtatatatttgtatatataaatatacttgtatatgaaaaaaatatcttttttctttcattttattttccaaacattaaagtcgggcacattggttaggaatttcaccaatactttttacaaaactgaggacttggatgataaaggcactttttaaaagattacacactggcatggggaataatacctttataaagatgatctatgtgttcctgaatatcccgatgcatctcctagctggatcttccgctccacaaaaattcataagatgagattcttgaattagaatgcatgccttaatgtattaagtctatgtagagagagttatttagtccatgtaaattaagtgggaatatttttatttgattactgttttatctggatcttgcccacttaaggccttcaaaaatgaaatttaaggcctgttaagcagacccaacatcaacagcatattctctctctcttgtaagtattgtctagttgataaaaaatttcaaaaacatgtcttaatcaaaaacaagatgatccagcacaggtttaataaatgttttgtgaatatggcacattcgtgtctcattactacagttttcctatgctgtctttctcaataattccccccaaaattgtagtgtttacattatggcatttatagttacctctgaacctaaaaaattaacttcaaaagtatttaaaaaaatcattatatttaaaaccatttcatgtttaaatggtttgtacagggcaatgaaaggaaatgtagtaataaacacagaatcagatttggtcactaatatttttctgcagttgaaatatatgtagactggcttagggtctaaatagcattgaatcctgttaccttccatctataatcaattaatgtattatgacattgttgtcctcagatcactgggatctcatggtaagtaagtaaagggattattctgtgcattttcccaatatctatattagttttaatatacctttatgttaatgtatgacactgacacttagtaattggattaacttcctatcagaatttgtttttcactcatactttgtatacatgtcttaagggtagggtagatgtacatttttttctgtgttagcctatctgtttctgtgacactacatgctttctgtcctccaatttgtgtttctttccgtgtacaaatatgcatcatctaccatctacatctacaaaacatgtaggcttccaatgttttcatgtaaatacatttcatgagtcctcagtagagtgttagatgagtggttaattagtaatgttaataaatgtaaattacaataaaaacatttataatgttaataaatataagtttattgaacttaaataatttaaacatcttctgaaatgtagtagaaattatgattagccataactagtacagtattttttgcttgtttaatttttttggtgatattccatttgtggaatgagtgtgtgtgtgtgtgtgcagtacagacagaaaggagagaaacatatctgcatgttatgttagaaagagtagtgttagctaccctaccaaatttacatactggctgaacacagtatgtaaaaaattatttttttagtccattgctggtgttccttgttgttgggtgactctattccacatggtgatgcagggaaccaatctccttccttctgtggctgtgtaatcccttgcaaccttgaagtcctctgcatctaactttaggatgaggaaagtgaaggtggaggatatagccctcttgactgccttgacctggacctggaacatctcttttgctcccattccatggggaagaactagtgacatggtggcccatagctgcagaggggaggctgagaaatgcagcctctggataagaagcctactcccagtggttactgtacattgtgggagggaagcttgaattctgatggacagtgagaaccattctccacacaataacgaaatgacgtcttctcaaccttggcaatgtagcatcctgtgacttaagtatgtaaataattatcagtacaggtcagtgaaaaattaggtcacctttcccttccacttttaattctatagtttaatttgcctatctgctacatattatatatatgggaatagataagattatctataaacatgtataaatttgtttcctacactaaaaagaaaaatgacaaagaagaattaagttagttgcccaaatccacacaataccaccaggagaaagtctaggaaccataccttctaaatccaggtctacacttctttagtgcactaaattttttcctaatatagctctgaggagactggtgtttaagaggagaatgttaagccaaaagcccatttcacttggctctgtacagacagtaagttaatttccaggatgtataactcctgattttctgtgatgacagagaaaatactgacctgatttgggtaactctgaggtttggagatcttgaatagcctcatgttcctgaacttctttaccatacatgaattacttcttaggaagaaacatttattctgtagaatttggtttcgcattttatttttattttcttagacactggtagttggaaattcaggaagaatttgactacaaaaaacatttattaaaaagagtttctaatctcacctgctaagtgctacaaggaaaaaaaaaaatacattttgagccctcaaggggctccaaatacggttgaaggaaaattagacccagaatagtatatgattaggaacaaaacgatggcagagaaatgagagtttagagaaaggagagataatcctgagttaccttaggaagagaaaatttcacagagaaaacggcccccacactgatttggggaagatgattcagacttgtctcaatggcatgaggagcaggggccagatgggaaaggacatcgtggtggaaatgacacgatgagcagaagcttagaagtacttctgcttcacgtctgtgattctgcctctccccttgtttctgcagtgctaagttgagtgtagttccccacacaaaccctgagctttcttcccctccaggctgctccatcagtcagacaggagtgccttctcaggggatcctcttcctcatcttatcgggccactcatctcgtcgcagacattcccatactcctggttgacttgctcttccctctttttaactgacatgagcaggcatcacctcttccaggaaacttccctgacaccaggctgagtctctctggtgtcggggaaggcttctgtattactgcatctgccattttgatttaaggttttctgctcattccaactcaacagtgagctctttgagggcagaaattgtgtcttattcatttttcttgttatgccctaaaaatgtattgtgataatatataagtaacgtacaatttaccattttcacctcttgaagtgtatagctcagtggcgttaagtgcattcacactgttgtgcaaccattatcaccattcatctccagaactttctcatcatcccaggcaaactctgtatccattacacaatagctctccatttcctcctgccctcagcctcaggaaacctcccatctactttctctttctacgcgtttaactactcatatagatggaatcatccaacatttttccttttgtgcctggcttatttcacttgacataatgttttcaaggttcttttatgttttcttatgcgtttttatatctctctatctttgatagcacccaatacatagaagacaatgaatgtttttgtgagtgaaaacataagaccagaaagaaataggatgtcatattctagggacactcaagacactttcttgaggacagaggcactgtagcttggaatttggaagatgaggttggcaaggtgggtggggaaaggatggaaaagtgatacgtttcttgaagcatgtggatttgcttccataagcagtggtggaccagtgggcacccttatctattaaaagaatgattttttttgtgactcgtgtagagcactgtcttagttacctaccccagtggtagataagagaagcggattaaaaagagatctgaacctgaggaaatggagactaccaagttttttgtaaatatgtctgttataacatatattatctagtacttgcgatgcctgtgccaaagcatgctttttggtttagttaagcctacttagctcgctaatttcagtaattttggcttgaattgcaaaaagttgatgggggagatgggggagtctctgacatccttcccccactcacaggtttgaaaaataaaattatgaagagcaaaaggatctttttctgtggtaaattgtacttcatgacaataaacgagttgtggttttagtggttaatttataaattaggccatctggttcttctgtaatctaaagatttttatatatatgtaaaatacaaagttgtcctgggcaactgccaatctataaaggagaaaacatcttgaactctgtggagataataaaaccatattcagctgccaaagtgctgctgacatactgtccaatgagacacccaacgcctttgcattacagccagcaaggtgtggagctagatgtattgatctatttaataatattagcttctcttctctgggtcggacttggcccagagcaagtgaacaggacctatctatctccttctcaaaagtcacagctttcttaccaaattgtacaactcaagccacaaagaaaacaagtcaaggaaaggaccagaggagcacgagggcacatgccttgttcccagaccctgggaccagctccagctctggctccttgcagatcccgctcttctcaagttctctggctttgatcctagttttctgccctactattcctgacatgtacagcacttagcaattcataacttgctttattaaccaatatctcaacagaacttttaaacaacctgggaggaagcagagtgggtgttactgtcctcattgcacagataatgaaactgaggttcagaaaggttgagtgtcttgcccaaggccacacggcttcttagtggagaagccaggatctgcaccaatgtcttccattggacacactgccacttaatatggtacttagtttttctttctagatgaagcagtatgaggaattctaccatggatatctctctctatttttttaaactgcaaaataatgataatgataataatgaatacttctagaatacagtctctatgccaggcactatatgctttatatgtactaacttgcttaattctcctaacaaccctagaaggtagttactaatattatcactatttttaaatggggaaactgagttacagagatggtaaataagttgcccaaggtcacagaggcagccagattagtgacaaaagtttgagagtactcagtttgaattttacatgttccgtggatatggtttatgccaaataccttctcctttctagacctcagtttcctcatgtatcaaacaagtggactgcactatacaactctgaggtcccttctagcctgaagattagagtcttttatgcccacatgatatggaaaacattaatgctggctctttaagactggaaccttgtcatttaaaaaaataagctctactaaatttgcagtaaactgtccaaatacgatctctggtctctgatttgtatctctcacagagcatgatacaatgctagacacatatatactcattaaaaacttgctgaattaaattgtaaaacattcctccagatagaccgtaagggtgagctgatgccctaatatgctcctcagctgctgacttaggacccgtgggtgacaaaccctgtccttgttgttccatctgtgacagtgggcagtgtccaaaatgagtctcttcatcaaaagtgagtccaggaaactggatcagagtaagtaaggagtcttccttgcttctttttctctaaaatacaatacagtgcattctagcaaactaccagcatgcctataaatctcattttaaaaatatcaggaaatagatgctcattgataaagagggtaagaatgagcaagggagagagtcaagcctgtacatttgtgcttagggtattttcatttgagaaattatcattggaaagatcaatttccaaggcaggcgttttgtcttgacttaataaactaatctttatcaataataattaaataatgtcattttcccagatacaaaggggaaaccataatgcctttcatatgccttctcatatcttcagtgtttctcaaacccagctgtggggtctttttagggaagatacaaggagggtgagaccatgtggagcacacactcagcagccactgtgaagtcatgggtcccttgctacctttggaagctgacaatctgcatgaaaagcagcccctaggaacatgggtagtggcccgggatccaaaactcctgaatccataaaagggcttttgacttcttgttccaggacaagtgacatctgacatgcttgcctgcttgtttgcctttcttccttctcctatccgtctttccatccatctgtccatcagtctatctgtccatccagtcatccatccatccttccatccattcgtctattcatccatccgtccttccatccatccatccaagatttattgagcacttacatgacaggaagtatgagacacaaaagaaaattctacacaattctcctagggacatgaactaatggttagcaaaaatatatgggaagtcctgcttcaagtaaaattatgacttaagatatacatcagatatttgaaaaagatatttttaagttcaacattgaaattctaactacattgtgtccttaatttctattttctagttagacttttttgaagatacaaatcatttgaattatcattattattgttacttgattttatttattccacatgaatggtaagaattttaaaggaaggtgggtgccctaaaaatacatttatgccaactggattgaatcaccttgaatcacaatgagtacaacaactgctaatgagctaacacttaatgagtaatgaccaggcaccagacactgttctagcactttatacttactgatttctttactcttcatgataaccctatgaggaaagtgcttttttgttaagctccattttcagctgaagaagctgaggcctggagaagttacatagctttctcatggtgtctccactatgaagtagctgagctgagatctcacccaaggccctgctgggttcaggccacactcttaagtactcacagctgcatcacactgaatatcatctccctgcactgccatttcatttgagcagggctttgcctgtcaagaacattcatatcttttgataaacagtgcattttttccctgatagtctgtatgggacagcctccttgtttgcatctgaaggacagggacttcaggacctcctgctgtggtcaccaaggaatcacattcaaacttctcagcaaggtgttatggtccttctcagtttgcctacgatccattgaggcaaaggtttccttctctcaatacaccctctgctttagccagggggacctcccactgtcctctctatgtgttctatttgttcctgactgttagtacccgcttgtgtggtttccatgatccttcttctgcctggaatgaggctcctcttgagtcctgagagcttcatttctgtctgtcttttgggctgtgccaaagcccctctgccttcgtggactccccactgattcattaccaattttcctctcctctgggctcttcttagattgcaaatggtgcctctggattgggtaccaagacttgcagtgccttattttgataccactaatatgagaccatgttatatgcctcttgagatatcattccctttctagcaatagacagtgataagcatgcgtatagagggtaaacgtaggactttgaggttcatccatctcaatagacaaaagtaaaagtatgctaatttcaatccttcacacagtaaattgaatgtaataggtcttcagtaactatttgaggaatgaaattgttattgatatattgatttaactgagcaaatccataagtgccacgcttggagtaaagtacagggaatctcattttttgggtaatttcaaacaagtaggagaccatccactatctattaaggacaaaggagatttgagtgacaaacatgttccagaccatccaatggtgttattctactacttcatcccagctagtaaaatggggcaataagaaccaaaaagcaggtactgtccctatgtaagtagacttcctagtcctggccaaaacaaaaacaaaaaaaaaacaaagcaacacaaaacaaaaacaatgtgtgaagagcatcttaccgttcattgctttggatgatttgtgcaaatctagttaatgggggtggatctgatcagtctttgtaggaagtcagtattggcatatgtctggcttctgaattttctaaaaatataattatttatttttaaatccattcaatcaacactgaatttactaatcaactactaaataagtaaaagatcctatagtagatccttcaagaaatggaaattgagacattaggtcactataaaccccaacccttgtaatctttttgtggcaaccttaggaaacttggaatgctttttacactctgataaaggtttaattgtaatcatagccccagtgttgcaaaatgagtcagaagatacaaagtatctcataggataatattatagctgtaggtacttcaaatggacaagtataacacattatgactgctaatatggatgcattgggaggaaaataagccctaagaagcaatatgcagaaaagctatgattgctggagacagatagatccaagaacctaggtaatttttcagcaaactgtggttccactttcgcctctttcttgacattgactgtgtttttaacagggaaaaagttatctgaaatttttgatagagttcaaactttaaatcgtgttcactttgctaaaactccactggatggagtggcagaagagaaaaaacacagaaataaaagaaaagcagtaatggagaatggaaaatctttaaagatgctaccatcctgaaaagattcgaaagcaagcccaggaaagccacggggagggaaagagcgcttagaggtgtccccaaagctttcagaagtgatgagggaaaccccagctcttcttgttacttcttggcattttgttcctctatacgttagcttttggttaatctttcatgttacttattatctctgttttaaaatttcacattaactcattggtttcatatcccacttaacaaattagatattttccttgggcttattaagaaaattatttgctctcatatgttatggctttagattttctgtgtagctaggactgttcttaaatttttatctttacctttgttatttctctgaagcatccccattggggtggcagtggggggtattaaatggttatgtaaaatttacatgtaattgtgcaatttacacatagcctcaaatataatgaggcctagtctagctgcccataccaagaggatattatagttgccaataaaatcagtattatttcttttttttttctgttcttttttagcttcttgcaaacattcactcagaatcctttttgaatatcagttttgtgaaaagcaccgtgctgggttctttgggaaaagccaagatgagggcaaatgcatcctccttcctagtgagtctagcacacagatgactcaggaagtcatgcactggaggaggagtatcttctagaactggggaaaggttaaggaagggatcagaaacctttttcactcaaccaattacattttcctgaaagcatgttattaatcgtacatgatcttgcagaccccagatagagactatatcactatatcaattgttttcttgaacaactggagttaattctcatatgtttggttacccttcaagtatttatgtttaggatctgttttcttcctcttaacttacattccaaagtttaggtatccttcccctccatttgctgtccaaaacagcatcctttcatgtagctacatgccattggaatgatttggtttttgccatggattcctagtcctaaatttggacttttattggtatctaagatgtcatggacagaacccacagatgttgtacaaaaagggctgagtggacagtccaacagagttacatcatctgttccaaacacccttgtaatggttgtatcagcgtcaatgtctgagttgctgtcctggttctcctggccagtcctcagctggccatgcctgttcaggcaccagagaaagcttcatacctcaggcaaatctttacaagggatttgaaaggcaagaaacatgtattttggaggttttacctgtttatttcatgtatagcttcatattaacagattttgctatcacttaaaagtaaataaaatgattttgatttctcaaaatcatcttataatttattaatctattttaaggcttgcatttacatttaatcttcaaatcttgatgcattttcacagagtttctttagttagttaaggatattaatgacttcctttaatagttgatgaagtgagtcatcatcgacagtgagtcactaaggccaactcttgtacctgctcttaaatagcagttgttttactagatttgtactgaaacctttttaaaaatctgtttgtcttatatataacaagcatttccagtagttaataatactttcttagctcttcaatcattttatgagagcattacaagaaaagcaggagatggggaaagagatatcttgtttgccatgtaggatgcatgaaattcttacttagtctgttgtgttttggattcgagagaaaatatgtaatgaatcaaaatgtttcctacagtcctctgaaaagatgtaatgagacagtcttccagcagcctttgatcatctgggaagtcattgactttgatccttatcctatcaggggctcttaccctggggtccataaatacccaggcatttttaagaagtggatttcagtataacttgtttcattttgtgatttttaaaaatattttgttttatgcacttaaaaccttaatctgagaagtcatctgtagactataccagatttccaaatggaataaaaatatttaagaactctcttatgtgtgtgtttcaacctataaattttatatgtgtagctcatggttaggtggtaagtagagaatttgctatctgtgtaatatttggtactttttataatgaaaaaggaagtaatacaatgataggtaccatttatttgttgaccacccatattttccagggaatgtgatagatactttttatatattctttctagttttcaccataacatgctgcagggatagtgttaccattctcattttgcagatgaagaaattgaaacccagaacaattcgttcattcattcaaaaaatatccatagagcatacactaagagaaggcactctgctaggcaccagaaattgaataattgaccccaaatcacctaactcataagtggcaaagctggacctaacaaagcccattatcccttctatcacacattccatcctcataatatcatattctacatagaaaaacttaacagtcctgttgagacacttggaactctaagaaggtagtcaacagatacttttctctttatataaatatgatatctaattagcttttcctggaaaggagtgattctgcctttttttaattctagcattccctgagcaaattagagcccaggtaatgatttcctgagataagtcaattctcttctaggacaatctctagtcttgtcatcatgagatggaataacaacggtctatgtcatttcagtgacggcacctgcatgtccttgtatctaagaaaagacacctccttctctgccttgctaaatatttgtaaactttgctttaattggtatatgtgccactgttttgtatgtgggaggggtttatggttttgttttgttttttggtcttttttagtaaccccaatccaaactattctcatttgtaacctaaaatacttagaacaagaggctttgcaatcttgaagaccgaatacatttttactactaaatgtaaggcagatttgagccacccattttgtagtgcttgattatggcaacccgaggaaactaatacggttactctttatctttattaggaaatactgctgtagttcctgttgtaatccttagggagccaacattgttgatgagacctagtaccaagccagaggccatgttgaactagcaagatatgggatagtttttactttcaaagtaattagcatctagagtctagagagtttctcttacagggtggcctggtgtcttagtctattttctgttcctataatagaatacctgagactgggtaatgtacaaattataaagatttgtttgactcacaatcctagaggctgggaggttcaagatcagacagccacatctggccatcctttaatgagggcctcatgctgtgtcataacacagcagagaattggaaggagaaatgggcacatgcaaagagaaagaaaggggacgaaaggggctaactcactttgtaactatgagactaatccattccctggagaactaatttattctcatgagaaagacatgaatacatcttaacatcctaatcacttcttaaaggcctcaactctgtacactgctacattgtaacaggcaattaaatttcagcatgagttttggtggggacaaactacatcccaactgtagtacctagctacccactttatttttagagtggctatttaatgacctggcaagatctactgtgcttgtaaaagaatccaccatgggttaaagaaaaatagtttctggcttccagtctccttttggcctctctctagaatggcatatacaagttcagtggttactgacttcaaaggtggggtggaagacactgaaatgaatttttctcctttctttggttggttgctctctctctttgttgctgaaatttgtgtaggataatggaatgaatatgggagatagggaactatagaaagactggagggaagggagaagtcttttctgaattaaccccccatgtgcttgtgagacccttggaccccaaagggctcctgactggctgggcccactccttctgtatatggagccatagggcttttctctggcttcccagttgaagcattgtcatatgctttgatgctcagcatttctggcaattttaccttgtaaaactcccgtttcgacattctgaacttaagtagaaaatgggaatataagcctcttgttttttgctcttaatccattccagaactataagtccctgggttcttggcaacaacaggtgttcctctagattttaaatcaagtgtgtgtgtgtgtgtgtgtgtgtgtgtgtgtgtgtggaatatctcactaaaacgacagtgttgtcatcaattttggcttcatggagggtcttgagctgggtggagatgggaggaagctatccttgtccatgcggtttggagacttgctctaaaaaagagaccgtctacttccctcgtagtttttgttttgaagacatttgtagtgtttaccaggagcatacagttatctggaaaatgcagactgatgacaatagtatttgaaatgctcgtagatctgcttctaggttgatggaaagaatgtatgttccaaggtacaagtgcttgttgacttttcggatgcagccagtctgtgctctttgtcaggtaactcggaatcactccacagtagctgtccttcctgtccatttgacaagcacttaaaagggcagtcttaagtactttacttcatagtttattaattttttcccttctttagtttgcaatctactctcagaaactgaaaaataatttcttttacctttttcccctttctcatttaagctgaaattgatttctttctgagcgtgtaaggaaaaaaataaaaagaagctgtggttaatacaattgcctttgctgaacaaaaataaaagactagtttaccttcaagctgtgctgtatcagagtaaggatctgttctgtcactcccaggagattttgataagagagagtacaaaatttcataatatctacatagcataattgtagcaaatataagaagtattataattgtttatttggggatgagggtggggatgggtttttttgtgtgtgtttggaaaattgggaagctagaagatactcttaaatccatcagcttcttcagaactcttctcaaatgcttattgtcatgacaaccatctcttcataaaccaaggctctgagtgtaatacagatggggctggtaacaaggtaggattgccatctgctttgttttctctaagggacattatttttttgtgatccccaagtctcatcctcaaatctgaaagtcttgacttatttttctttctggagtcagatagagctgtgagattaattcttttctcctgacaaactacttcctcacctgtcatcaaacaacttacttgttaaatggagggaaaaaagggtaattatgtgtgtgtgtgtgtgtgtgtgtgtgtgtgtgaaaacaaatatacatattttaatgatttatttatctgtctactttgcaaagtctcctatgaggtacctagtaattcaataatacagtcaagtgtgagatccagaaacaagtaggagtgaggcaatcattttcccatgaaacaagtaaaattattactgcttttgaacattttaacacctgtgcttcctgatggtggggctgcatgaagtttgtaagtagtgtcatcattctcttattaggtaacaaataggagcataattatttaggagaggaaaaccttttcttgttaccaaatttggtgagaaatttgccaaagaaatgaatgcttacaggagggatacagcttaatatcttcatactcccctttgtcaaagatacaagtgacattttctcatatcaacttcctacaaaaagtgaggccatacatttttaaaaagaatatacccagtattttaaaagtttgtatatatcgtgatcagaattaagatatatccagcttttgaaaaaatatacatatttagccattaaaaggtatgtggtaaactaaactgatgaataaaggttatgggaaatatttcataaaatttatatttaaagtaaagaacaatttctctctttgtattatagttattttacataagctacaatctataattctaaaccttaatttcttgaagggctttataagcctcatttttctttctaaatagagaagttcatacactgcttttatgtcctatatgttgatgtgtaaaaataatcaaatactagtgggtgagtagaatgtaactacaatatggtacacacacagacacacaggatgactaaactgtgcacatgagctgatgtccagagcagggaaaagctgctaaagaatgtttgaagtagagtcagaatgcagttttgtggttaagaccaataatttttcaaaggagcattataaggagtgtggttacttgggttggagttgaaaaccaagcaacagttgggcagacttgaaaccagttttgtctttaggtttcttttcttaatgattggtctacaatgagttagccactcatcgtatttaaggtcttggtaaaggagagactttctttgccatgtagtttatacctcatgtatgcattacagtagagagctccaggaaatactgcaggccttctactggtttttatcctctatttagataaaaatgaggaagaagtagaattatcataaacaatcctgttggcttttagttgagatatactacagaaacatcacctttgaatctgtatatgtaaaaaaaaaaaatctcagagtaagatataagttctgttgcattgttctgaaggaatgggtaatgtcagaaatgtcttcattacattacataaagtaatacacagtgctgttatcagattgcatagtcaaagttggcaagtttgcatatttacatagatatcatgaccttcatcattcatacttctttcaagaaatggtcatcttaatatggggtatttatttgaggcatacaccatttattttaagaagcagtacctttgtttattgtaaaacttctggactaaattcttcaattttttctcaaatgaattcagttttttgttttttttcttaccactggtttttactgcatagcgtttgcctgaagaacaccactttgtttcccaaggcaagtagtcactacaaggcgagttttgttctgtctatcccaaggcaaatagacagcagcaaacatagtgtggagggctgctgggttcagtagaaaaccatcaactatttctaattgggggtgtatgaagacagctgcattctggacatgctaaacatcttgaaatgcttggagtgtaataaaaccccaaacgtgctttcttttctcatttctttgcacatgtattttaggcaaaatataatccacatgctgttgttccctctccttttaaatcatgaaaaatgttgtttttatagggctatttgaggtccaggatgcctttttatcctttttattaggttatttttatatataaatgaaaagaaaaacataaacagaaaatacaacatgacatcatgaatgagggcaagcacaaactgcccaatttaagtttgaagttataaacctaaaatattttaaaacaaaacatttctcttggtgttttgcaaaagtaatgctttcttctattgggcagaaattgcagcctgttgggatgaaggagagaatagaactaatatttattgagtagctaccatggctttctgggacatctgctaaccccttaatttttacagtaaccctaagtggtaggccagtccatctgcattttacagacaggaaatgctttcagagatattaattagatggctgtagaccacagaagaattgaaagtcaggtcttcttgacttttcagctcatgacttcattacttctgccctcctcattctgttgggagatgggtgggagtgtgccctccagataatcagaaagtcccatgttgggatgtgatttggaaatagctagtcctcaggcctgtggacgaaggctattgtagcctcaagaaagaaagagtcagcttgatattggcaaggtggttatttagtgtggcagctgcataagagcattggataggtggtatgatatgggatgggggtcagggtgagagctgctcacacctccttattatggcagggcaaaaccagaatagtcacagtgatggtgatgtagggtaggttcaagagaaagctcatgttcttctagcattgagactcacaatatttcaaaacaagtgattatttattccattactatttattttggtgatggatgttgcatttattttattttctaacagtagtacatatttggtaagagttgtttgtgacattctttatttaaatggattaaacccattttcttaatttttttaagtgtttgtcctgttatcgaagatatcttaaagtgttacagaatgggaatcatagctttaatgagtctgcatataagagagtccaaacattttttttttggagagaaggaaggtcatttcaactgtactataggaacgatagggcccatgatccatggtatggcaataagttactattttttggagaataaatcgcaaaatatgggacgtgaagactgcttggtatttacacaggagtctagttcttctgatactatatattctataagctttctcccagaaatccaaagttttatttagcttgtagccatcattgtgccacaatcttccttccatgatttatttttttcccatactgtactcttgcactgagtctttggcattgaaagggaaagagatgaattattcaactcttcttctattgagtgaaaagccaatacagaaaaaaaaatgcaacaggcaatttcatgactgacattttggagaacattggggtcatcatatgactgagaaaatgattatctcttttgaaggtcaggaaaccaatatttttttttccagtgaatctactgagggaaccaaccacctagctttttgtaaatagcactcctcagggaaatgttgcttttttcttttgcagtgtttctgctttgaatcttcatagactgtatcccatggaagcaggaatataattactgtagtgcttactttttttcatgtctctactgaagagccaccctgatttatcttttactccaaggtagtgtggaactttacaaggatttagattatattagtcattttgcttggagatctctgcacacttttcaacatcatttctaagagccttgccacactcagtaaaagagggtgaggcttcaagaatctctgtgtaccaacgcaaattaggcaatttgtaagaagtccctagtagagcagagtggagagagggctcaggatctcgtgaggcctggggcagggaggtggacatgctatgagctcctttcacagtcaacacaaagttaacacatcttggaggaaaaaccgttactgtataatggaaggcagaaggcagggatgtctgtgcttggtgatgaagctataagtagtgagctgatttatgatggaggggtgaattgtgccatgaaagagactcccctcaattttattagccagattactgcccatatgcggggtgaggagtgagcattttaaggcatttctctctgttttcaatatatcatctctggattcactattactgggacttgtgaatatagactagggattaaaacctgagtttgcttttaaaaaactttattttattaaatgagatttctgagcaactgatttcacttagtcttatcaaactattcttactactttttcgatatgcattctgtccctcctgtgtgaaggccacaggcccatggcccccatgtcattgagatggaggtcctcaagtgatggcgggatgaatcacctctcacttgccacctgcgagaatgtctatcactgatacctctccttatgtcccgtagcagctgctaagctcccacgttattattggtgacactttctagtgttcaggagagaacaggatttactttttgaatgcctctaaattattatagcaggttcatttggaattgcatatcagaacattcttcctgtttatcaggaaaataaaccaaggtcttgaaacttgatgtctatccatagttggcccaatataattttgcatgtggtttattacattatttttctccattggctatgaactgaaggcatctcatggatatttattccacgctgaaaaggtagttagatgctgtgtggtaaagtcgagaccagtatattggaagaaaagagacactccatctaataatctttcatagtcttcacattcattgagaaggttacttgataacctttcctgcacactctctcccaaccctgacccaggaacttgcagagcacactgtgcaacagatctaataacccttgtctgcaggcaatatgcacagctgggaaagataattaaatagactctttttgagaggtctacaacatttcaacggaaggatcgagcaatccggctggcctccgactgaaaactattaccaacagacatacttcagacagattccatgatcaccatccttatgtggcacaagtgcttatggggagcttctttggcttccaaaaggccactaaaactgtcagacctaaataatactggaactgtaaagtgggaattaaaaattataattccatttaacatgtaacgttctcatcagaaaggggcctttggttttccatattgatcggttacatggtcagctgcaattgtaactcatgagacacacccagatatcatcctgcgtgattctttttgaggtttatttagggtgttagataatccgaggtaggtttcatcatgggtggcaatattacatatagcaaatgtcatgagaagagagacaaagcctcccttttgaatgttaacatttatgcaataagtttaatgtaccgtgtaagtttacattactattatgagacttaacctaaaaaattggggtgaaatcttaaagaattatgaaattaagaaatgaaaccagagggctttcgttttaagtactgatcacttaaaccaaaaccagtttggcttatcctatgagatcgtgggtattgagaaagaggaacatttgctgctgcatccggagatgtttccttgagagcaagactagttccttttgacccagtacatcctacaggtaaatcactgcatgctgtagagatacctgttccctcccttcccccaccccctggggatctgaaaccaaatcattgctttttcatcttttacttatccttataaacaaagccacccactttctcatttttcctgatgccaagtccttctttacatgagtggaatccactcttttcaatggaaagacacctgctctgagacaggctacactgtcatgagccttggcatggctgagtgatgtagtggaaggtgcaataaatttaaactttaaaaatgcaaaatttgatggaatcatgcatcttgtgcctacagtgagtatatggtctagcaggatttacagatacatgcatgattaatttgaatacagtatagcaaaatgatctgttaaaaaacacatgaaaagatgtgcaaccttattagtcattaggaaaatgcacataaaaccaccgttcctgtgtgatacctctgtacgtctattagaatgtataaaatttaaaaagactgaacatagcaagcactggtgaggttgtagaccaactggtgctttcatgttttgctggtgagaatgtaaacattacaactactttgaaaacagtttgacagtttcttaaaaagctaaaacatccacctggcatgctatatacagatatcctactcttacgtatttaaccaagagaaataaaagcatatatccattcaaaaacttgtaaataaattgctcctagcagctttatttgtaatagccaaaaactagaaacaacccaaatgtccaatgaaaggatacatcgtatttatttataggacatatccatgcaatggaataccacttaggaatagaaagaatcaactgttcatcatacatacaaccacatggctaagtcttaaaaataattatgcttagttaagaagtcagacaaaaaggtaagagactgttaggagctgaattagcgggttaacagtggcaatgaaaaaggagaaaattatagctacctcaagatagaattgatgagctttgattatgaaatgatggtaagagagagggccatagactctgaggtctgtctctagctttggtttccctatgtggatcattatctatttggatataagaattatctgaaagatgatacttaagcatgtaagaaatgataagctacctgtttaatgatgagcttttgttacctccaagaaccccaagaagaaacatcctgtaagcagaccattcatacttgattgttaaaggaaaacaaaattccattttgtctttttcatcaacacaagtatagctggctaataaaagtgtaatattcatgagagaaaaagaaaagaacacgcacacacatacactcaacaggattcctagagtcattcccatggataagagggaaggaaaggttgagggcaaagagagaagggaaggaaacagactatgatgggatatcttagggcaaaagaatagggggctgatttggaaggcagcaaacttcatggatacttgatttatttaatgtccctgtcactctggcgtatcttaatgtgtgtggtgtgtgatttatttagtcacttgatccaaattctctaattaagtggagctcagaagatatagtgtccattgtggtcaagggcacaggttttggcttcaacagacaaataagctctctgagcatctgtcttctcatctgtacaatgggaatatcagttcctacctcttcaggttgttgtattcataaataaattgtgtacaagaaacattaggattgcttcttacccgtagtaagggctcaacaaaccttctcctccttctcctcctccttctccttcttcttcttcctcctcctcctcttcttcttccttttgcttttctccttccttcttccttcctttcttcctacctccttctcattattgttattaggtaaccacaatattatcagtaatgattggagaaagctttaatctcctagttcaccattagaaaacaagaacacattttggtggttattacccgaagtaatcataatgtcacctttttttccatctgactcattatcccaagtgatttatttatatatggagttttctgagtctttcttttacatattacaaaaaaagagtgtgatttagggacgaagcaaagaaataaaaatttagtgactttcattctgcctgtgccccaattcctattgggcataaggcaagtaatttaaatttcttagcaccttagcatcttctactcaaacagaaatgaggaacagtcacaggttactattatagctgtctaagtagaaggcacacaagttttcacactgagtataacactttatagaaagctaagtgtgttgctcaagttggtacatttctgtagatgtgacactatggcactaagaaacttaatgccacattgaaattcattgagatagctagactttaaaaataattacttgacttcactataaagtatgttcgtattgcatttactccatctagtagaaaatagaccttgtcagttcaaatccctgttgcattaatttcaccagtaatgagtctttttcatttgagtcagcagggtttttcttgcttgttttcaggctttgtggatttgaccctccatgatcaggtccaccttctagaatgtgcctggctagagatcctgatgattggtctcgtctggcgctccatggagcacccagggaagctactgtttgctcctaacttgctcttggacaggtaagtgacctggctgtagcttaggagtagcatgttctttacgatcatagttcattcatgaaactattttattcatctctcggtgaagcttcagagaactttattaggtatgtttacttaacaaaagagtgcattgggggtgatgaagcctagtcaaattcacagaaagctaaggataactttctgctagacattacctcagaagaattctattatttctaatacacacacacacacacacacacacacacactcacactctctctctctctctctctgtcattatgaatggtaattttctaactccatcttcaacttgtatcatataaaaattataataacctctctttaattaaaatctgttgttgcttcttgtacatccataccacaatagcctattcattttcttctccaattttcccatccgtaaaatgaagaaatttgaccagagttctgaaggtcacattcaggtcgacaaattcattttcatgttcaaatatgttaccttctttaacataccattctggggttgccttggaatgtgggtcccattgttttttttttttcagtcattgcttagagtcatagaatttagatattactcaatagcagctgccactgatagagtctccaccctgcaccagctgtgatgctaaacactttacatatattatctcatttaatcatcaccggactcctaggaggcaggaatgtcatcatccatgttttaccagaaaggaaactaaatctcagagacatcctgctacttgcaaaaagaggaaagctcactaaatggtggagccagagttcaaattcaagatctttctggctccggtatgctctgttacctcctgtgctgggcacatggtcttcccactctcatgttcagtgatgcctcctttggtctgctgccatagcattctgttttccaggtaaatcttgtctttgtgggctacataacattttggatgagaaagaaccattttgttgtttcttgcaatcctattttgcctccgtgccaagcagtctaaggctgccaggctgcccacagtgcatctctgcatggtactttacttcagagcatttcactatctttctacacctgccaagtgcctggagcagagttgcagcaaaatttatttaagtactggagaattgtacaaggtgttggttattgttttgtcattttgtgttaacacagcttttgaaaaacagtggtgatacagtttaagaagcatattttgctgtctgtggaatatattttgatatcacagtttcacaaaattatcaagaatggccactagtcttgttccttagaactgtactcacaatgtattctgtcagccttatagaggatgtctttaccgtgttctttcctttccattccttgtttcctttccattttttcctatctcatttctcctctcttttcctttgctttcctctttctttctttctcctgtcctcttaatttttttgtcttatagcagtgtggttttgtaaccaagtgatatcaagtttgcaaatgaaaatcttagaccacacgtaacatttccctgcctactgcctggagtgtctaccatgtttaggtttttggacattcataactcatttgctccttgatttccatcctcatctgtatctatcttcttttttaaaatttaattcaatttttataatgttgacacaattatgcagattcatagggtacacagtgatgttttgatacatataatgtgtggtgatcttatctatcttcttgagtacacacttgcttgaggacagtcatcaaataattgcattttgaatatgtgaaggtttttgacattactgcacccaaaaaactcatattgccagtgaggtgatatggcctaggattttatcagctacagccttctctttcctttctgtacactccagtggtggctaattttctttcctctctcacagaagtatgaatgactaaaagttctcatctctattcattcctactttctaaaacttcagatcggaaatttgaattacctctagaccaggatttgtcagtctctttactattgacattttgggtcagatcattctttcattctttcttggttgaggggttgatattgtttggtgtgtcctcatccaaatctcaaattatagctcccatagttcccatgtgtcatgggagggacccggtgggaggtaactgaaacataagcaaaggtctttcccttgctcctctcatgacagtgaatttctcatgatatctaatggttttataaaggggagttcccctgcacacgctctctctcttccccgttgccatgaaagatgtgactttgctccttcttccccatgattgtgaggcttccccagtcacaaggaactgtgagtccattaaacctttttctttgtaaattacccagtctcaggtaggtctttattagcagcttgagaacagactaatacaaggggctgtcttgtgcattttaggatgtttaacagcatccctggactccaccagctagctgccagtagcaacctccacttcctccagttacgataactaacaatgtctccggacatttctacctatcttctgttgtgtcagggggtgggggaggtaaaattgcctctggttgagaatcaccactctatgctttcccaactcaatgttctataagctcctcagacacactgtactctaaactgcacactcactttatcttctgcaacaagtctattccttttcttttctgtcttggtgacatcaacactcacctagacactaaagctagaagctttaagttacccatggattctaccttctccctcaccaaattatccagttaactatcaagtcatctatgaactgcttctgaatccagacctcccctctatccccattcctctgcatggcacaggtcctggttgtctctgctgcagattccttgcttctgcaccactgactcactttcttggtcctgctactctttctttcagtccatctcccatactgctgctggagaaggctttctaaggcacagctgtgatcatgatgcttcctgactcacctttcagtggctctctcaattcttaacatggagaaaccccatctctactaaaaatacaaagttagccgggcatggtggctcatgcctgtaatcccagctacccgagaggctgaggcaggagaatcgcttgaacatgggaggcagacgttgcagtgagccaaaattgtgccattgcactccagcctggatgaaattccgtctcaaaaaaagaaaagaaaatactgtgtagacttcttatcttaataatcatgaatcactattacaagtgtctcaaacgcaaatttctgaagagtcacaggtgacccagtgagcccttgtccaggctaaaaacacctggtggctgaattctgaacttcacacattcgaatttctcttccattgcttctgagagaccctccaccattacggttccttatcagagtcatatctacctataaggctcatttcaggtgccgtctttttataaaatcttccttcaaactttctcctcttcagcctttatatatacaaaaggcttttctttcttttccttttctaagtttccattgtagttggtttgcttttctctttattattctcattccaccatattagttatgattggatgtcttcttaccttccctactagctcataaacttcttgtggtcaaaaaccagatcttgttcgtcttgtgtgatctccagtttacgaagtcttccatgatacccaacaaatatttgttaattgcactggccaaggtcacccaggtggcttgtggccaaatcagaagaatctacatcttctgatagtcatggcagctgttattcccatccaactcacttcctgtgcattgctactcatcaattccccacttattcttttaaaaacattgcataaatacatatctatgtgttttggaaagattttcttaatctataagcgcatttggcgtgtgcttatatgtctgcttatatgccaaatttgaaattccaaatttcgccatttggaatttcaaatggggaaaagcaaagactcttatctttcccataatcaaaccccttatgaagtaaaatccttaaggtctctctacaggttaaaaataattaggtgatatgatttggctgtgttcccacccaaatttcacctttaattgtaataatccccaggtgtcaagggtggggccaggtggagataattgaatcatgtgggttgttttccccatactgttagtgtggtagtgaataagtttcatgagatctgatgattttataaatgggagtccccctgcacaagctctcttgcctgctgccatgtaagatgtgactttgctcctccttgccttccgccatgattatgaggcctcctcagccatgtggaactctgagtcaattaaacctctttcttttatatattacccagtctcaagtatgtctttattagcagcatgagaacaaactaatacattaggtatatgttaatgatgaggaatgtgtataaatacatatacatttatatttaaatattaatatttacaaataacatgatattaaaaatatggtctataattttttaaattatctacctttctaatcattaacatgcactaaatattattaaatttcaatattatttaattaccatcttggtgtttgaggataactgcttttgatggcattgatagatgcattaacagtgaaacattgtgaccaacagcccatctgagattttatacttgtagaagatggcttctgagtgacagctgagaagactgtttatgtctttgccctacaggttcctaacccctttaataaaatagagctctctgatgcagatgacacatgggccttctttttgctcttgtcccatcacattgtacatagtaaacatttttagcaacaaatagtagatacttataactttaaaagctaagtggttgacagctgagaggcagatgatggtaatttcatcatttttctcatatctcaggcattgtgacactacctctgcaaggtcaactgtctccataggctgttttcatttgcgtagaaataggggggaaagatagcttgaagtcatcaggagccctgcaacccatggattaccaatgttgctaactggagcctggatttcatcttcaattgattgtaatgatgtcttgttctctcaaatctttgcaaatctaggcatttataagactatcctgtaggtcccttacaagaccatgaggatgctagaacttaccctagtcttttcttgtaattgcttaaatgttagtattggcaaatggggtttggtgattataagagtaaaaaaacctgctgccatcccacatttgtgagcagaggatacatttcctatcttgtgtccatttaaaaagaatgattgcttgattggcttcctgatgacaacccatgatatactgattctgttagtttataactttcctagtagtcatatgcttataggccaattttatccttgccatgcttagcctagtcacaatttccagttcttctctgtatcctgcagcagtgagttccaaacacttaatgctgtcatctcttcctgtgaaaaccaagaaataaaggttattataaggtataaataaagaacccagtgatttctcttggggtgtgtgtgtccatgtgtgtgtatattttacaagaggaaagttaaagatactaagaatgcctgtgaaagtaatcaggaaatggagaaaacttgttttccattctagcacctaatcctttggtgtgttttggcactagaaaacacaaaatatgtcctctgtgtctactaggaatgcctctcttcatttagtcctgcttgagtgctcatgatggaaaaatatagactgaaaacaggagcaaaagtgttcatcctactcattccttgtggggtctctttgctttcaaagagatgttagagatgttagtaaatggtgttagaagaaacaatgtaaattgcctgtttagtaagatgatccagtttctaaggaactgttttactggcgccttccatgctaacaaattctgagaaatatttgcggatttctcagtgaagccaaagcactctcttttgactcctatttactctcagagaaaaaaactattcatccatttgaaaagcagggaccaattcaacaagcagaatattccctctactaagcctttggccagagagttgttgctctagttctttccatcactcctgcatcaggaggctctgcctgcaggaaatagtattggacaacagaaagttcttttacttgtaggcataaaataggtataaattctcctccttaagagaaaaacaggttgctgcaccagaaagaacatttgcctcttctactaaatagcagactgttttccaatgataaactcattttaaatagaaaaaaaaaagtcattctctacaaacaagaacattttcattttaggttgtttattgtaaatatttcagaaaaaaaatatgcaaaaaaaaaaatgcccaaaaatcaatgcttccagtaacatatttattagctatctttttccccatgtaaaacttcaggtaaattctttgcagattttttacttggaagaatgataaaaaaaaaaaaaaaagttctgaaatgagttgaattcatccacgtgtgtttttgattcacatgaagagtaggacctccctttatattccctcttcaaattctcccctctgaaaaatgggtggtacactcaaaggaggaccgcacacattgtagtagctggggtgttgggggtggaaggagcaggttttgggggtgggaggagcggtgagtgatcctttcagcaaagtcagtcctgggcaggagacggcttcaggaatactgtcagctttactggattccaccatcgctttccaggactgtttaggccctgggcccttgaagggtttgcgtgcctcttgtctccattcatacctcaagaactttgttcatgttaattttttttcactctatcatatggaattgagtaaaaaaagaaaaaaaaaaggaagccaacacttacttaactgctttaatgtataggactctgttctgggttgtcttctaaagtacatttcattcaatgtgtgagaatacagataggaaagagttttgctagtttctattttgactgtggatccattgattctttctggttctcagcccttaattgctcagctgcagataccacttgactgactcttaaaagtctttggtttattgcccaattctgggaatatgaaactgtaagctgtttaggagaaaaactgagaccaaaagaaaggagaagtgagccaaactgccattatgattgccacttcttattgaagataaatcaaaatatccatttgactagaaatcaattgaattatgcactttaaatgggccaattcaatgatacctgaactatatctcaaaaaaggtgttaaacacaggcacacacgtacacacacatattggaattccaggaaaagtcactttgatcaacaagattatcagtcgtcaaagtgcttggaagggttctattggaataaagctaaaaaaaatcaaagtaaaatttctccttaaaaacaaaagcaattaagcagcactgtattataaaatatgctaagctgcaagtcaaaattcttaagagacttaagcctgtaagcagtaaggatccactcaatgtaaagttactccagagggaaaggcgtgagcccaaccaaagtattaatgctgtgtaggaggttaatttgactcttcttaacatttttacacaccacattatgttttattcaccatttattattaactgaatttattaaagtataatcaaaataatatttttgagagtttaaaaatattctcataatatttaagttacatatactatgcagggaccgtcaagtaattccactctgacatctgtatttattaccgccacctgtccatgatggtattagaaagatcctcatttgttttaatggatgcctctaaaatccagttttaagagggggttggccactttcaagtttgtgttagttaggattcagtttaacccagctcaacaggtatttactaagtaccagcatatccatagggcgctgtatgatactggaggacacacagaaaagagatgtgtaagaggcactcctgccctcaaggagtttactattgagtggtagtgtaatatgaataaacaaatgaatctgctcaaaagcagggcattctaagcaggccctcaccagcctctcatcattcgcatctagtgtatcttcctccatcactttctaaacgctatggattctgagtgaaaaccaatcgctggtttatgcatgtatgcatatatgaattcattcttgacattgccatgcagagtatttagtataactagacttattatccatttatcctgcctagaagcatactgtaatatatataactctaaaagcaagatcattccttatgttggttcttttgagctggcagggggaaagcagagtatgttggcaggggtctatcaaggtagatgagcccagtttgtacatctttgaaatattaccaatgccaatgtgttagtactgcttggatctcttctatgacaacagttcttattttttccttttttttgtttgtttgttttttgagacaggatcttgctctgtcacctagacaggagcgcagtggtgtgatctcggctcacttcaatttccgcctcctgggttcaagcaattcttgtgcctcagcctacagagtagttgggattacacgcatgcgccatcatgcctggctaatttttgcatttttagtagagatggggttttgccacgttggccaggctggtctggaactcctggcctcaagtgatctacccgccttggcctcccaaattgctgggattacaggtgtgagccaccacacctggcccatcagttcttaatttgatgaatggatagaggtttggcttcaaataaatggagttagtctgtcaatatctgtttcttttaaaatttgcaattgtttttatttttagtgtcatgctatgtgcccttaatgatctagaattaagttctaatctctaccctggtataattgatttctccctgtggactcctaatataagaagaaagatgaagtttttcttttaatgcttttagagatcttcattaagtcatttaatattcttatttgctatttcccagtgtgatggttaagactgagtgtcaacttgattggattgaaggatacaaagtattaatcctgggtgtgtctgtgagggtgttaccaaaggagattaatatttgagtcagtgggctgtggaaggcacacccacccttaatctggtgggcacgatctagtcagctgccagcgaatataaggcaggcagaaaaacgtgaaaggggaaactggcctagcctcccagcctacatctttctaccatgctgaatgcttcctgcccttgagcattggactccaaaatattcagttttgggactcggactggctctccttgctgctcagcttgcagacagtctattgtgggaccttccgatcatgtaagttaatgcttaataaactcccctttatatatatcctattagttctgtccctctagagaaccctgactaatacacccagtgtgttcttttatcaaatagaaaggagatatagaaaacacactgtccatgtctttgattgttacaccacagcagagaatcaatttcttaacctgcttacttatttaccattctccaatggtgccaattctgagatccatcatgactttatcattagaaaaggggatgtaacaaacatgatgagatgttacgggaatactgcttactgcatgatatggtttggctgtgtcctcacccaaatctcatcctgaattttagcctcccatacttcccacgtgttgtgggagggacccggtgggaggtaattgactcatgggggtggtttctcccatactcttctcctggtagtgaataagtctcacaagatctgatggttttataaggggttttccctttcacttggctctcattctctcttgcctgctgccatgcaagacatccctttgctcctccttcatcttctgccatgattgtgaggcctccccagccatgtggaactgtaagtcctttaaacctcttttctttataaattgcccagtctcatgtatgtctttatcagcagcatgaaaacggactaatacactgcatgctcagtatactcaggcactctggaaactaggtttctacttcggacccctgagagaaaagggttatgtatctccaagtgtggtcatgacaagcatcactactgtgtgcagttgggcctgtggattgagccaccttagcctctgaggaaagcagaacctgagagcatgcttaattcagagtgtgtgtgacttggagtgtggaaaggaagatttccagatttgcggtattggcgactgaaaggatggcaatgctattgatggagattaggaagacaggagagaggtagatgttgagcaactccgaggagtttttcctcatacatgttgggtttaaagtgcagggaagatatcctgaaggttattccaggcagaaatttggagctcagaagagacatcagagctgaagataaaaaatttgagagccatctccgtagctaaaagtgtggaacgaatgtgatgactagacaagataatagagaaaaggtatccaaaggcctgaggtcaagacctcttaaaaggctgacttttcagggttttaggtagaaaaagagtcccagcctggggttaaggcagttttttgagaagtagaggtacaaagttccttgttccaaaggaagggtgtctttcaaaagaaaaaggatgggccgggtgcagtggcttacgcatgtaatctcagcactttgggaggccgaggctggcagatcacctgaggttgggagttcgagaccaacctgaccaacatggagaaaccctgtctctactaaaaataaaaattaaaaattagccgggcttggtggtgcatgcctgtaatcccagctactcaggaggctgaggcaggagaatcacttgaacctgggaggcagaggttgcagtgagccaagttctcaccattgcactccagcctgggcaacaagagtgaaactctgtctcaaaaaaaaaaaaaagagagaaaaagaaaaaggatggtgaattgggccaaataccagagagatggacaggagtaagaagaaaaagactaaagatttgttcatcaggagctcattgtttctaaagggagcatttttagtaaagaggaaggaggaataaaatgcagtataatatgttaaatctaagtataatttataaaagagaaaatgggggtggaatattacaaaaaaggaactataaaccagctctttgaggtatttgtcagtgaggaaaacagtggggctctagttcttgatagcaacagcatcaaagggaactttttaaactaaaatattatgaatttttcaaactgaaataatgagagaataatacaaagaaatctcatctgcccataatccaaattcagtagttattaaaattttgccccattgcttaatccattaatctcatttcattttgtcctttttctttgtttatttttggctaaaacattttaaagacaaatcctaaatatcatacatcagtaggcatttacaaaaaaatttcttgataatcacaatgccattctcataccaaataaacttataataattctgtgatatcatctaaaaaacagttcttttctacatcaaaaatgtctgtttatagttgatttattcaatttagagtccaaacaagttccatatattagacattaggtcattaatgtctgtctatttgaatttataacaatttccacttaatttattttctccagcttctgtggagactaggtaagttgttttgtagctgtctggatatatctgattgcttccttgcagtgtcatttaacttgttcctctatcctcagtgtttctgcacatggaagttagcctcatagcaggggttggcatactttagcctgcttaccaaatacgactcccttacatttttgtaaataaaatgttactggaacactgtcacatatgttggggtcatagaaagagtttccgtgtccccaagttataattgcattcacttatattttcttctagtaatttttacccttacatgttaggggtcaatttggaatttctcttcatatacagtatgcaataaagaatggcttttatatttttccaaatgtatattcagttgtctcaacaccatttattaaaaagtcagtatttctcaagtgatttgagatctacccttaattacacagtaaatttctctgtagtcttgtctttttctaatatgttaattctgtaccaagatttgttcatctgttaatggatcaatatcacatagctttgtttatagaaggtgcacattgttttaattctggccatgctatcccaccaaatattgccctttgatttttcagagttttactgtggattcttccttgtttctttttctatgtgacctttagaattaacttgtttaattctataagtaaatttattgataattttattgaaattatgtaaaatataaattggcttaggaagtactgatatctccatgacattaagtcttcatatctaagaccaaggggtgccttttcatttgttaaatattctttgtgtctttcagaagtgttttcaagtatccttatgtgtattttgcacaaatttttatatttgtgcctattggatgccacgtgcagggttaaaaaatattatacctattttatatagatatatatgtatataaaaatatatattatatatagttataatacataaatatattttaatatattatataatatatacatgtattgtatttatatatgtatttatatgtgtatctataaatatacatatgtatgtatctataaatatacatatatgtgtacatatacacatatatacacattatatgtatgtttatacacatataaatacatatataaatatactagaaagtccatggggtttcctagtatacaatcatattgtctgcaaatagagattgttataccttttcctttctattccaaagtgtctaaaagattttttcttagctagtggcattggatgacacctataatgtcttctaaaaatagtagcagtcataggcaccatttccttattcttgaatattcattcatgttacaaagtttataggaatttctgaattattaagtacttttaataggaatgaaggttattgtcattattgcatcaaaattcataagaaagtttggtgtcaaatttgtgctttgtgtgtagtcttcatcacgcttttttttttttttttaaccagtgttaaacatccattacaaaaatagtttggaagtttttctttttttttttcctatgtcctggaaggtgtaagtagaattggaattatttgatctttaagatgtaaaatattggtagaattctacctttgaaagcacctggacatggtgacttcttaataggtgagctctctggaaactttatttcttctgtagtaattggtctccttagactttctattccttctggagtcagatattgtatatcaaatcttctgttaaagttatccatttcttcttggtattccaatttttcacattgagttggacaaatgatttctgatgatgtttaaaaaatttctctggtttgatggttactttgaccgtataatttattttgtgtatttatgcttcttttagaaacttaggtcagctagtggttcctctattttgttgatttttttcctcaaagaactagcttaagtttattttattagttctactagttttctgctttctaactcattaagttatgcctttagctttattaaatccttcattctgctatcagttaatgttttagttcattttctagctttttgagttgatacttaatttattttcatttcatgatataggtaactgatgctcagaattttctcaaagcatcagttttcgctgggccccatagattctaatatatcttactttcattattattatttcctaaaaattcagcaatttcatgttttattttgtctctcattcaagagttgtttaatagacagtttaatttccaggttggatgggcattttgttttgttttttgttttactgtttataaatacttttggccttgggatcagagaatactgcttgtattacaattattactgaatatttttgtggtctaatataatttcagctttcaaaaatgttccatgtatacttgaaatgaaggtttatttacccttataaagatagaaggtaaaatattagctatgcccatgtctatttatcttcttataatttttgcttaatgaaaactaatgatccattatctgctgcataagtatttatgtttgctttctctttattatgccttatggcttttgtgttaaaaagctattgatttatttaatattttggaaggattgaattttaccctatctaatatcaagatcatgactcttgattcctttttgttttcacttgtttaatatatctttcttctatctttattttaaacacaagaagagctttgctttcagtttctattttacatagtctacaatcggattttacttattagtcaatctgagaatacttttaatagatgagttacacaaatacatatttattgataccaacacagtttaattcaagatctgttctattattttatatttattatatattaaattgtcttctttatttactatttattgatttattgaatttattttgctttcaggtattttgtatttttgttctggttgttagatttatgcatacttagtcaactcttcctttataaagcattcattttctactatgagcagtagtaaaattagctagtaacttaattcctgagcactctccagtcctagtcactagtaataacgcagtgttaaactttgtaatattaattatacttaagcctctattacttggtttgtcaaaatcaaatgatatcaatttacttccagcacatacctatgaggtaattgtaagctaataataacttccatggctattcttttctctttttttttttttgaggtggagtttcgctcttgttgcccaggttggagtgcaatggcacgatctcggctcactgcaacttctgcctcccgggttccagcgattctcctgcctcagcctcccaagtacctgggattacaggcatcagccaccccacctggctaattttgtatttttagtagagacagggtttccccatgttggccaggctggtcacgaattcctgacctcaagtgatccaccccatcagtctcccacagtgctgggattacaggtgtaagccaccgcacccagcctctcatcttatttttattacttatatttttctacattattagaagttataatacttatatgcacatttctttagccccaaccccattttttgatattagctctattattaagatatttaatgtccaccttcagattatatgctgatgattctctaatcgtttttggttgtctggagcttttttactgtttattttcaggaagagctcatgataactcttttttctttggtttaaaaatgtttataattatttttctctggactttatgctgagaaatttggctgcatacaaaatctctggcttacattttttctcaagtatttttaagtgattgcttcattattttgtagtataaaatgttgctcacaagaagctggatgccagtctgattttctttccctcattagtgatttggactttttgtctgaatgttgaatttttaaatataaacataaattgcaatacttttattaagatatgtctctgcattgaacattttaggtccgttttcctaggtacatagaatgtcttttgaatatgtagactcaaatcagacttcttgattctcttgatttatagttttaaatatttgtttgggggcgggtgcggtggctcatgcctgtaatcccagcactttgggaggccgaggcgggtagatcataaggttagcagattgagaccatcctggataacatggtgaaaccccgtctctactaaaaatacaaaaaatatagccaggtgtggtggcaggcacctgtagtcccagctactcgggaggctgaggcaggagaatggcctgaatccgggaggcagagcttgcagtgagccaagatcacgccattgcactccagccttggcgacagagtgagactttgtctcaaaaaaaaataaatagggggcggttccaagatggcagaataggaacagctccagtctgcagctcccagcatgagtgatgcagaagacaaatgatttttgcatttccaaatgaggtaccaggttcatctcactggggactattggacagtgggtgcaggacagtgggtgcagcgcaccaagcatgagccgaagcagagcgaggcatcgcctcacctgggaagtgcaaggggtcagggaattccctttcctagccaaggaaaggggtgacagacggcacctggaaaatcgggtcactcccaccctaatactgggcttttccgatggtcttagcaaacggcacaccaggagattatatcctgtgcctggctcagagggtcctacacccacagagcctcgctcattgctagcacagcagtctgagatcaaactgcaaggtgcaagcgaggctaggggacgggcgcctgccattgctgaggcttgagtaggtaaacaaagtggctgggaagctggaactgggtggagcccaccgcagctcaaggaggcctgcctgtctctgtagactccacctctgggggcagggcatagccaaacagaaggcagcagaaacctctgcagactgaaatgtccctgtctgacagctttgaagacagtagtggttctcccagcatgcagcttgagatctgagaacgggcagactgcctcctcaagtgggtccctgacccccgagtagcctaactgggcacaccccagtaggggcagactgacacctcacatggccgggtactcctctgagacaaaacctccagaggaacgatcaggcagcaacatttgctgttcaccaatatccgctgttctgcagcctccgctgctgatacccaggcaaacagggtctggagtggacctccagcaaactctgacagacctgcagctgagggtcctgactgttagaaggaaaactaacaaacagaaaggacatccacaccaaaatcccatctgtacgtcaccatcatcaaagaccaaaggtagataaatccacaaagatggggaaaaaacagagtagaaaaacagaaagttctaaaaatcagagcacctctcctcctccaaaggaacgcagctcctcaccagcaacggaacaaagctggatggagaatgactttgactaattgagaaaagaaggcttcagacgatgaaaattttctgaactaaaggaggaagttcgaacccacggcaaagaagttaaaaaccttgaaaaaagattagacgaatggctacctagaataaccaatgcacagaagtccttaaaggacctgatggagctgacaaccaaggcacaagaactatgtgacgaatgcacaagcttcagtagctgattcaatcaactggaagaaaggttatcagtgatggaagatcaaatgaatgaaatgaagtgagaagagaagtttagagaaagaagaataaaaagaaatgaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcacattcaggaaatacagagaacaccacaaagatactccttgagaagagcaactccaagacacataattgacagattcaccaaagttgaaatgaaggaaaaaatgttaagggcagccagagagaaagattgggttacccacaaagggaagcccatcagactaacagcggatctcttggcagaaactctacaagccagaagagagtgggggccgatattacacattcttaaagaaaagaattttcaacccagaatctcatatccagccaaactaagcttcataagtgaaggagaaataaaatactttacagacaagcaaatgctgagagattttgtcaccaccaggcctgccctacaagagctcctgaaggaagcactaaacacggaaaggaacaactagtaccagccactgcaaaaacatgcaaattggaaagaccatcgaggctaggaagaaactgcaactaacaagcaaaataagcagctaacatcataatgacaggatcaaattcacacataacaatattaaccttaaatgtaaatgggctaaatgcttcaattaaaagacacagactggcaaattggataaagagtcaagacccatcagcgtgctgtattcaggaaacccatctcacgtgcagagacacacataggctcaaaataaagggatggaggaaaatctaccaagcaaatggaaaacaaaaaaaggcaggggttgcaatcctagtctctgttaaaacagactttaaaccaacaaagatcaaaagagacaaagaaggccattacataatagtaaagggatcaattcaacaagaagagctaactatcctaaatatatatgcacccaatacaggagcacccagattcataaagcaagtccttagtgacctacaaagagacttagactcccacacaataataatgggagactttaacatcccactgtcaacattagacagatcaacgagacagaaaattaacaaggatatccaggaactgaactcagctctgcaccaagcagacctaatagacatctacagaactctccaccccaaatcaacagattatacattcttctcagcaccacgccggacttaatccaaaattgaccacatagttggaagtaaaacactcctcagcaaatgtaaaagaacagaaattataacaaactatctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaactttatagcactaaatgcccgcaagagaaagcaggaaagatctaaaattgacaccctaacatcacaattaaaagaactagagaagcaagagcaaacacgttcaaaagctagcagaagacaagaaataactaagatcagagcagaactgaaggagatagagacacaaaaaacccttcaaaaaatcaatgaatctaggagctggttttttgaaaagatcaataaaactgatagactgctagcatgactaataaagaagaaaagagagaagaatcaaatagatgcaataaaaaatgataaaggggatatcaccactgatcccacagaaatacaaactaccatcagagaatactataaacacctctacacaaataaactagaacatctagaagaaatggataaattcctcgacacatacaccctcccaagactaaaccaggaagaagctgaatctctgaatagaccaataataggctctgaagttgaggcaataattaatagcttaccaatcaaaaaaaagtccaggaccagacggattcacagctgaattctaccagaggtacaaggaggagctggtaccattccttcggaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctgagtaaaatactggcaaaccgaatccagcagcacatcaaaaagcttatccaccatggtcaagtgggcttcatccctgggatgcaaggctggttcaacatatgcaagtcaataaacataatccagcatataaacagaaccaatgacaaaaaccacatgattatctcaatagatgcagaaaaggcctttgacaaaattcaacaacccttcatgctaaaaactctcaataaattaggtattgatgggacctatctcaaaataataagagctatctatgacaaacccacagccaatatcatactgaatggacaaaacctgggagcattccctttgaaaactggcacaagacagggatgccctctctcaccactcctattcaacatagtgttggaagttctggttagggcaatcaggcaggagaaggaaataaagggtattcaattaggaaaagaggaagtcaaattgtccctgtttgcagatgacatgattgcatatctagaaaactccatcgtctcagcgcaaaatctccttaagctgataagcagcttcagcaaagtctcaggatacaaaatcaatgtgcaaaaatcacaggcattcttatacaccaataacagacaaacagagagccaaatcatgagtgaacttccattcacaattgcttcaaaggaataaaatacctaagaatccaacttacaagggatgtgaaggacctcttcaaggagaactacaaaccactgctcaacaaaataaaagaagatacaaacaaatgcaagaacattccatgcttatgggtaggaagaatcaatatcatgaaaatggccatactgcccaaggtaatttatagattcaatgctatccccatcaagctaccaatgactttcttcacagaattggaaaaaactactttaaagttcatatggaaccaaaaaagagcccgcattgccaagtcaatcataagccaaaagaacaaagctggaggcatcatgctacctgacttcaaactatactacaaggccacagtaacgaaaacagcatggtactggtaccaaaacagagatatagaccaatggaacagaacagagccctcagaaataatgccatgtatctacaactgtctgatctttgacaaacctgagaaaaacaagaaatggggaaaggattccctatttaataaatggtgctgggaaaactggctagccatatgtagaaagctgaaactggatcccttccttacaccttatacaaaaattaattcaagatggattaaagacttaaatgttagatcaaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagagaaactaccatcagagtgaacaggcaacctacagaatgggagaaaatctttgcaatctactcatttgacaaagggctaatatccagaatctacaaagaactcaaacaaatttacaagaaaaaaacaaacaacaccatcaacaaatgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgattattaagaagtcagggaaaaacaggtgctggagaggatgtggagaaataggaagacttttacactgttggtgggactgtaaactagttcaaccattgtggaattcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccaacaatgatctggattaagaaaatgtggcacatatataccatggaatactatgcagccataaaaaaggatgagttcatgtcctttgtaaggacatggatgaaactggaaaccatcattgtgagcgaactatcacaaggacaaaaaaccaaacaccacatgttctcactcataggtgggagttgaacaatgagaacacgtggacacaggaaggggaacatcacacaccggggccttttgtgtggttggggaggggggagggatgcattaggagatacacctaatgtaaatgacgagttaatgggtgcagcacaccaacatggcacatgtatgcatatgtaacaaacctgcccattgtgcacatgtaccctaaaacttaaagtacaataaaaataaataaataaataaataaataaatactagtttggctgcattgctttgattttcttctttaggggcctgttcatacatacaaaggataccatttacctgtcttctatatgactttctcttaaatcctttcattcttttgttttaatttttatcttcacatcctttatttctgtcactgtgctgtccatagagtttgtctgctgtgtgtccttataattaagtctatgttctgaatgtttttccttttttagaaattcagttctaaagtgtttaatttctcgtatttttttttctgttgcctcaccatatcatttctgagttttctgtttctgaaatgtgcaactaactctttccaagcattgaccagattcttcagtctttttaattcattctgaaataactgggctacagtttcatctgctttgtggacagaagtgccacaaagagccgaattgtcagtgcagacccacatgaatcatagatcttaacgaggtttttactaacgactagcaaaggatacaagctaaaaatgggtacaagcaaacacagcatcattcatcactgtaaagactctgaactatcacatggaacttcaaaaggattcttcttctttgctgcaatgtgttttgatttttggagtgatagatgtttgctaactacgcacgtgacaaaaatttgcttagaggaagccatgttagttttgatgctactcaactttgtattttgttagtcatgagatagaaagcctgtgagattacatgcccttcttttagcagctgcatcccataaaattaaaaattccagttttttttaaaccatgaacaatttagtcagacttaatatatcctatttaaaacattcttagataagaacttcctttgttattttgctaatatacaatcccaccaaatgtctacaagaagggctagttaatcaatataccaaagatcaaatctatttatatgaaccacaaatacaaaacataattatacatatataattttatataatttaatttataattatatacattttatagcagcaatcaaaactatcatgtattttgggatgaatttaataaagaaatagcaggagctctgtagaaacaagtatgaacttctattggaagacagtaatatcataaaacattaaaaagaaagctataccatgtttatggttaggaagattcactattgaaaatacatcaattcttgacaaatcggtctataaattcagtgcgtgtccaatcaatatatttagctcatttaaaatgtatatggaaaaggctaagtaccaaagataatcaaatgctcttggaagatgaaaattaaagttgagagatggggtaaaaaactataattcagttctaaagtcataaagctataataattaatacagtatggcattggcatagaaataagcacattgactaaataaatagaaaatacagttcagaaaccaaactctacatttatgaaaaactgacctatatcagaacgagcattgagactacaggagaacagaggaactagtaagttaatggtcctgacacaattgatatctacatagaaaaaaaaacttaatccttctttactctatgtaaaaacaataattccagatgaatgtaggacttaatggagagccaaaactaaaacttttataggaaaacatagaaaaatacctatctcagggtcgggaattaggtcttcaacatggcaccaaaagtactaaccataaaagaaacattaataaagtcaacctttttaaaatcaacaactttaattaaaaaaccagggccaggcacggtggctcacgcctgtaatcccaggaggccaaggcaggcagatcacgaggtcaggagatcgagaccagcctggccaacatggcaaaacctcgtctctactaaaaatataaaaattagctgggcgtggtggcgggtgcctgtagtcccagctacttgggaggctgaggcaggagaatggtgtgaacctgggaggcggagcttgcagtgagctgaaatcgtgccactgcactccagcctgggcaacagtgcgagactccatctcaaaaaacaaaaacaaaaacaaaatcaaaacaaaaaacaaaacacaggttgctggaaaaatggttacttatttttattatgctttataaaatatacagttatattatcaaacttcttttgtaagaatcaaatattatgctgagaatatggcaagaaaaaagaaaacaacctccaccactcataatggcattccctttacccaccatcaactaagtcaggaacctgcgtcactttcaagttttctgaaatgtggactgaaaatacttgtggagggccctcacagatgcatttagaaatggtatgttctggaaaatggaactgaaatgttttagcgagagtcatgggcccaaaccttgaaatagaggttggtggagttttctatagtatgtaattacaacacaataagactcaaaagcatttcaataaagtgtggatggaagacaagatactgcttcaagggcttcattagctttctgcagactggagctctccaaggcatggggaggaaccctgtttacctttggttcagaatcagttttaaccatcattgagggctaggtcagagtgcagcattaagtccttgggaatacactgggtggggaaagaaaagagagcaatgtttttctaaaagcccagaaatgggcttactgtgtttaccagttgtttccaggataatgtattgcagtgccaattgctgatgagatggtaggattatacttcagtccctgctttacatttatttcttaaagaagcttctggtaaattagagcaatagcatcggcttagtttagtgttgttctgttggactaaggatatcagttctatccgtatggtcgggcctaaagcctgggaaatatttaatgaagggagagagggggagagagtgagcatgcaaaagagagagagaaaaacaaataacaaaacaaaaaccaagacatttccctttatagtaagaatgatgaggaaaacatgtttagccatacaagatatcaagataatctcttatttctttcttgaaaatgcaagtacaaatgcctgcaaagataaaatatcctctggatggagtggaaaggttcaccaggcctctgaaatcacgtgaatgatgttgcgctttgctgttaatgaagctcggtgcatttttcatttcagtttctactaagcatttatgagctattacccttcccttccctaaactgcgttgttttttaaaaagccttagaggcattccttctagaaaataaaggtaagtgttaagtggtgataatttggtaataggtgtcatgcttgtggttcataatgtgttaccctacacattttctcaattatccctagaacagctttttgaggatatgaagttagaccttacaaagcacatctttctgctggaaaaatgaggtttatagtggttaagtttagttgcttatgatcacaaggctagagagtggccggaatcaagactcttcaccctgatttcagtgctttttcactccaccattaatatttattgttgataaataatatcaacactttcctaggtgtattagggtcatctagagggacaagactaataggatagatgtatatatgaaaaggagtttattaaggagtattgactcacaccatcacaaggtgacgtcccacaataggccatctgcaagctgaggggcaaggaagccagtctgagtcccaaaacctcaaaaatagggaagctgacagtgcagccttcagtctgtggccaaaggcccaagagcccctggcaaaccactagtgtaggtccaagagtccaaaagctaaaggattggagtccaatgtttgagggcaggaagcatccgtcatgggagaaagatggaagccagaagacagccagtctagtccttccacgttcctctgcctgcttttatcctagccacgctggcatgatgatgacatggtgcccgcccagattgaggatgggtctccatcttccagttcactgacacaaatgttaatcttctttggtaataccctcacagacacacccaaggacagcactttgcatccttcaatacaatcaagttggcactcaataataaccatcacaagtccacaccttgtcaacttgatcccacatacatctccttaaatcatacatgatctccaaatacagacaataatgtcataattacactgaacataatacaactatcgttcatacaaccagaaatgcaccaattcccaaaccaaatgttattacataaagttaacaacacttaaatgctgatatgaagtcaataaatactttttttttttaaaagatggagtcttgctttgttgcccaggctggaatgcagtggtgcgatattggctcactgcaacctccgcctcctgggttcaagcaattctctgcctcagcctcccgagtagctgggattacaggcacccaccgccacacctggctaatttttgtatttttagtaaagacggggttttgccatcctggccaggctggtcttgaactcctgacctcgtgatccacccacctcggcctcccaaagtggtggatcccaaagtgatccacccaccttgacctcccaggttgtaagccactaaatcttatgtcacatgatacaggaaaaagaaaggaagtaaaatgaagatattgtcttagtacaagtgtatacaggcagaaagatgttcttaacaaaataaggaggaaatactcatgacaattacagtaacctggttgctgcaactcatcacatggtcgtagctgttattgatgactaccttcttctacaacccattctgttttccctttgcctctagcaagtacctcagcaggtcatggttctttacctggtggagtgtcccaaaccttcattcctgaagggtctgggccatttgtagtcctgcctggatcgagttgttgtcattttttattgaccttaatcacagggcttggtaatactaagagacaccctaaggaatttcctgtattccacacatgttcttccttaccttcattatggagtagtagactgagttcatcttgataggctaagtcagtcaccccagccaacactaactcctttcttagcctgttgacttagaggtaggaggagcccgagattgcaatcttaatttccagtttaatgaaatcattattgtgtctcctggtggcaacattcatcgccctggaactgagacttctaggccagcagaacgtaatgctgtggaacaagaagcacaaattttactagcgggtctctaggggtgatggtgagtggtgccacttccatttccaccccttgattcctggacccatgaatcctggctatgggagaaacagtaccaaatactggacactgatccggagcatacacagccttctggaaaactttgccccagccctgcaaagtattgtcgcctagttggcattgtaattgtgacttcaaaaggccattccaccgttctatcaatccggctgcttcaggatgatggggaacagggtaagaccagtgaattccatgagcatgagcccactgctgcacttctttagccataaagtgagtgccttgttcagaggcaatgctgtgtgtaatgccatgacagtgggtaaagcattccataagtccatggatggtagtcttggcagaagcattgcctgcaggataggcaaacccatatctagagtaagtgcccattccagtgaagacaaaccactgttctttctgtgatggaagaggttcagtataatcaacctgccaccaagtagctggctgatcaccccgaggaatggtgccatatcgcggcctcagtgtttgtctctgctgctggcaaattgggcactcagttgtggctgtagccaggtcagccttggtacgtggaagtccatgttgctgagcccgtgcgtaacctccatccctgccaccacagccactttgttcatgggcctattgggcgatgacaatggtggctggggaaagaggctgagtggtatccacagaacgagtcatccaatccacttgattattaaaatcctcctctgctgaggtcatcttttggtgagcactcacatgagatacaaatatcttcacagtttttgaccactcagagaggtccatccatccacatacctcttccccaaatttcattgtcatcagttttccaatcatgcttctttcaagtccctgaccatccagccaaaccattggctacctcccatgaatcagtatataatcacacatcttgccatttctccttctaagcaaagtgcacagccaggggcactgctcaaagttctgtgcattgggaagatttcccttcactgctgcccttcagggatgtcctagaaaggggctgtagtgctgcagctgtccacttttgggtggtgactgcatcatgcagagccatctgtaaaccaggcccttgtcttctcttcctctgtcagcttatcatagggaactccccatgaggccatcagtgcaggctgggggagagaaggcagggtggcaggagtggggaccatgggcatttgagctacttcctcatgtaaagtacttgttccctcaggacttgcttgagcctgatcatgtatataccacttccatttgatgatggaatgctgctgtgcacaacccactttatggctagatgggtcaaaaagcatctagttcatgataggcaatttaggtagcttggtgatttgatgacctgtagtcaaacatacagtttctaccaaagcacagtaacaggccaagagttgtctctcacaaggagagtagttatctgcaggagatgcagggccttgctccaaattcctagaggcctcccctgtgattgacctataggggcctgccaagggctccaaacaacatccctatctgccattgacacttcaagcaccattggatctgccaggtcatatggcccaagtggcagagcagcttgccaagcattctggacctgttgcagagccttctcttctggatcccactcaaaactggaagcctttcaggtcacttgataaatgggctggagtaacacacccaaatgaggaatgtgttgcctccaaaatccaaataggcctgctaggcattgtgcctctttcttagttgtaggaggggccaaaggcagcaacttatccttcatcttagaaggaatatcttgacagaccccacaccactggacccctagaagttttactgaggtagaagttccctaaattttagtcaattttatttcccaacctctggcacacaagtgtctcaccaataaatccagtatgtttgctacttcttgctcattggatccaatcagcataatgtcatgaatataatggaccagtgtgatatcttgtggaagagaaaaactatcaagatctctccaacaagattatgacacaaagctggagaatcgatatacccctgaggtaggacagtaaaggtatattgctggccttgccagctgaaggcaaattgcttctgctgggccttatggacaggaatggagaaaaagccatttgccaaatcaatggttgcataccaggtaccaggagatgtgttaatttgctcaagtaatgaacccatatctggtccagcagctgcaattggagtcaccgcttagttaagcttacaataatccactgtcattttacaagatccatctgtcttctgcacaggccaaacaggaaagttgaacggggatgtggtgggaatcgccacccctgcatctttgaagtccttgatggtggcactaacttcctccagggatgcaatgttgtgtttgatttactatttttctaggtagaggcagctgtaatggcttccatttggcctttcccaccataatagccctcaccctaccagtcagggagccaatgtgggggttctgccagctgctaaatatgtctatgccaattatgcattctggcactagggaaatgaccacaggatgagtctgggacccaccagccccactgtaagttggacctgagctaaaattccattaattaactgatctccaaaagcccctactttaactggaggaccacgtgatgttttgggtcccctggaatcaacgtcagctcagagccagtgtccagttgtccctgaaatgtctgattatttccctttccccagtgcacagttaccctggtaaaaggccagaggtctcctgggggaaggatgggagaaagagtcactgcataaattgtcagcaatgtagtggggtccttcctcaaggggacccagcctccccttcattcaaggggttctgggtctataaactggttcaagtctgcaaattgattgaggggccgtgattctttgtataatttttaatttaaattagtcttttgtctacttgacctggaagttttctgcttatataaattaagcaagaatgcagtaggcctcttgtcaatttcactttttaggaacactgagattaagtagccaatgccagagctctacacaagtcagactattctgattgttgccttgcctccgctgacctttacggtaattgcacccaccttgccttgatgcttgagtgccaccacttggcccatgccacctcaggatccaattattaccattgtatttaaattttgtagttgaatgactgtggttcccactataatatctagcatgcagagaagagcaatcacagagctcttcaaggatgcaggtgctgccctcacaaatctatttcacaatgtgctggtcaaaggtatatcttctgtactctcccagctgggatgagtaggactaaagtgacgaattcactccaccatcccagtctccataagcctttggatcccttcctctacattaaaccaagggagatcaggcatttccagctcactcacagtgggccaccttttgatctatatttcagctaaccaagcaaataaactattagaaccttttttaactctccaagctgcaacattaaatgcagaattcctgcttagtgggcccaaatcaatcaattcagcctgatccaactttatgttccttctaccattagcccacacccttaatatccattcccatgcctgttctccagatttctgcttatataaattagaaaactcaagcagttcttttggagtgtagcgcacctccttgtgggtcacattctgaacctcatctctaaggggcctgccgggactttagtctagttctataactataagcaaacaggggtattgagggtgggtccttaggagaatcaacatcgtctttcctggcaactgcctcaagggaggtcatcgctgatgccttaggcagtgcagggttaaactcctcagacaaaggtgaaaagcctgatggcagcgcaggtggaggaggggatgttgcctcccctctgttgcctgtttcctctggtaaaaaagattcatcagaatttagaagctcagtgcccccagccttatcagggtcctcccgcatggccccattccaagttgcagggtaccattctttttcaatcaatgctgtcactttaacagtaaacacctggcaaggctgtgcacgtacctttcgttgcaggtcagccactcacatgataagagcttgtgtctgattttccgcaatttcagctctttctctacaggagataagactcgaacccagggcaatcttagaagatttgaggctcagaatgtggttctggagctgggagatagaatccctgagttcatcatttttttgttttcatcactttgattagtgaacttaggagcaaccaactagcttcattatattccttggttctccacatatggttaaaggtattaggtataaagtcactaaactccttgcctctcatgagcagtgaatcaggagtatcagatgcatttattttgcataactctctacacagttcacagcaaggactatcagtgttctccacactattagaagtagagtccctagcattttggcgtctaatcatatttagcagccaactccagaaaccccaaaaccatctaaagaaatccatccgtaaaattctgttcctctagaaccactcctggtaccaaaatctgtattagtcaggattcgctagagggacaggactcacaggtgagatgtatatataaaaggcagtttattaaggagaattgactcacacaatcacaaggtgaagtcccacaatagtctgcaagctgaggagcaaggaagccagtccaagtcccaaaacctcaaaactagggaagccgacagtgcggccttcagtctctggctgacagcctgagggcccctggcaaaccactggtgtaggtctaagagttcaaaagctgaagaacttgtagtccaatgttcgaggccaggaagcatccagcacaggagaaagatggaagccggaagacttagccagtctagtccttccatgttcctctgcctgtttttgtcctagccatgctggcagctgattagatggtgcccacccagattgaggatgggtctctatcttccagtccactgactcaaatgttaatctcctttgacaacaccctcacagactcactcaggaacaatactttgcatccttcaattcaatcacattgacactcagtattaaccatcaccctaggctttagggatatagggaaaaacatgactcattgctgttatctgagagtacataatctattggaagaaaggaaaacagttacatgtaaggcttatatcagtataaattagataactgccaagtgagagaggtagaggtagcaagtgctgtctgtgggtgcatgttaactcagtcttaatcttggaagaagtggcagtgtggaatggtacatggagaagcagaagggacaattactgtgagcagatgaatggctcactacaggggcatgggaagaagatgcaagagcagtggaatctttaattgacgaacctggtaccaagctgccaagtcttagtctcaggactggcaccgtgcacttggccattgaaaagactttggaacctgtggagtgaagagttgtaggaattttcaaagcctcagtgtaggaacaatgtgagaatcaaccagggcatggtactccacactgtgttcagatccactggtgttaggggagtcccagagaggcctcttagagggttgaggaggatgggatcaggcatagcagagactagggacacgaggctctgcggccagactgcaggtctgctaccaactacagtgtgattttgcctagtcacataatctctgtgggcctcagttttttgttttttgtttttttctattacaacagtacctttctcgtggagttgtagtgattagatatctagtaccaagactatgcttgttagcactgagtaagaactcaatgaaggttagctttcattggtactatattactattgttagtgttggtggtggagctgaatcgcctaacctatgaggttggtgctgaaatgaagaaaagaataacagtgttttaagaagtttggtcactagaagtggagcttagtaattaaagaaaaagagtgaacacttttaccttcttgtggaagttagtaagtctacaaaatgttaattctgcatttgaatgatcatttgggagactcttattgtcctatttgcactgaaaaagtcactgaatcattattttagaactggaataacacctgagatctaggccagcactttgcaagttgtgctctatgggacttttcatggaagtggctgaggagttgccttgaaggaaggcagagggagtgggtcttgggacacccttccagttataaaacaggacgttgattctgttttgtagttgcagcatcacatataatttcatttattaagaggatcccacttctaaaaataagttgaaaaccagtgatttaatccagcctctctgtttgcatatgaggaaatggaattccggaaaggttaggtgatttgtccaaggttgcagactagactatttattaatagagtagggtcaggaacaaaagcctgctccttgctggtccagcgcctgttactagttacataatgaatgctacctattgctgcacagtgccaaatcattgcacttttcagattttactctaatcaaaagaaaaaaattaaagtgcacttccaaatcagtacttatatgcaagagcttcaagaaacaaactagtatttaacttggtggttacatattgactgtattttcattgagtgaggttagaagagattgagaagcgtgaaatgaagttacaaagtagaaactatatggtgaactcaaggcaaagattgtccatagtaaaagaagacaaaataagaatgaaagagacaaaagaattgccaatgagttgtaatcttaaaagaaagatatatttaataaaataggattgattgttttgaatgtgggctgagaagtcctgccatcttccattgactctgctcacaggccttgtttgtgaactggcttccatggatagcattactctcctgacagctgcagctccaaattcagcatgaaaaggctggcaattctaagaggaagggagggtttaggccacttttaattctactttgtcattgcaagtttcttgcattgtttggcatttgttggtcttccttactggatttcaaaactagaacactttttcctagccttggaaccaaccacgaaaataaccacctcttaccctcatgaagaacactttaagtttttctcttttaaaaatgaagtctggaatatctccaaacatcttgtcactcacgccttcatttaaatgtcaccctctcaaccacaaggaaactaaaattgccccctacttgctactccctgttttattttctagtagaacatactacagttggagatcatctcatccatgtcttttattcttgtctcttatttgcctctgcttgactgtaagctcatggaaagtaagggaccttcaccaactagcaaagtgcttaggacctagtaagaacctggtcaattctaactgagtgaatgactgaattcctgtgagaagtcaacatgaaaattcctaggtcattagtttagttattggaactccaacactgtattggaaaagtgtcatggaaaggatagttagtggattaaggttttttataagaggaagagggaaagaaaggcattgtctttacttcaggcatttcaatggccatgatggagcctaaatattgtatgttgcattttgttttggttttgtgtgcacaagagctttgccagtggaatgaacgggttaagaaatgtgagttttcttttcgtcctgctatagagacttaaggaattgccctgtgtgagttccttgagggcagagaaaaatacaaatccatgaatacctgaaagccctgatttggcccctaagcaatctatgcatgtaacaacattgcatttgtaccctgtacatttataaacattttaagaaaagtataagagaaacacaaattttggttactcctctctgaaaactgctctgatgtcgcttggccgggggaattaagacctcttcctgtggcctgtggccactatgtgctcccggctctccaggctcatccagggccactgtgcctggggtcacagggttccaggatgtcaaccttctttcagcttctctgactcctcaagcatttttttttttttttttttttttttttggtttccaagacccaaacgcatgtctctcttcttggcacactcttcccaacttttttcctggctaattgctagttatttagtttgagattaaatgtcactccctcggcctggcgcggtggctcacgcctgtaatcccagcactttcggacgccgaggcaggtggaccacgaggtcaagagatcgagaccatcctggccaacatggtgaaaccccgtctctattaaaaatacaaaaaaatttagccaggcgtggtggcatgtgcctgaagtcccagttactcgggaggctgaggcaggggaattgcttgaggaggatattgcagtgagctggatcgcacctctgcactccagcctggagacaaagtgtgacaccatctcaaaaaaaaaaaaaaaaaaaaaagtcactcactcacagagggcttctcagatactcccctgccccctcatttaagttgcaccgcttgttgtattctcttataagccccattctttttcttcttggcattgatcaaattaacagctttattttattttagcattgtgagtgtatatgtgtgtttaatgtctgcttcctgactaaactgtaccctgcaggaaggcaaaactgtgtctgtgttgctcattgttaaaccttcagcactgaactcagtgcctcgaacataggagattccaactcaatatttactgcgtgaaggaatgaatgaatctttatgtccctcgtgcctaacataaagtctgccatatacaatggactaaaaaatagtattcagctaaaactgagttacggagaagatgaagtattaattgtattttttacagagaaacaatggtcagtgtatcaaaaatagagaccctgctctcagatatataacatagaactctcttcattcatttgccttcattttagttaacagaatctgttcatctaagtagagcagagaaaaacttcataattgctgtgtctgtgttattccaaaacatttaaacaaaaggtgaataactgaggtattcttccctgtggtacatacttgatgtgggcattttaaaagattgatcaaatctcctttcagctggatatttgagtaggcacaaccattacagaattttcctctagggacttactttagctcttaaactatgtaaactgaacaagcaaactcaagtggatcattatctatagaagtatagaattccatctccctttggcaaaccattcaaacccagaagtgtgttttacacattctgacagaagcatctgtaataaccaactctaacctcctttcttaccactttagcacccaaaagtataagaaaagaggacatgttaaggcttgttctatttattagaaaatatataaagagttcttggcttaagaactcttctggctatcagctccctgatgtgaaaaaagtaaatagcaaggggtagcatggagtcttactcccgtgtgacagacagcttaagaaagacaattggacatcatgtgactacatgattcaagctaaagtccagacacatcttttccataggccaattgaacattttctctgtaatttccacaataaccatttgcaccagcatgaatggagagggtctgagttcttctgggtgagtaaagggtgtgtcagttatctgtcctctgtcaccaggatttagaggcaggctcatagtgactcttgtaaagttgaggttcgcctgtggaggctgcaaaaaagagggaggaagagagagtgaggttcctcttggctctgtgccagggatgtgattagaggaccctgggagggccttcatcctacgaggggttggaagtggaaatggatgtgtgtggatgacctggtaacgtgtcacagccccttccaccccatagtagtcagggatttaatgcctcaacaaggcaggtctctgaaggagactgacttttctctctctctctgaatgatactgcctgagagaaatactcacttcctgctttgttttcaacaagtatggacttccttacacaaaaagaatcttttttgcttttgtccccccatttcactggaaatctatccactgggcaccactgttggtcggcttcctttcatagattcctttatgtttcaaattttaaaaagacaataatagcaacaaagtgaaatatggatttaagctaggaaaagcagagaactgaaacttttttcctgcaatcatacttcccagcttcttcagcaagatctgcttggctgggaacatgccttctgagaactttacatttctaaactgctgctaaattgctccatgcatttattcctcaaactctcagggaagatagcactggctttcagtctcataccaaccattcttaaggtaatggaccaaaagtcatttccacttgaaatataatccttctaaatgaatcatgcaacatggtttttacctccattttttcagaataactctaagatgatgatcctctggccatattttaaaaatttctcttatttgttttaattttcttccattttttctttaattttgtatccagacactgccttctctaagaggaatgacatttttgcgggttatcatgatatatttttagcccatttgccttgacccatagcttacaacagttaaagaacactaacatataaacatagagttttgcccaaggccattagctttgcatgttaacaagtgggcagaaggaaggctgggcatgagagagacatgctgtccttctggtgagatcatcaatcccattcttgtaaccttcagatcattgcatttgttcagaatcgtctgcagaggaaaacatctcaaagttgggaggttgttgaagagtcagaaacaaatgggtcctgggtaatttttcaaaacaggctttttgtcaattgtcagtcagctgtttaatattgtcaattgtcactcagctgtttaatattgtgctttgttataaggataggcactgtggtctcagcgttcttaagcttttacatttccgttatttggttttacttctgcattagtagagtagatgtagagtagatgccacctctaggaactctaccagcagcagcatcttagactagaagctccctctctaggactataatctctgtagcctccacttctcccaccccttatttcttctgagcctacttggtctttgatacttactataatactttctattctcttatcataaacagttttctgatttcattttcctctggtttcatactaagccccataatcagtcactgcaagattaccttctagaatttctgtgccctcaagttttctccatatctagagagtcagtcatctgccttgagccacatccactgtctactttcttcacttccatccccaggctgcccagcactgatgaaaacaaaacaaaaacaaacaagcaaacaaaaacaaaaacaaaaaactgactaggatctcaatctggtttgcaaatccatgcttctctttcttgacttctttagacatcaacagaattgacgcctcctcttgacctgggacacccctcctccttggtgctttcttctacctccccctgcttctctgtatgtcttttgcaggctcatctttctcttaggctgtcttcccccatctctcctctccctctgtgcactcaggcagtctcccttgtcaacccccaaaactgcttctccagaccccagtgtttctctgagctccaggtccacaattctctaaggtccatgtggatgtccctcaccatttcaaacttctcttccacagggagtccctggttttcactaccatagcatattaaaataccatgcatttcccttcataccactaattacaactttgtttcttttttttaaattttatgttttaaaaattatcttctgcccacatatattgtaagctccttttgagaaagacacattgctgtcctggtcattactatattcttatcaactagcaggggccgtggtcggggcttgtgttagtccattttgtgctgctataaaggaatacctgatgccaggtaatttataaagaaaataggttttatttggctgagggttttgcaaactgtacaagaagcatggcgccagcatctacttctggtgaggcctgaagcagcttttactcatggtggaaggcaaagagagagcaggcgtttcacacagcaaaggagagagcaagagagatgccaggctccttaaacgacctgctctcccataaactgaaagagcaagaactcactcattacggtaggatggcaccaaaacagttgtgagggatccaccccgaacacctcccaccatgccccacctccaacactgggatcaaatttcaatgtgagatttggagggaacacacatctaccctttatcagtgctcaataagctcgctgaatgtagaacagtgatataaggcaggggtgggccaagtataggcgacaggacaaatttggcctgctactgcttttgtaaataaagttttatttatttacaaaataaataaataaatacagtcataatcattggttacattttgttcaaagctgcttttgcattaaaacatcagagttgagtagctgccacagagactgtaatggccccacaaagcctaaaatagttaccccgtggtcttttacagaaaaagtctgatataaaggacagtctcacagcacagaggaaaagcatataacccaaaggaggaaagagtagagcatagtggactgcagagaagtttccctggacccaatctgtgccttgaaagatgagaaggacacctccaaaggcaggatgggggtgaggtggggtgggcggtggtgatccaagcagacagcacgggcaagtgttctggaaaacttgcctttgttcacaagtatcctgcagtataaattgcaaggtgggcagtaagaaatggacttgaagagattgaacaagggccagaaacccaaggacattgctaaggagtttgtgccttagcccatccagggccctagcagccttgactgatgcttctgaggtcctggaggctccaggctcaggctaccttcccatattctctgaaaataatatcacatttgtttagtaaaaaaattgtttactaaaaaattaacctctcagaatttctgcattcacatttatttcttctcatatcctcgagttagaaaaaggtatttctctcctgtgatgatattgattctgcactcatctattttcattactgtctccttccctccctccctcagtccctcccttagtctatctcactctaccatcttttcctttggaccttctgacattcaacatcttggtcgctcctatccagccacacctctgaccattcaaccatttgtcctcttgattggttccaccttgtcctatcacgctggatatgctgttgctcccaaattgcctccctctgccagtttcttgccccttcctccttctgtctctccctctctctttcaatctttctctccctcagtctctctttctctttccctctctctcaatctttctcttcctcagtctctctcccattctctttctctttctctcaatctctctcttcctctctctcttatcctctctttctctcaatccctctctccctctttctctctctcaatctgtttctctgttaatctctctttctctctccttctttctgtctctgtctctgtctgcctctctctctctctctctcttccctagtgagctcacttgctttcccagtttcagtgatttctattcagatatctccaaaatttgtatttccggatattttatgctttcatggaggccgtgtaaattggtataacctttttggaaggcgttttggcaatacttagtaaaaggttaaatgtttacaccccttgattctgctattgtatgtgtaaggattttttcctgcatacttttgtaagtgtagaaaatatatgtataggaataattgcacattgtttgttgtagctgaaaattacaaataatataaatgcctataatcagagcagttaaatacatatgaacacagtgaaataccaggcactcatttaaaagatgaggtatattttaacaagcctatttgaaaagatacccaatcttagcaagtgaaaaaaaaactcatcaaattgatatatttagcgctgtccctctctcaagtttcagacccacattttcaattttctgttgtcatcttgacttagtctcgtgaaattttaaactaatcatttttaagggaagatattttcttcccttaaagatgaaattcagacaaacctctgaatttccctctttctgctaatttcttgctttcttttatcatctttccatccatcctaacatacagttccagaggagtctttaaatccttccttattgcctaacaccgaggatcatttgctgaaatcttgttgatttttccctcagatcaacaaaggattttcagaatagccctgatttctctttatcaccacggtgctgtctcacgtcttctctccccctcctcctacctgccgtctcttccagactcgtctctctcccccaatctcctttgcgcactgatgccaaattagtcacaacaaaagtgtttacgtgatcgtgtcacccactggtaagctcttaatggtcttcccttacacattatctcccatttcatctcaggagccttttattaaccactcttcacagtctgactcagccctctttgccagtttctctctttacaaatagcaaagtctatgagctagattactcaatattccctgaataggtcttctcttctcccacctcttggcctttccagtaccattcaatcttcctggaaattcctgaaatttctttcctcctcactcagtcaatgttttgagacccacatcaaatgctacatactatttgttcctttactgatcatgccagttggaaatgattcgaatctgtaaagcagggtgctatggaatgacatttcttatagccctttggtcatttgggagcaatgtctaacataatatcctccaggtccatccatgttgttgcaagcgacaggatttccttcttgttaaagggtgagtagcattccattgtacatatattccatattttatttttttttgctcatctgttgatggtcacccaggttgattccatatcttggctattgtgaataatgctacagtgaacttgggagtgcagatatctcttcaacatattgatttcatctcctttggatatatacccagtagtgggattattggatcaaatggtaattatatttctaattttgggcagggtcctctgtagtagctccataatggttgtagtaatttacatatccaaccaagcacgccagggttcacttttcctcatgtcctcgccgacaagcctgatattcttatttgcctcttagcgcttcagcctttccctcgtgacttaacggtgactcccttgagactacttgaaataataagtttggatggcaaggaaatacccttctgctgtcaccctttgccataagactgagttactttgtaaacaaagaagatttacttggtcttccatgcccaagacccttttacttttcatcgcttaatatttcatggccaaaaactgttggttcttccaatcttgtaaggccatttatctttgatcttgctccattcccttccatttttgcttgagaatcattcagttcttgcctgatctcacgtctttctcgcaacaccttactaatgactgccagagtgtccactacacactatcggtctcatttgaccacttccccaggcatgtagcctacctgccaagttctttcacagcagatattttgcagtgttgtaagagggctccctagcttgctatgttttcttactacctggcattaggaagtaaacatttttcatggcagtattcacttctagtaccaatttcttttttaatctacatgggctaactgctgtatcaaacagccatcaaatcccaatgttaattgcaacttacagtacgttgtgatgtttctgtctgtatactcattcagacacacagagtttaagtaatttgttcaagatcacaaagttagtaaatggtggcatcaagatttgaacccaggcagctggactcaagagtctaaacaactttcattttaaaattttcatctttcaagatatatcacttacaatttccatcttcatcactttcttccatacttcagagctgcatatgtaaacctcttgatcatataaatatttatggagtctcagcattttgagcacatgctgagagattttgtagcattgaagataaagaagctctttcaatacatctaatcttgccactattgattttgaacagcatcttaatttgttacctttttaaaaccatattgtacttttcttcaggacagctaaattaaatgtcttatgttgatcccctgggttttctcagtttccatttatcagtttccttttatataaagagatgctaatgggtaaccttacattttgtaaggcatatttttgaagatatacaagtgaaggtttgatctgtacaccctcgttagagctctttattttacatgtggaggaagagatgccttagggcttctgaaaaacaggcttttatttttatagaggagaaacttccagaacatgccatgagcaaatgctctgtcaagtctggttctttcccccattacttaagtgcaaatggaccacatttgaagaagataagtagcagaacaaggctccccacaaggggattttgaggtgctctgaaaaccagactgacataatccatggaggagttcatcactgcaggctgtcacgtctcacagtgggagtcataggctggtctgcttgataaactactcctgatctatgactggagctgtgtgcttcctttaaaaataaatcttgtttttccatgccccacgtgcttctcagcctcaggagcacctcatggatttagactaatcttgtcttttacagtcatgttacttccagattcctaggaatcaccccatttctgatgccgttgatccatccatacccactgaaattgagctaaatgctctagtctgatttgccccttgaagttagtatagaatattttggctagactttgaaaatgaagccctgaccacaatgcataatgacctcagtagacactgaagagttcctttgcatcaggcaagtgacaagtatctatctcatcttcaaagtccacatagatatgtgccagattgtaggttgacaaatcactttttcactagctcacgtggcaagccttttcaccttgtaataatgctagtgagagacccataggtaccacataattggccagtcattgagattcaagcaacatttggataatttagcaaaactatcatcagaatcatcaaagtacataatttttatttattatgcaaatagtggattcactaaagtgcttagaccaattaagttgctcccattgaaaaacagggtgattttattcttaagaatatatcaggataaacttcttgtagcctctaaacagtactgcttagaaaagtgcagcttcactgcattgcatatccccccagaagccctcaaagttcagatgtacaccacaaaaacatgaagcacatgtgtttgcatggaaggtaggctctggggtcttcctatcataatatgtctatgattaatagtcaacatatgccccctccacattccctaaaggaacatacacatgcatacacacacacacacacacacacacacacacacacgtgagaactgaattgagagtttggggtatacaccatccctgagggcacagtctacagctcctaatgtgtgctgtagagcaagcattatattgttgacaggtaataattcctggttaggaataacaggataccagtgagaagaggctgagaaaaatacactcttgctggaagagtcaagaacgagctcttcgtgggaaactatgggagacgattgaaaaaggacaagaagaaaggagaattgttaagtctccactttctcagtttctgaactgaacttttgctcacagcaggtgaacacaggctccctcccacactgagacttcctcccctgccggtgtgcagtctgttaagtaaacagagacgttatactgagaaaggaacatttctctattttggctatgagttgttatttttaaagattcatcctccaaacattttcccctatccttgtttattttttcactagaaagaagatgaactgcttaaaaaaaaaattcaactccatgacaagaaaaacccacttctagtatgttctccccactcaatgccaatggagcctttggtgtgagcactctgccagccacacattgggcagcatacctcttgaaattcctgctgtgcttctatagagcttccatgcatccagattttcaaagtcaaagcaaaatgcgcatggcagtttttttctgactccttcaagttaaaaggccaacctctcccttgacatatccatgtatttatcagtatatctataggtaatacttaaaggtgatccttactgtgtgccacactccattctaagcactttacataaaaaacctcatttcactttatttgggaataggatgacaatttcttcaatattgagatgggttgaatctggggagactgatgttagatgcaaaaagctttctttctagaacttttcctgtgtcttgcacctggctttctccctgtcttgttcccattctagatctctttactgacagtgcccatggctttcttcttggtactctagtgttgagcataagaactagtatgtaataggctctcagtaaatcttgttgaatgaattaaagtagagcaagaattaaagacagagaagaagatcttcttgttggagttctttcttttggttgataagcaatgtgatttgacgtaacaatcttgagtcctaatcccctcatttggaaaatggaaataataatgctaatcttagaggtcacttctaagaagtatatgaatatatcagaagtaatcaacatttttaagtcaaagaaaagaacgtctgtgaaaaagaaaactaatgagctagttgaaaaaatattaattggatctttttctcataccttacgccaaaataaatccccaaaaatggttgcacaacattgtgaatatactgaaatccattgaatcacactctttaaatgggcaaatgttatgttatgtgattatctttcaataaaattgttataaaaatgaataaaccccagaagatcaaaaatttaaacataaaagcatggaagtatactagaaggaaatataagataattttatatgttatgttgtatatatttatatgtaaaatttttttatttatttttctttgcttttaaaagcaagacataatgttctagaggaataaatgaaacgttcgataaatttaattctctattaaatgttttgcagaagaaaataccaggaacaacatcagaagaaaaaacaaaaaaccataagaaaaacaattaaaaatacatatgacaaatggcttattactataatatttaaagaactcttaaaaatctatgtgaaaatgacaaataacagaaaaatacgtgcaaaggacaagagcaggcagtttagagaaagcctataccaatatattctcttatcaacagtctattgtacaagctatttgaaagcaatgtttgaactatcaaaatttaaaatacataagcccttttatctagcaattctacttccaagaatttattctatagctatctgtacacatatccaaagacataaacataaggatagtcattgaatgaaatgtttttaacaacaaaatacttgaaagcaaagaaatgtcacccaagaaagaagtgattgaagaaagtttagcattcagttcagtgaagacatattgagctgtcaaaaaaagttgatggagaactccaaggtctattaactaaaaacaaaacaaggtgctaaacaatatgtttagtgttcatattttaattgtttatatatttcacaaatatatatttgtgcatgcagaaaatattttaacttctttctaaccccgtcaaacacatcatgccaaaattcaacttgtgataaagaaaaaaataaatgaattcctttcgtgtgtagtatctcatttaaattcttcaacaacccaataaaaaagatacagacacatgtttttaagtactacatgttatgcacctttggtttgcttatttaatagttgcaactactaatgttaaattcttgatgccaaggttaaaagcctgaacttctaaaaatatcaagatctgacatttttctgttttcacagattaatctgccatctcctgacctccaacacactgctctatgttctttcatgctgctcctcctcccatgtttaggaccctcttccaaggaggcattcacatctctgcttgatgaaaccctacattatcttaaagcgtccactcgaatgccacctacttatataccatctcctgcaataccaatgggctcagcccaaccatagcccatagttattgtagttgttcttgtacttcaaaagcactacaaaacacaaccatcaggacttgttacattatttgaaggctatgagcatcttcagccgaggccctgtttttattcccagaactaccacattgtttagaatatagtagcagatcaatatacgtgtattagataaatcgtttacccagatcttgatcattttcaattacccataggttgaagaactccatatttaacatggcagacttgaggactgaactacctacctcttctaagaagttgaaatgagaatgttttattgatgggaaattatttttttgttttgccttctagaattcaaatgaatgttcatattccatgaagacaatggctgatagttttttgttaaagatttagaaccagtggatttttatgaatgtgaaccctttcatgtcttgtggaagattttctgttttttaatctttttatttatttatttatttttgctatgttttcataggaaccagggaaaatgtgtagagggcatggtggagatcttcgacatgctgctggctacatcatctcggttccgcatgatgaatctgcagggagaggagtttgtgtgcctcaaatctattattttgcttaattctggtgagttgataacacaagataactcaatgctggatgaaatgtttatttgtagttttcaaccagatacgatctacccactccaaaggcataatgtcataaatagaaagaaactactgacacacgttttaaaataacctaccaacattgcagattccttataaaggtagaaccatgctagccaaatagacacatgaaaaattgtaatttggcattgaatcaaatggcctttgagctaaaatttttgtatgctttcacagataggatgtttttattcaaatggtacatgtatatagacatatgttagttgatagttatattatgtctgaaaataagtagaccaagtaattctgttaagaaattgtgaccaattccaggctccagatagtaaagaaagagggttatttgagacagaccatgtttctggtcaaaactgactagctaaaaatatagttggcttagagatagaaaaacctgtttctaaaacagaagaatgtggaatgcaataaattgtccagctgaaagaacattttccatttgctctatgaagtctgattctactgccccttcgtatttatttgtttgagaaagcttagctaagagcaacatctgttttttgtttttgtttttgtttttgttttgtttttgttttcaatgtagtgaggctggctgttgtataaagagttactctatgtcaccaagatggaaactatggttcagcctgaattagtgccctgactcctcctagcctcttggtatttggatctaagctctagctctacagcctctgggacctaaagctcacattgggtatcagcggtacagcagctccccttaagctccacctttccccctggctctaaccccactttgtgcctcatccctcattctcacatagaaatcatagctatttcgaatctctgggcctgacttagtttcttatgccattagacatagtctcaaattcctcaatagctgaattgcagcttgtattgatcacatacatagagaatccgcacttccttctctttccacgtgtttttgtctctttctgatgagtgctgatcccttcccgcttcccctaacaattttttacttttcttccccaccactgctaggaacctgtgttgcttaatggaatcagcccttccttctcttttcttgtgtttttgtctctttctgatgaatgccaatcccttcccacctcccatgacaattttccacttctcttccccaccaccactagtaacctgtgttgcctaatggttatcacagtaatcattctcacttatcaactaataaatggaaatctgtactattacactaggcaaggactgaattacagaatgaagtcccatgataaatgatgtgatccacactaaggaagtgattaccactccattcaggtttctgtttccactcacgtgcattgtgcttttcatttcagtcgtttgtcctgtacattgtagggtccagatcccacaatggctctttattggatgagagttctgggagcagtgccactcagctacatggtgccaggtcctgaacctgtgccttcttcggtggagggctggcacgtgctgacagctttcatgtgggcaatctgggaacttcagagaaggcaggcctattaagtgttaagactccccaccccgaacttttactgagaaaaagtaccccagacaggaagtaaaattagccagagttgtatgatccacacagtggatgctctgatctcagtaataaaaaatatttcctccagatccatatagacttttcctgcattattgttttgtttctgttcctatggcagagtgagtttttaaaactattatgcaagaaatatcaggatttttgccaccaaaaagttggattcatagacccagggtttttacaacccagggggaaaaaactttcagccctcacaagaaagtattttattaaagactggcacccaaacctcaagactatatttctcactgcaggatttggcccctgtctgcctccttctcagactagttaaactttcatactccatccttgttccttcgcttctttcttaggatcttctgtgcacttctttcttaggatcttcttggcacttctttgctcttgaagggcagaaacgctattgtagaaattcaaggcactgtatgctgacatagtttatagttgtctttttcatgagataacacagcggctggcagctcctcttttctatcaaggacagtactgctggctcaggagagcagtaagcaaacagaagctgtctctcaaccctgtacaaagcgaaaccactcttttccctacaaaagtgagctgtgccccagaaaagcggatctgctgctgagcagggctcctcatgtctcctattgttcctgaaaaacagcatcaaagagggcaagactgacacacaatgttgtagcattaggagcctttttcagaataaaaaagcaatcagtcatatgaagcatgtggtcataccacaatcaacaatttttctccacaactggagatatggatttttctaaaagtccaactgattcatggccctgatacggggcagctctacctctcatgagaccaatgaccaagtgactctgactccaggaatctctgacagaagccaagctggaaacggctcaggaaacctgagctagaagatgcctttctgacacctgggaaacaaaacctcagtgtatggaggaacccaaggttttgtgttgagccccagtcgccaaggtctgaggaggctgggtttatattggccccgattttgtggccgaggcacaaggggaattgaaaggttgttgtgaggacctgctcggaatgtctttctggaagtttggagagggtctctcaaatgccaaaatttccatgggaagccattttcacagctgcttgggagtgggagatattcgtcatcatttctgccccatttagaataatttattactttgcttgcaaaaacccggaatcatccataggacacacgttgtttgtttttccactccacaccaaaggacagaggcattcctggttaatccaagatgccaacttcaagacattctgagaactagctggacagagctgaagtgtagggcaaatcagaacagaagtgatgggcccagggcaaaagcccgtgaagcagcagctgcggaggaaggatgggagctggagctgcaaagggggccatggtggagactctgggcctgcccacagtatcccctctgcccaatgggaattcagttttcctgcatatcattcaattatttctcatttttctaggcctagctcaccttattcgggaagttttgcgactaccccagtccataatgaatttcctctctagactatttcaattcttacagtcactaccacacagtctaggatttggttagttggttgatttcattcatttattcaataattcaatgtttattgagttcctactatggactttgtgccaggtatacaaaactgaatgttactgttgtgtggggtttttttctttgcatttttaaagttaacctggatttttctctcactctttatgcatgtatttcctaatctccctataaactatttgtatttttttggattcctcacagtctatttagcctgtggactgtcaacagatgttacatcattcagtcatttaatagatgcttatttgctagacatggccaggaggacctggaaagtcctcatttttcccatctgttcttaccattctgaaatgtatcatgctcttcagtgctccacagatctagatgatatcaaattattaaatggaaaaagcaagacccatctccttgggttattgtggataagggggaaattgtgtaggaagtgtctattgcagttcatggaccattgtaggcccttagtcaacaacagctatcatcatcactgatgagaatctctggcttaaacggagtaggttcatgccttttttcagtgtaatgaagtgttttagtttaaaggcctttagcaaggcttacaataaaaaaaagtggggactccagggtaacaccaacaatagagacgaccatggctgttatcctgagactattaattatgccacgtaattagatttagagaaaacttagagcaacatttatcttgtggataataattgattgtgattgggacttaccgttgagagaccctgatgaaaactctatggtgaattgctgtggagtcacatgggttcatgcatcattcatcagtgggccctggttttagcctcataacccctgagaatccacctctatcagaaaaccaccctttcagtgaaagttcctcaaggctcagaaaaattcatatgtcaaagctttatatgtaaaaacctatactctctaataaatgtttggtttggccttcacattcaatttaataattatttctacctcttttctaaaccgctcttaaccacagttctatatatttaattctgaagagcctcatgcacctccctccctggtaactttatctacttctctccctggagaaccagccagaccatgattccagccctctgtcctctcttcaaccgtaggtcctctttttctctcctgactcctcaaaccttctccagttacccggatgccttctgtgtgctgctggcttctgcatcactgttcacagggccacttgttcccctggaaatgtcttatgctcttgaaatgctatagccttgttcacctgttcatccaaaactgatcctcagacaacatttctctttcaattggtggaataataaagaggaatatgggtcaaaattcatagacatttaaatacccaaggtgcaaagttaagagaaaacaagataggagaaagaattatggcaacatctctaaaatgtgtactttagtgtttagcaaaaaagggactatggaatgtcaaacaggaacatatatgttaaacataaacatgaagcagtgccagctgctgtctgccatatagtcatgctttgttaatgtggcacatcttgccatgatggtgccctcatgaaacgaaggatgctgaagcagatgccattctgtttgctttgatcagaagccactctctggtcaaggaagtatttgtttcatgcttaattataacaagttctcatcacaaagattattttctttctccagatctggattgtttgcactcactttatattattagacaattactcagattgtttatgtttttatgtttagaaataagacagtgattcagagagtccctgtatttagatgaaagaacattttttaaacatattgactgtaaacactgaaaatcattaattctcaacagttgaaggtttctgacaggaacggcccttggaaattgtaaatgggcacattgtcaggtatgcccattgttgtcacattggagaagattggattctgttctctctggagtcctttgtaatgccaagcttcctctccagggagctggcttattgtcattattttgagataaatggcacttcatagtattaagtggttcattgtctcttctctggctgactgtattctgtaggcagccactcaactttggagcctttctctgctaccaacttttggtgttgccttaagcaagcctcatggctcctgttagtttcctgacaacatggtatagcatggactttgtcatcagagaggactgaattcaggagaagcaactctgccacttccttggcggaagggggatgactgatgtcctttgataagctgcttccctgagcctaataaaaaaatagaaataatgatacttaaactcatggaattgttgtgacaattgaaagaatgaccagttagtaaagcatcttgcaccatgactagcacacagtagatgcacatgagtgttactaagctttagttatgccctccaaatacaaagccttagttttgtcactatgaaagaaattactctgttcttcttagcaggtaataaataaatccctgcctggaaattctgcaggagaatttcacccctgcgctttcaggttaaaagattgcattcccatgatgaagatgttctgtgaatagaatcatctcaagtcccaaatggtgtggatttgctcctgcatcttgttgcagagattctcttggagcttctgagaactggggaaaccaacaaaatgcctgtagcctggggaaaatgtagggagttttagcatgaatttgtgggaggtgagaaaaggcagcaggtgtcgaaagacgggaaatccttgcactgttctagatgttaggagccattttccattcacattcagcacctcaggaggagaagctgcctatcactttgtgtcctcaagagaaccaacaaaggagaatgccatctcccagatactcaatttgattaccattttatcctaccttctctagggtccagacattatgtaaattggcattaagtttgaataatgtatggacccagtttaaaaggaaaaaatgctttgggaggctgaggcaggtgcattgcctgaggtcaggagttccagaacagcctggccaacacagtgaaaccccatctctactaaaaatacaaaaagttagctgggcacggtggcgggcacctgtaatcccagctactcaggaggctaatgcaggagaatcacttgaacctgggaggcagaggttgcagtgagccaagatcgtgccattgcactccagcctgggtgatgagagcaaaactccatctcaaaaaatttttaaaacaaaaggaaaaaatgctcccctgattcccgcagtgctgacttaaaatgttcttagtatgccaatgttgcttaaatatgaatgactgtagcttctacttaaattggcaaccgcaccaaatataaactgcaaatgtttatagctcttatggaagtataaaagcaaaacaaattcttaaattaaatacaaactaagagggaaactgataataacaatgttttgtgtaattaagttgctgtttgcaacatgcctggggcagactcctggcctctttgcatctgacatgagaggctaccaaggatgtggccacaactgggctctcccagcacttgcttgcgctcagaactgtgccaaaacctttgctcgcccagtgttctgcaacgtccatcatttggatttggcaggaacacatcatttatgcattttgtttgcttctgtatttagttgagatacttaaaatataactgctagattctaaggcattcataagcatctgtgaaaaatgtgttacttaggaaacagttcagggttccatggattatctagattggtgagtcttaagactgaccacacaattcatctgggggtgtggaggaggggagctttgagaaaaatctctgtatgagcacccacacccagagattcctatgcaattatcccagagtggtgccttaatatcaacatttgtttaaaaccatcccccaagactaaaatttgtgaccgggatttagaaccattgacttaattgatgcagaacactctgatattaatgtcttcatgtcttttggaatgtcattaagacaaaagcataaaattttaaaattcttaaagacaatttaaagacctatgagaatccatctttaattctcaggagcgtgtggaacctagtttgaaaactactggcatcgacaattgaatttccactaaaataaaatagctctctagtatattacaaaactacccattctgcaaactgcaggggagctactgataatgcttggaactgtgccaggcactgcctgcataaaaatgagtaaggtccacttcctccatggactgggttgggtaggaggcaaagataattaaccaattattttaatattatgagttcagggttgtaatgaaagtaagtattgagtgctgcagagacccagcaaaggagtccttagctgagaactgatcctttgctgagtgacgaggacattattgaaccgccaggcttgatggcatgttgcatggtaacagaccagtacaccaaacagcaggagctgtagcagagaaagagtttaataattgtgtggcagccaaataaggagacagaaggaaaccttaaatccacctcttgaaaaagtctgggactaggctttttaagagaattctggcaagaaggaggctgaggagctgggggtaactgattggttaggacataggagaggagacaataaggatatagaaactccattcttgcactgggtcagttcctcggagggggtcctcactctggctggcagcagtgaacccattggaatgcaggatctgaaaaatatctcaaaatggcaaacttgaggggttttttttagcatcaaagatgttatctatagaagttaggacattgtgacaggggctacgtgactttgaagtgttaagtggctgtcagaaagtgagctattgcagcggtccccaacctttttggtaccagggaccagcttcatgaaagaaaatttttccacagatggggtggtgtagggtggggtgggggatagcttcgggatgaaactgatccacctcagatcatcaggcattagttagattctcatgaggggcacacagcccagatccctcacatgggcagttcacagtagggttcacagccctatgaggttctaatgccactgctgatctgacaggtggcagagctcaggcagtaatgcttccttgcccaccactcacctcttgctgtgtggctcagttcctgacagattacggactggtaccagtttgcaacccaggcagctggggacctctgggctgtagggtaggctggttaatgcttagctgtgtttctattcaaagcttatgcttttgtttaaaacctagtaatttggttttgttaattttatgaagatgatttcaaggatgagtaggattagctggagtcagaaggacacaagggaatttctggcaacaacattaaactaccagtgaatgtctcatcaagtcactggacctctaattctaagcagtactgtcaaccttataggttatgatgtataagatagtgttgtgatgtataagatagtgcaaaaacctaagttaatatcaccatttctgtagtactctctatttcaaaggaaaaaatcttcagcagtctaatatcctaccaaaattttgaagtcaagacctccctacactaatcaaagaactagaggtgcaatcaggccatatatttggaaaggccataggtgccctccctctgtccttgttcccagcatactaaactatagtctaaaagactttaaaacttgaactgaagaaaaccttaaggaaacaacaacaaaattccatttatttcctgagcccaaaagtagaataattgttttttaatgaatttttctttccctgtaagacatactatgaattgttcaatgggtattcaaagcatatgtaatagaatatgtatgctttcctgaaaaattgaaatggaacatcaaactgttctgtaaagttttgagtctagaccaaactcacagcacttagccagaatatgtacatctgcatctgccactcatggccccatcgctccctccaactgcttctcttgggctgaaggatggaaaagcaaactccctgcgttgagttccatcttgccctgcatggcctcccccatggggtcattgagctccccaccagcttccacctcttccagcactttccgccagagggcccgtggctgcttttgcagactgaaattgattgtggttgattcagctccatttcctctgagtttttactttagatgtgctttttaggttgcatttttcttctggcatataagaaagacagcaatattccatggaacagagtgatgtctgtggctttgtcaaccgttgtttgttagcttgatcaccatttattgagtgtttactactttccaggcattgtgctaagtggtagaaatacaaagttgcctttacttgattcatctgtaaaatagagagagtagtagttcctacagtgtggtttatgtgaggcatagggactgctccctgaaacctagggacaactccctagcagcgacccagtgctcatatcaatagtggtaacaattaggaaggcagctcctacctcaaagacctcatgatctgatggtaaagacagatataacaagaaaattattctttttaaatataaaattgtgatataaaaatagttttcactaaattggatttttatgaaatttacagaaacaaaataataaattaaggaaatataaaaccacctgacattagccaaccatgttgatgttctgattatgttactgcaaaggagtgtagggttaagaacgagggactttgattccaagatcaaatccctttctgctatttcttagctgtctgactttgggcaagttgcttaaaccctttgtgcttctgtgtgcttgcccatgagatggagattataatagcgtctacctcatagggctatttttaatacaagttagctcttagaacaatacctacttaaactaacaatttgtattaggtactgttttattctccatccgtactgtgtatgcatatattcatatttatatttacatattctaattaggattatatacatgtactttctttaaaaataagattttaaataactatataatcagtcatgatgatacaacatgatttattcaacaaatctgatgctgttaaacacgtaagtgatttctctttcaggattataaataacatttgttttgcatttttttcatacatcttttgctcacttttcattgttactttgtatatgttgctagaaattgatttgctggtgaaaagggtataaacatttttaaggctcttgctacatattgcctgctcttcatacatattgcctactgccccaggaaactatcaattacacttttaccaagagtgtatgaaagcattcacatgaatgtaaccttatcatgcaatgcgggccatgagacagaggagagttatggagggtagacggcttccccgctgctcagccactgccctctcctctaaaagagccacagtcaggaatttctacatagatcctattataaacatctccttttgaaacaaattatcttctctcagagcattttcttcattttagtatctatataggtccttgttatgttcattttaagttttgtgacctgcactgacacaatgctgatgaactgcttattccaggcagtctgagttctcaaagcatttgcattttatgtcttatcctctgttttgggctctttgccactgatttttttttaagtgatattttaagaaagaggagggttgatttgttgtgagtgtatctctctttaaaaacttttctagggaaggacaacctcttccaaagactttgtttgctttgtgtgattggcatgtccttccctggtcagtaatgagcttgaaggaagctactggacacgggactgaacatggggttttgctatcactctagctgtgcctttctctagtgatcaaggagatgttggttcagaaagtgccctgtctaatcccactaaggcccgaaggaccaagtgctgtctactctccagattctctgcaacagaaagcagatgcttaggcttcatggtccaggttggaacaggtagttagctctgaggacagttatgcatgaatgtcaggaggggactggcaggggaacatttatttattctttaaaattggaatcaacagttatggatgaaacccagaatgcaaaattcactttcatcttgacacgcaacacatctgtcctttctccttgaatagcaagtattaatcattgagttagacaatgtaaccttcacattcagtgaaagccaaacactcagcaccttctagaaaaatcttagtgccatgctttcttagcatattgcaagtcctctgaggatgatgtgttgttcagctttgaagctgatcttttgtacttgcttatgtagctcaggctagtgataacatgccagaggcatttccaactaagaaaattattcacagaagctttaattacaaatttgttagccccacttcctgctaaaatggccagccttgaagagtttcggaaatgtgagcagccttaaggatgatagaaatattatgaaatagtaataagtaatacccatacagcaaactcctttttctttggagtatccgttcatcagccagatttccctctcaacagtccaggtgttgacgaagatcatgaaataataggaatgaaagggacttcgattttgtatttttaatagcattttcctccaccaaattacgaaagtaatgcatgaccaaggcagagaacttggaaaatacagaaaagccaccaagcaaaataatctcccaagaaatcataatttcaccacacaaaagtaaccattgtcaacattttggtgaaaatccttaattaaagagactcttaaaagatgccagttcgctgccacttcttcctttctccacaccatcctgcaccctgttttgaaatgcagaattgtttctaaatcattccaggaaaattattagttttctcaaatatctctggaggcgagtctgttggcagtcatttctagtttctcacaaaccttgaagttaggaaattatttgtgtagcttttgagcactgggccagaagtgagggatgtttgggttctagttccagctctaccacttatttaccaactggccgacctcaggcaagtccaggctagcggccccgcctcaagcccctccagatgcagcatctgcaaccccacttccttcacttcctttcgcctcagtttcccaacaatttcctagtaattgtactgaatcattgtttttcattttttacattaaaatttatttattttattttatttttaaagactttattttttagaacagatttagatttgcagcaaaactgagtggcaagtacagaaagttcccatatattccctgcccccgcacatacacagtctccctcactatcagcatccccaaccagagaggtacattggttacagctgatgaatctacatcgacacgtcattatcacccaaagtgcatagtttgcattggcgttgggcattttagggcttttgacacatgtatgcactattgtaatatacagaataatttcactgccctaaaaatcctctgtgctcctcctattcattcctccctccaccccattcctggcaactactgatctttttactgtctccacagttttgccttctccagaatgtcatatacttggaatcataaggtttgtagccttttcagattggcttctttcactcagtgatatgcatttaaggttcttccatgtctttttatggcttgatagctcatttctttttatcattgaatactactactccattgtctggattatacacactttatttatacattcacctactgaaggatgtgttggttgcatccaagttttggcaattatgaatgaagttgctgtaaacacccatgtgcaggtaattgtgttgatatgcatttttaatgcttttggataaacactcaggagcacaattgctggattgtatagtatgtttagttttgaaggaaactgccaaaccatcttcccaagtggctgtaccattttccatttccaccaacaatgagtgagagttcctgttgctccacatcctcatcagcatttggtgttgtcaatgttctggattttggccattctaacaggtgtattgtggtatctcattttgttttaattcgcattttttggataatatcacatggagcatcttttaataagcttatttgccatctgtgtgtcttctgtggtgaggtgtctgttaaactctttggtccatttttttaatcaggttgtttgcgttcttatcgttgagttttaaaagctctttgtatattttggataacagtcatttagcaggtatgtcttttgcaaatattttctcccagtctgtggcttgtcttctcattctctggagatcagtggtttttacactttcttctgctgaagccaagtattgtggaagaagccatggggtcaccagaggataggtgcacagggtagtgagggaaagttggagtgaatgggcttggtgcccccaccccgcaacatttctcttgctttaatcagagaagtttgacttcatccagattgcatatgaggactttacatgaggttcacctttttatttgttttaaaaggggtttttactctcaaaatgttttaaagaccactgaactagatgatcatcttaaggcccttttaagatttatgattctggaattctgtggctctatttttccaatgtaatataaccttcctctcgttaaggaaaaatgagataaacctgttataaacactcatgtgacattttttcaatacagttttcatccacgtagtgctcacttagaatgatagaaacaatacacctaaagaatatgcaccattcacttgcccactcatctctcaaagagaggaactttcaacactagttatctttttaaaaataatcagagagaattctcagccacttcaattctagcccaggaaaaagagggaaaatacatttgaaggtttctggctcatgtgatacatttgcaaaccagaaccaagatgatatgactctcatttattagtgactattgcaaagctttgcaggctattaagcaggctgttcaatttagggtgatatggacatgtgcatattggccaattatatatgctcagatcgtatgtcattttttttctgcattttagtctaagtgtcagataggtgtttcatgatgttttataaacacttctgttcacattaacattgttcattgatttggcaaggaatgaaggggtgtcattttcatgattttatttgtatattatgtattccacagaggatttgaaatgccttaccaaattttatgtaatgtaaaggggtaaaccaatatttgacacatcattataaattgaggataatctgaagaaaataataaatccaggagacagattatcacactgatatggtttggctctgtgtccccacccaaatttcatcttgaattttactcacataatttccatgtgttgtgggagggacccagtgggagatcatttgaatcataggagtggtttcctccatgctgttctcattgtagtgaataagtctcatgagatctgatggttttatcaggggtttccacttttatatcttcctcattttttctcttgccaccaccatgtaagaagtgcctttcgcctcccaccatgattctgaattctgaaccctccccagccatgtggaactgtaaatccaattaaacctctttttcttcccagtcttgggtatgtctttatcagcagcacgaaaatggactaatacagtaaattggtacaaggagtggggtgttgctgaaaagatagccgaaaatgtggaagcaatcttggaactggatatcagggagaggttggagcagtttggagggctcaaaaaagacaggaaaatgtgggaaagtttgaaacttcctagagacttgttgaatggccttgacaagaatactgatagtgatatgaacaataaagtccaggctgaggtggtctcagatggggatgaagaaactgttgggaagtggagcaaaggtgactcttgttatatcttagcaaagagactggtggcattttacccctgctgtagagatttgtggaatttgaacttgagagaaatgatttggggtacctggtaaaagaaatttctaagcagcaaaacattcaaaaggtgacttgggtgttgttaaaaccattctgttttaaaagagaaacagcataaaagttcagaaaatttgcagcctgatgatgcagtaggaaagaaaaacccatttttttgaggagaaattcaagctggctgcagaaatttgcataagtaacaaggagccaaatgttaatccccaagacaatggggaaaatgtctccagagcatgtcataggtcttcatggcagcccctcccatcacagacccggaagcctaggaggaaaaaaacagttttgtgggccagtcccagggtccccatgctgtgtgcagcctaggaacttggtgccctgcatctcagctgctccagctattgctaaaaggggctgaggtaccacggtttcagaggttgcaagccccaaaccttggcagctttcatgtggtgttgagcctgtgtgtacacagaagttaagaattgaggtttgggaacctccacttatatttcagaagatacgtggaaatgcctggatacccaggcaaacatttgctgcagaggtggggccctcatggagggcctctgctagggcaatgaggaagggaaatgtggggttggaacccccacacagagtccccactggggcactgcctagtggagctgtaagaggaggaccactgtcctccagaccgcagaatagtagatccactgacagcttgcaccatgtgcctggaaaagccacagacactcaacgccagcctgtgaaagcagtcagggttggaggtggtggtggctataccctataaagccacaggggcagagctgcccaagactatgggaacctacctcttgcatcagcatgacctggatgtgagacattcagtcaaaggagatattttgaagctttagaatttgactgccctggtggattttagacttgtgtgggccctgtaacccctttgttttggccaatttctcccatttggagctgctgtatttacccaatgcctaaacccgcattgtatctaagaagtaactagcttgattttgattttacaggctcataggcaaaagggacttgccttgtctcagatgagactttggactgtggacttttggttaattctgaaatgagttaagactttgggggactgttgggaaggcatgattgcttttgaaatgtgaggacatgagatttggagaggccaggggtggaatgttatggtttggctctgtgtccccacccaaatctcatcttgaattatactcccataattccaaagtgttgtgagagggacctggtgggaaacaatttgaatcatgaggccagtttcccctatactgttcttgtggtagtgagtaagtctcacgagatctcatggttttatcagggtttccgcttttgcatcttcctcattttctcttgctgctgccatgtaagaagtgcctttcacaagcataaggaagaagtatacttgctggagcagcaggctgtccttcttctgacgatatggactgcaagtgcctatgtttactttgaccaagacggcctttcttttcacagaaagccagggttcaccccttgaatttcataagacctctctttgcagtgggttagatactcttttatatttttatactctgtcaggaaaacatttttttttccatttaaaaatcagtcttttggttgcttccaagatggctgaataggaacagctctggtctgtagctcccagcgagatcgaagcagaaggcaggtgatttctgcatttccaactgaggcacctggttcatctcactgggactggttggacagtgggtgcagcccacggagggtgagccgaactggggcagggtgtcacctcacccacaaagtgcaaggggtcaagggatttccctttcctagccaagggaagctgtgacagactgtagctggagaaacagtacactcctgacaaaatactgcacttttccccacagtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaaggatatgaacacctttacactgttggtgggagtgtaaattagttcaaccattgtggaagacagtgtggtgattcctcaaggatctagaactagaaataccatttgacccagtgatctcattagtgggtatatacccaaaggattataaatcatgctactataaagacacatgcacacatatgtttattgcagcactattcacaataccaaagacttggaaccaacccaaatgtccatcaacgatagactggataaagaaaatgtggcacatatacaccatggaatactatgcagccataaaaaaggatgagttcctgtcctttgcagggacgtggatgaagctggaaaccatcattctaagcaaactatcatgaggacataaaaccaaacactgcatattctcactcataggtgggagttgaacaatgagaacacatggacacagcacaaggaacatcacacaccggggcctgtcaggggttggggggctgggggagggatagcattaggagaaatacctaatgtaaatgatgagttgatgggtgcagcaaaccaacatggcacatgtatacctatgtaacaaacctgcacgttgtgcacctgtaccctagaacttaaagtataataaaaaaaaaagaaagaaaagaaaagaaaaaaagaagtggcttttacctcccaccacgattctaaggcctctcagccatgtggaactgtaagtccagttaaacctctttttcttcccagtctcgagtatgtctttatcagcagcgtgaaaatgaactcatacacacacacagaagtatatctttacagttcccaggatggactgcaagtttggctctaaatttcctttgcctggccaaaacaaaaagaacacattttattataaggttcacaggcttttaattgaaaaaaaaaaaaaaacagttattcaacatgaaaactctttttcagacaaagttctacaaagtctatttctcacaagtaggactttggcaaggattgtgcaactgacaattcaaagtcatttattccgtggtgagaaaccggagtacagatctttaccagttaggggatgatccatgtgttttgataatcaccttggtggtgatcagactaaaggtctcctatgaaaaccattaacttcacactatagctgataggatgcactgaagcccttaccgctgactgcatggatgagagctaggccagagcattggcaggcagagtttataacatggggcaggaagcattgaaattctattccacctcttggtgtatcaggtcaggagtcaaatctcctatcttcctcttctggatcgctttcctcctgaagtgtctggcatagatgtctaggtatagcttggcatggtggtgtgtgcctatagacccagctacttgagaggctgaggtgggaggattgcttgagcgcaggagtttgaggctgcagtgagccatgaccacaccactgtactccaccctgggtgacagagcaagaccctgtctctctttctaaaaaaacaaaacaaaacaaaacaaaacaaaaagaaaaaaagatgtccaagtgtgttctggttactgctgctgactgctaaatttaacagctagaaaaaaaaagtttggactctatggatcataaatttggataagacacagagggaatggcttgtctcatgttcacaatgtctaaagtcttaaatggggagagtcgtcaaccaggggtaatttgagagttatgggctggaaccaccttgaggcatctttattcataggctagcaattgatgttggctgttggctgggacgtcagctggagctgtcaactgggagacctgtctgatatcccagcataggacactagacctctcacaaagtggcgagggctccagaagcaagtgtcccagctgacaaaaaaaaaaagtttcatagccttctacgacatgcacttagaagtggtaatgtgtcacttccagccctttctgttgattacaagtgagtcatgagtccactcagtttcaagggagagggcccagatcccatatctccatgggaagagtgccaagaacaccttgtagaaaagcttgtggataggagatattggtgtggtcatccttggaaaacacaatcttccacagtgtgcaagagaggcttcctgctctgcattgtggcttaattattgttgaaataccaggcaagaaaaggtaggatccagggaaacaaatgtatccaggatgttttggtctgccttttctaggaaaaaaggaaaccctcaaagcctctgagactaggtcaccccagtgggactagaagttccacgtggaaccttctgcaaactcctctgcaatagatggactgtgcattttccaaatgtgtctttacatcatctcctttctgaccttgggaagatagtaactgactgtggagtaggaaatccagaaccctgattgttttaaaatatattacagatacaagtaatgaaaagaaggctcctaaggaaaatatagatccgtaatggctttgtcccaaaagctattaggctataatattttattacaaaggctatatttattacaaaatgtatttaaataaatacttaatatttatttaaataaataatatttattttattattaataattaatatttaaataaatataatatttcttacaaaaattaaaaactgggactttatatttaaaggtgagacattaaattctttttaaaaagtgcacatgtaagatttttttctcaagtcaactgaaccagttcatcagtttcactatgaatgtgttgatgcaccaagtatttactttctagaacatctagtagacgtcactaaaaaattataccaagttgaaaaatgtcactgaatcagaggcatgtggttggttatgtagtcatctgtgccagctgggaatatagcaataccaaatgaacagcactgccatgttcccttgctgggttccagcaaaaacactcatcttcactgtcgtctctctttgagacctcttagagaggactttgatgagtgtatggtcttatacacactagtctaacaatacacatttgctcaaggattgggttacgagcaggctcttcacctttcaggtgaacaattacacatcaggagaaggatggaagtttcctatctatgaacaaatatttcccaaagcaataatctctttattcaactcacgtaatgagaagtcagttcctctgtgccataaagcaatctctttgaagtcttcagtaatgttgagggttttaatgttgagggctttatcaaactaaacattcaagtgtcttaggctttccccttagttctttgagcaaattggttgctatgaagtatgttagtgttccgaatgaatggatagcatgatgggggatgtctaggtggttccagaatttagattgtggtttccataacaaagtgtggcagtattggcattagggaagagaaatgacttctaaataacttctcaaagtttactaaagccttaagaatgtaggaaatggccacaaaaggaggtatacaaaacattcctctgtctttattcctctttatacaaacgtattcactttcccatcagcaagtcataaaatacttctcatcttgcattacagtaggacacctactataacaataggctacaaaatgtataatggctcaaacacctagcagtttatttcttatttacttaacaatgctgggtccacgaacatgttgatatcataaccctcttttatgtggtcactcagggactcaggctgttgagggctctgtcatcatgaatgggtggcttccaaggtcatcctaagagttatctccattctaaccagtccagccagaaaggcagaacaggcttggaggagcaaagatatccatggatagatcatcctcttaaagtcattgtagcattgtgatagggctcttttcacaaaacaaggatacaatccatgttttcaagattttacattttagtagccacaatacaaagaagctaagatagtcttgtgatttgtcatcatggctgttaatggagagtgttttaaaagcactgatatcagggctccaccctcagcttccaatcatcaggtttggatggaacctgacagctgcatcttgtaaaactccacgggagattctgagagacagccaagtttgagattcacaaaccttaagagaaaaaatctccttgaattgccataacaaactaccagtctaataaaacatacatattcctttgactactcttaaatgaaacaaataggtaataatttacctgtacatataattaaaaatgtaatgtattttataaccatcatataaaggagaaattatattaaactatattaaaataaaatgatatatatttcaatgcagatgcccaagcttgactaaagtaggaaacataataaagtaataaaatgcttatatgtacttataatgaatgtttggctatgagaagatgatcagaggctttttgtccaagaagtacaggcatatgaaaaagtagagcaagagatggacaccagactgagaaaactaaaaactaaccaacctatttgtgtatgataaaaggagagaaaaaaaattgattagtaaaaatatgctaccgtgtggtctgaatgtttgtcccttccaaaactcatgttgaaatttaatcccccatgtggcagtattgagaagtgggacctttaagaggtgattggttcaagaagattctgcgctcatgagtggttgaaaccattcacggaataacgggttaatggatcaatgagttatcccaggagtgggactggtagctttataagagaaggaagagagacctgcgctagcacactcagcctccttgccatgtgagccatctcgggaccccgcagagtccccagcagaaagaaggccctcacccaatgtgtccccttgacctaggatttctcaacctccataactgtaggaaatgaattccttttctttgtaaattatccagtttcaggtattctgttataaacaacagaaaatgggctaaaacacacgccaagaaaattgaaagactgtggaagtgaaagaagaataaaaaatgaagtaattttgcaaatgagtctggctttattataagtgtattgtcaaagtgattccctttgttataagatgaaaaagagccaaaatggatagaaacatttatcctatcttaatatcccactacattcaaggcaaatattcagtcagtctctagaacttaacaaggccttggagatgatatcctttggatgagcaatggagaagacaagatggattggaaaaagaaacaaacaaacaaaaaaacatgtaagaggctatcaggaaaactctggagacgatgtcaatgtaaaacagatacaaacctcaaaataattttaatatgtacattgcacaaaaatggacttcttatcatgttacaaatttattttaaaacatataggaggcaacaacaatatttcattgatgtgtactattttataattgttggctctaattttatttagtagagtcttacatctcctctctacatatttacatccggttgtattgtttttgtagtacctgttcaactgcactgaaatcatttcaattaaatgcatggttgaaaagctgacataatacattcaattgccaaattgcataaagtgaataagctatttaataatttggagaaaatatattccatttaaacttccttctctataaccagttcatacactggaccttttgggcacagccatgtgaaagcttttcaaaacttttcactacttttttttgagacggagtctcactctgtcacccaggctagagtgcagtggtgcgatctcggctcactgcaacctccacctcccaggtccaagtgattctcctgcctcagcctcccgagtagctgggattacaggcacctgacaccacacctgactaatttttgtaattttagtagagacaggatttcaccatgttggccaggatggtcttgaactcctcatctcaagtgttccgcctgccttggcctcccaaagtggtgggttacaggcatgagtcattgcacccagccactatagatttttatttgtagtagatttagttcagtagggcatttgagaggcataggaactggaacaaatccttcattgtttgggactgccttgcacattgtaggacatccagtacagtcccttccacgaagtggcagcagcagcctcgggctgtccaaacaccctgttagggacagtgccactcccggaaccacagaagaaccacaatcataggagaagcatacaacaaacatggtgttcatcggacggtcagcttcagtggcacttttgagcaagcacactatttggttgtagaatgagtccctggcagggcacccgaaaggctgatgtgtgactcatccctagtacctctgagaatgctgaaatctcctccttctccaagctgagtggcagctttctggtccagactacttaaattgtgacttgaggaattttcttcactttttcctttgagtcattctgtttttgatcaagatgcgatagaatgaaggattctttcagggtctgctgtcacatccttcctttgggaacagatagaaaatctggcctggcttgaagagtttgtcctcaaacatctggtaagccataggcatcagcatctcttacttctccagagacatttagatgtgtcccccatctccatggaggcccatggcaaggggacccctagttgtactagagcttccttctgggcacagccacactgcacaggcactgcagtgtacagcacagctcctccagcttccggaagactccattatctagaaaagtgctgagaaatggagaagggggttcctctggggtggagatggaaagaggaaaaggaagggagaatgtccaagcaaaatgagagaaggtgagggacagcagaattgagagtgagggagagggagagagcaagagactgggttgagatgtcttgtacatgggggtgtcctcgtggcttcactcccctttcgtttgtaccactccgtttccccagactcttcctaaatatccccttattggctacaagatccagattgcctagaagctcagatttgctgacagcacctcaagactggttaatgacatatagattttttcttgtttccatctttgggatttggagcaatctccagagttgcaaaagcctaccttgttgcaataatatttttgagggtccacactgtctgctcacttgctctatgctgctgggcacagtggtgtggccatccagggtgggagagaccacctgggatatggaaattaccagcagccctgttttgctcttgcagtggttgccaaagcacacgaagcattctgggaatctgaatttctgttgtttctcccaaatggcccctgaagggcaacaggcagcacacatggaccacattttgccagaaaagtccagaaagaagatggctgctgttgtcaactattggcatttcaacaggacctatttttatttctcagtatatttgcacaactaggaagcatctgctgacaaggatgagatgataagctgtattgatgccaaaacaggactagaaaaacaggcttgttctgcaaatggcctgcatcctgagagtccgtgttaagaacattctctctctgcaggcaatatctgctcttaaaacattaacacttgaaaggaagtaaggcttggaatccttagcatagttatgcacacactaggttctcagtaagtgcatgctggatgaaggaacccacacgcaccttaaggaggatggaacattggcagcccaagaaaaaagtcactccccagaggccgagtgccatgtctttgacctccattggcaaggtcatggtgaaatgctgtctcttggggtcgctgaggtcccagcacggtgtgccttcacaccgtgcaaacaataagaagagaagagaggcacacatgtcacctttccaggcagggacatccaagctgtttgagtctccattctgtgatttccttgaacaagaaagggattattggtgaatgaggccagcatcctgggtgggaacaaaaaaggaaattggtagaaagtacatcatccaagttggtctaactcagccctgtggcttgggcgggttcctaggatatccagccggaggcagaggctctaggggatgtgaggctgcactgggtatgatgacacagaggactgtgagaggcagagaaaaggggagaagagctgaggccctcctagccctaacctcccagctcacaccctctgctatctgccacctccaggccaacaccacggccatgggaggtttgcccatttttctgatagacacattctttctctaccaacagcccacatggaacataagtgaagtaattcagcagtttccttcttaatctgctgtctctctgctgcttactcattctgtgctgtttgctttagatcaaggtgccccagggtaccaaaagctacattatcctattcaactgcatggaaaccaagatcccgaccattctggtttgttgttattgttacgttagttttaaaccttagccattttccattctgggcagttacaactctgtttactatgagttcctctgtgtagatgtttctcccatacccgacctacaaactgctacgtgagcagtaacttgtcaccatgttatccgcataaagtcagggattgataaacttgggagcctttagctcttgaaggtgctgatgaggaaggggagaggggaggagaaggaatttgtttgtgagatggtcagtgggctgaatagtggtatgaccaaaaagtgttactataaatacacataatctggaaaacaaaaatactgtcatctcctccctgcaaggcgctgtgattaggcaggatggagcttattgctgcagtgttagaaaatgcatccttgtagtcccaaaaaagcctgttccatcctgcccatctcttgttctcaatacttcttacttcacggtcactcattttcttcctgtccttgggttgaggtctcaacttcttgtaatagaattttttcagttataagcgacagaaatccaactcacactatcttaagcaaaaaggggattcactgatacgtgtgttaggaaggatatatgaaagctcaaaggtcaagtgaaaaaaatgtaagaacgaagaccttggtggggtgtggtggctcacgcctatcatcccagcattttgggaggccgaggcaggtgggtcacaaggtcaggagttcaagaccagcctgcccaagatggcgaaaccccatctctactaaaaacacaaaaattagccgggtgtggtggcaggctcgtgtattcccagctacttgggaggctgaggcagagaactgtttaaacctgggaggcagaggttgcagtgagttgagatgtgccactgcactccagcctgggcggcagagtgagactctgtctcaaaaaaaaaacaaaaaaaaaaaactaagaccttgtgactactacctactacctggatctctctctctctctctctctctttctctctctctctctcacccccccacactatcacctctccttgttgtcagtagtttcctttctgcagacaggagttccatgtgctgggaagagggccattcagagcctcgtattctcatcctctcagtttagcaatgcgagaagaaaaaacttttgtctcacaacctcatatacaatctcagaaataggctcttattttctggcttgaggctgtccagaggcaccaggcactgtgatggtctcactttctgtcctggatctatctgtggggcccagacagcaggatctatttcagaaaataggcgagagaggaaaaacttatgtggccgtaaaaaacagcggttttcaagtggcctatccccatccacatcataaacttttctgctgaggcttaaaagtgcttagacttcaaacttgatctaaaacagaaatcctacctggaaaaatcaccttccagtcacttagccaatcgctcatcactctctgtctctgaatctcaccacgagtttcacacgtctcccgagagagcgtctcctttatcattaccacatgtggagtcagcagattgggtttcatctaagctctgcctacctactatccgagttccctagcaggttagtgactttctctgcctttttgtttcttgatgtgaaaaggaacaacagtggctgctcacagggttgtcagttacatggtcaattacattacatggacaattcatgatggtgtcagacctgtctgagaaaaggtggcccatgttaccatgacaggccccaaggctaacagcccctttctgggtcatggctcatacaaaggagccctccttggtttgctggtgctctgagacttgcaaatgcattaggaattttacactgtaacccggttttaaatgggtccagagcatccccattgctagactactgtgctgaggaagggcactggctcattgttacatcccatgaacactctgggtctcctagacctcatcctctttgagcttctctctctcactctctctctgcgcattcaggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgaggtgaggcatctgtgggcttcctacaggagagacataaagaaaacatgcccccaaacctatgtgacagctggccgggaaggactggtgcctgcatatggagagtgcacttgtgacagttcctggcatagaataagcataaatgctataggaggacagaagagagaggttttaaatctgcgagggtcacagggcaagtgtcagagaaggcatagaggaagcgatacttacgcttggtttaaagcatgtgctttggggcagtggtttagagattgggtgcagtgtgcaaataggaggagggggccaatcaagagaagtcagtgaatgtacacatcccctgaagacactgggtacatctgttatggtccctgtgtacactcggatattctaaatgagagaccctggggccagatgcctcacggagagtcaatgttgactccttcatacctgttgaaccccttcttgtcacccccattgccattaccctagtctaagccaccatcattttctgttggacttctgtgccagtcactggatgtgtatccctgcctgtaatctagatcctttctagatcattctccatgatgtgtccagagtgatcattctagaaccaaatctgatgtcatcctcctgcttaaaacccttaagttctcattgcttttagataaaatataaaccctttcactttgtttttattactccttatgattcagcccttacttagcttacaaggacttcctcatgtctgagctctagccataatagctgactgttggatgagtcatcggggggaggttcttcttcaggctgcagattggcggtcagccctcctgacctcagctgggctcactcacacatctgggaggcagctgcctgaggccagggtgactctgctctatgcctcatgtctcctatcctccttgtacccacatgttagctgggacatgttctcatcgcaatggcagaggcatgagaaagtgatcctgtttgggcaagtgcattttactcttttctttcactcatgtccactgacatttcattggccaagcaagcatgtggggtgtccagagtcaaagagggacatgttgccggggtcatgactatttctgagcaataatctaacctatcatagctcagatctcactccttgcaggaagcatctcctaatccttaagacctagttggaacttacactctgttcttccctatggttactgcccattttactatttttctgcccatttagactgacaactctgtgagccatcattgcaatatggcttgcttacccaatatcacctagcatgatgtagagcacatagtaaatactcaacaaatgttttctgtaagagctaaggaaggacatcagcagacaaaatagagtctttctatgccaaaaggtgaaagtggtctcatttccattccattgtcctgtaatttggctagccaaaagcttagtggataccattcccataagtagacctcatctgcagggaagagatggggagactgctgggttatttattgcagactccagcaggaccacaacaatgattcaaagtgatgacactagaaggacaggtgccaatgggtgatgaagccacaatgacgatgtcaagtggtatcactaaaaggacaggtactcatgggtgatgaagcctacatgaccttgggcttacaccaggaccctaggaatgaaagagattccttctcttagtggctatgagggaaggcctatgatgtcttaaggaggttggattcgatcatttttaagggaccttcaaatccttagaccgtgattcaaatggtaagaagtttgctccattaaactcccaggcaccaccctttccggagacaacctttaaaaattattagctcctgggaaaatagatgtatctcattttctttgtatccctcacagtgccatatgtgaagacttacatatggtatatgcccccaacattactactgagtgagtgaacaaagaaatgagggaatgaatggatgaacaaatggctcatggcaggcttttccctgccctgtgaattcggcttctacttggtaagaaggtgattgcaatctctgttctcagggttccccaaggattcctgtgtaacagatgaaggaatcacgtctgtcaggtagagtaggtgactgcattcagagtatacatttccagtctcccctgtctttttcttttgatgagtattatagagagggaagccatgagtggattagatgccaaaatccctggctgagagaataaccttaccctggaggaaaacatattagctttgactctgagctgggaatttcggtgatgttgtagattcaatgcattgcagttgggtgtttttatttgttgaaaggaattgctgaattttcaaatccattaactgcttgtcagcattagcaagcctaattagttaatactaagtaaatttgcactaaatatacaaccctggctgattttactggccacgtctggcagagggcagcagcagggagaaagctctgtagagtttctgttggaatcgtgtgaaaagctggagaggttgcttctctttctctctctctctctttctctctctctctctgacacacacacacacatacacacacacacaattgtaataataataatattttggttcctcactaagccaatctaaatcgcagaagtctattttgttaagtaagcttggccccagccatatgttgctactcagagaatttaatatcagatttcatctgactgtaaacgtgaatcatcaggttgcacaaggaacacagtggcagatccagggggcatttaacttttatagcattttaaatgaaaaaaaaaaaaagtaacacttaaacaagtaatttagatcatgctgtaggccctgaatagctttgatgttgtgttttcatggcaagtctccaacttgagctgaattttcccctactaaaaatgcaaatttttctaagaccttctcttggtcctgctactcatgatacatatttcttttaaaagaaatttcaaactagataatagttgttctcctccccacccccgccaccagtagtgtggtggggcagcagagttgtggctagtggaggagagcagaggaggagagtagggaaaggagaatgccatttgcctacatttccctctgcccatttcccgctgcccatttccccccttgttttcctgaacgtgaactgagctctgggcactgttttaggcctagcaggggacaggataaagcctgcttctctaggaattcgcactgagggtgtgagtgtgtgcacgtgtgtgtttggaggcgggagaataaacacaaataaataaaaaggagaatttcaggcagtgataagagtgctgagaaaaacagaacggtgtgaaagaggaaggctgagcctgcagaggcttgaggctgctgccactgggtagcggtaggcctttccgaggaggcggcatttgaagaccggaggaaggttcatcccagcaagtaggaacagcaagtgtaggtcccctaagtcttgggggagcttagttcctttaagggcagcacaaaaatcagtgtggctccggagagcacattaggggagagaggcaggaagagcttggagacatggatggaagctggaccagttgggccttgttgaacatggaaaggcatttagatcgtattctgagttaaatgggaagtgacgtgagagatttaacaatggagcgtcttgaactgctttactcatttaaaatacccactcctgcttggctgaatatctcatgttgtctttttagaagctttggcgatcctatttgaatgcatttaggtcctattggaggggaataggatctcatttgaggccacggaggtccatggaagtcacctgcatagcaaataccctgaaagtggctgcagggagagtgtgagggtgggaccgccctggtaggaggtggaaaatgaaaaacacacggccatgagttccagattagggcttctgaaagccctcagctttcccagctcccatcctaaagtgggtctttaaacaggaagaaagaaagattgctaagtgtctttggagttcctcttccttccccttctagggatttcagcactcctggggctcgggttggctctaaagtagtcctttctgtgtcttcccacctacagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttatttatgaatgaatgagtgaatggaagaatgagtgatctgaaatgatataattagcttaaaaacctctccctcattctgaaggtaaagcaggaacaattggtccacccccaccccaggtttccatttcaggactcccttccctttttggagctacctgcgtgcttcctttacccattttctcagatttaactgatgaattgggagggggtgggtataggacttactgagatgcaacataatattcacacaggctctgcagctagattactgtttgaatcttcattctacctttttttttttttttttttttgcatcaccttgggcaagttgagttccctgggcctcagtttcttgacttgtaaagagagatgacagtgcatctgcctggaagggttcttttatgaagaccacatggttcgctcatggagagtatggaaggaccgtggctgacactgcttctccctctccagagtcttccgaaactgcacgttggactcatttctttattaggatgggttgagggtcttctcattgtttgagtcacatggatttcaggaaactaattcattttcttgtccaagcattcccttggcaagttcttcaatccctgttttcaatggtttcctcatttctaaaatagaaacaagaatagcacttaccctatagcagtactgtgaagattacaagactggacatgtgaagtgcccaggatagtaccacacatagtcagcactcaatccacattagctatttttatcacaattattgttgccctgtctgagcatctacatttaatagaatgatggatatgtttagatttacatttttcacgttattatcgttttgtacatgcctcctgtctttgttcctctgttcttactgcctttcgttgttttagtgatattatggtacaataagaaatatatatttggtctctggccccagtttctgagacaatttctaaaactcttgtagacaggggtgctaggaggctcttttgttctaatatttggtctttgaccctggtttctaacacagagctcccaaatcccttggaatttcctgggcaatagaaacttcttttgttctaatgaggcagctcctggtgggctcctggataacctcaggatggggaatcagccatggcattaaagggttggaactttcagctctaccctttgacctctggagaggctcttgagaggctctggagaggggctgatggttgaatagatcatcagtggccactgatgtaattaatcatgtctatgtaatgaagctgccataaaaaacccaggaggacagtgttgagagagcttctaggttggtgaacacttgggggtgtctggaagacagcccacctggagaggacacggaggctcttcgcaccttcccccatacctggctctctccatctcttcatttgtccatctgtatctttttcattatattatccttgataataaactggtaaatataagtgtttccctaagttctatgagccaccatagcaaatgaatcaagcccaaggaggggtttgtggaaactccaatttataaccagttggtcagaggtataggtgacaacttagtactttgcaattggtgtctgagatggggggcagtcttgtgggactgagcccttaacctgtgggatctaacagaaaacctttaaccttttccccccaaattgttaaataaatatttttagggtgtcattttaattcctctgttaatttttttttttttttttgagatggagttttgttctgtcacccaggctggagtgcagtggcacaatcttggctcactgcaacctctgcctcctgggttcaagcgattctcctgcctcagcctcccgagtagctgggattacaggcgagcgccaccacacctggttaatttttatatttttagtagagacagtgtttcaccatgttgggaaggctggtcttgaactcctgacctcaagtgatccgcctgcctcagcctcccaaattgctcagattacaggtgtgagccactgggcccagccaatttaattattttttgaattattttcttagtgattgctcagtatgcatctttttttttttttttttttttttgagacggagtctcgctctgtcgcccaggccggactgcggactgcagtggcgcaatctcggctcgctgcaagctccgcttcccgggttcacgccattctcctgcctcagcctcccgagtagctgggactacaggcgcccgccaccgcgcccggctaattttttgtatttttttttttagtagagacggggtttcaccttgttagccaggatggtctcgatctcctgacctcatgatccacccgcctcggcctcccaaagtgctgggattacaggcgtgagccaccgcgcccggcctcagtatgcatcttaatctatcacagtatatttcaaattaatagtaacttaaatctgatgacataaaatgaaaatatttgctccaatgcagctccattctcttattaccacatatattatatctatatatgctataagctcaaccatgttattttattgccttaaactactttctatctttttaaaaaaattgacaagaaatgagaaaaaaatttatggactttagaaatactaatctgcgtatttgccaattccagtgtgcctcatttcttcctgtggatttgagttactgtctggtgtcgttttcttttagcctgaagcaattcatttagtattttttgtaaagtgggtctactagtaacgaattatcttggtctttgtttatctggtaatatattaattccaccttcatttttgaagcgcggtttgtagtttttttgaatgtggaattcctggttgatgatcattgatgtttttgtttcagcactttttgttttgctttgttttgttttttgagacagggtgttgctctctcacccaggctggagtgcagtggcacaatctcagctcactgtagcctccatgttccaggctcaagtgatccttccaccttagcctcccgagtagctggaagtacaggcatgtaccaccaaacccagctaattttgtttgtttgcttatttatttatttattgtagagatgaggtctcattatgttgcccaggctggtcttgaactcctgggctccagcaatgctcctgccttggcctcccaaggtgctgagattacaagtgtgagccaccatgccctgcccagcactttgtatatatcatcccattgtcttcaggcctccattgcttccaatacaaaatcagagccacccatgttttgatgctcacctgtatctgacaagttactttttctttattgcttttaagattttatctttgaacagtatgactataatgtgttttggtgtagatctttttgtatatattctacttgggaatcactgaacctcttgaatgtgtaaagtgatgtttgtcatcaaacttgggaagttttcagccattgttttttcaaataatgtttttcccccttcatctctcccctcccttgctgagactctctttacatatatgttggtatgcttgatgtcaatcccacaaatttctgagcatttatttattttcttttgccttttttcctctctgttcttcaaattacataatttctattcatttatcttccaggggactgttttgtttttcttctgccttcttgaatctgaggttgagctcttctagtgaatttttatttccattattgtatatttcaactacagaataaaaattgattttttaaaacttatttctgtctcttaagaattcccatttgttgattcattgttgtcatactctaattctttaaacatggtttccttcagatatttaagcatatttataatagctacatcaagtctttgctaaatccagcatctgggaaacacatagtttcttttgacctctgctattcctgattgtgggccacattttcctgtttctttacatatgtcctaatttttattgaaaactgaacattttagataccctattgtagcaactctggattcttattcttccctgcttgttgctactgcttgattttgttgtttttattcattttttaaataactcacctgaattaaatatatgagacttgcctctactagtatttggcttctgatatttctgctaggttcttaaattattattcctgtttttatttttaagcctgactttctcagagttgcccctatctccacagctgagcgtgtatccaatgactaggctcaaacaccctaacccagcaaggcttctgtcctccaccgatggatctgtatgtggctggagaatgcattcaattttcaggctgttttcaactctgactcaattttttgctgggcccctttgcatctcctctgcacatgcacacagccgtcatggtcagacaggagtcaggggctagctagcctgggcacactctgatctcccctaggcatgtttgcagcctaagccaggaatgtgcttgccacggccacaacctcaagctagtgaagacattggccctgcacactcatccaccaaatcaagtgagctcccctgtgactgcagcaacaaagctgtcggtccttctacctgccttgttctgttgctgaccaaactgggggaggtaagggtgggagcagccccaggcaagaatgccacaaatctgcactgtacttatacaaatttcagcaatttttcaatataaacatttctcagattgttatacatctttggtcaacttgcagagtgttgaaatagttgtttttgtcaattttgttcaaccttatagtttctttttggagtgaggatttaccaatactctctctcagccatagctggggatctcacctctccacataccctgtccatcctttatttctcttatcagaacaccaaggagcagacttgtctacatatgccatgtgttatttctggggatcagcaaggttttgagagaatactgagcaatctatggagcttttaaatgtacccattggagtgtgccaatgtaggaatgcctgactggggctggattacatactaggtaaagagcacattctccagtgttagatattcttaagcctttgggaacatttaaactcagaattaccacgtttagatttgcttctccaaaaatacagaatgtacgttgtattagcccattctcacgctgctacaaagaaatacctgagcctgggtaatttataaagaaaagaggtttaattggcttacggttctgcaggctgtacaggaggcatggcagcatctgctcagcttctggggaggcctcaggaaactcaatcatggcagaaggtgaaggggaagcaaggacttcttactttgccaggaggagaaggcagagggaggtggggaggcgctacacacttttcaacaaccagatctcacaataactcacttactcactatcacaaggatagcaccagaggggatggtgctgacccattcaggagaactccgtcccatgatccaatcacctcccaccaggccccacctccaacactagggattacaatttgacatgagatttgacgaggacacagatccaaactacatcatacgccttaaataagtaaattttcatagttttcattatttggactatgtgcattaagaagctagttttaagttcacattcgtggtggcttacagttaaaatatttggggctgggcgcagtggcttacacctgtaatcccagcactttgagaggccaaggcgggcggatcacctgaggtagggagtttgagaccagtctgggcaacatggagaaactccgtctctaccaaaaaaaaaaaaagaaagaaagaaaatacaaaattacctgggtgtggtggtgcatgcctgtaatcccagcttctcaggaggctgagtcaggagaatcacttgaatccaggaggtggagtttgtggtgagccgagattgtgccattgcactccagcctgggcaacaagagcaaaactctgtctcaaacgataacaacaacaacaaaaacagttgcaatatttgtgaataccaccaaaagagcagagctgagaccagagaaaagatgttcgttcaagacagagatacactttctaacagaactgcctatagataacctggggtgccggttgaagggaagggtggggagaatttcctgcaacgggagacacctctgcatggatccataaccatgaagctacaatgttgttgaaaagattccctcagcagatggaatgttctttgatttttctttctactgtgagacagcatacacacccacattcatacacacaaaagctacgtaccagttttacaccactttttcaggtaatcctcacagctaccatataaggataaattattatattttacagatgaagaaactgaagcctaaggcagttaagcaactcccaaaggtcagaaatcttgtgaatggcagacatgaaattagtcttcctgactttaaacatgagtggtacttcttagaccagggttgagcttcctaggaattactgagagttgctgagtacatatggaattttactcaaggactagagtgaatgttagttttgcatgtaatgcctgtcaatggtagactggataaggaaaatgtggtatatatacatcatggaatactatgcagccatgaaaagaatgagaacatgttctctgcaggaacatggatggcgctggaggccattatccttagcaaactaatgcaggaacagaaaaccaaatactgcatgttctcacttataagtgggagctaaatgatgagaacacagggatacataaaggggaacaacacatactggggcctatcggggggtggagggtggaaggagggagacaaacaggaaaaataatgaatgggtactagacttaatacctgcgcgacaaaataatcggtatgccaaacccccatgacacacatttacctacataaccaacctgcacatgtactcctgaacccaaaataaaagtttttttcaaaaattgcatttaagcaagctttcacattttctgaggagaaagaaaaactcataagaacttttaacgcaaaaggagtatttcatcaaagaaatatgacaccttggacaggatgctgaaagctatgtccatactcaaatcctggagaaatgtgtcccggttgtctttctggtgggcagccgttgggtagggaagcttgaggagcacttccaccatcttcctggcacctgggggtgccagtgctcttggtttctgaggcccctttcctgcctctgcttcctgctgaggagtggttttcctctgtaccttggcaccaggaggagctctatttctagccgatgacctgagaccttgaagcctgcagcggtggcaccctcactagcagcagggcctgtctcagcctctgacagtttctggggcaggctcaccctccccccgttgccacaagaccatctcatggcccaggaagggaccacagcccacagtgaaagcacttggcatctatgtagaactgacaaactaggaactgtcacctcactaaatgaacgtgaaaaaagataaaactggagcaaggaagcctttgggcaaacatttaaaaaagtgatttcgaaagtgggtgggctgacctcagtggccaggccaggctgggtgcctgggatgcactccaaagtggcagacgctaggccgtttgccaagagccagtcgccccaagggttgcaggacagacagccctccgagcgacttcccagattcagtgcgctgctaggcctttctgcggacctgcaacctgccatcagctgccttttcattgagaaatcagtaattgtgggaaaggccagtgaaaggtttgtgagccggttaacatttttacaagctgattaaattctcaagttcaccccggactcaatggagtttaagctgaaaagattcctgagtatttccacatttccaaccagaaagaacatgtttcaatacccagggccccagaccacaggctggaagggaggggagaagggcagagagagggtgcaggcagctgcaggaaccgtgtcgctgtctcggtagctgctttacacgtggtctcagtgccttgaggacgccaggcgcagaccagttttggggctcaaccccagcaagggaagcatttccttccaattggagggaagggctgatggtgccaaaattggagctgccagatggttccctaagaacggattacaaactagagtaaacactccatcaattcatctttgaatttattactaaatatttttaaacaccctttaacaatccctacaatctaatccattctcaaatgctaaagaaacgtgtataaagaaaaacattaagtgggtttgtcaaaagattggaggtttggatggaaaagtttattttagttacttggcaatgttggtacccactggttttagcccagcatcacaagaacctgggtccaggcagcagaaagacctgaacccaaaaaggacagaactcaaggcagctccaggcttctgtctatggaaaaagcagctaaactttgatctaggtttaaaaaacaatggaaaggcaatgtcagagaacttgaaacaatatggagatttttttcctctattttctgtgattgcttagaagcagaaagttaaaatagatgccctttcaaatttcctgtatctcatttcaagtcaagtgtccccgactagtgagttcctcctttccccagcaactctgtgacactggagattcaagacctcagcagctaccagggatatttaggcctctggagtacacaaaggccaccaaaggaagaaagggcttaacaatgcccccgggatcccatcaagccaatcaaaaggattgaaaaccctgaataagcaaggtttatcaccagccaaactatgtcaccatcctggtgccacactgcccattcccaccgagctctgggaaaccacctatgtgctctccttgccggagggacatacccagccccagaacgaaactctgcagaggggccagctactggcactcctgatgtcagcaccagcagctgacctggcaggcgcccaaccaggaaacgaacaagggaaactggaagcggccaagggatttgcagaaccttctgagcccactgcaaaagaccatgccatttccattctgaagacaaaaacgtgaagtccctgttcccaagaccccctacagaatccaagaaaaaacaaaaagggaacatcaaaatgaaagagagaattcttcatggatggatgtcacgaacgtgttttcagggaagaaccccaaatggcagtcagatggaggtggggcgagtgctgagctcacccaaagaggatgcccattctgagaactgtttcaggagaaagaagcgcaaaaggccggggcgctgcctgtcccaccctgccgccagtgctgtgtgtcttgggtggctctatcacaggtcagcaaatttttctgtacagggccaaagagtaagtagtttaggcatttctgtttgtttgtttgtttgtttgtctctctttgctttacaattctttgaaaatataaaacccattcttagctcaagggcctataaaaacaggcagggactgtaattccctgacctttgtcaggcaccatcaagccacaggtaccctcctgatgaaaggagtaagagtccctgacaggtggtcctctgcatggggcggggggcacctggaaagggagggcctgggaaatgcactcatctgggagggagtctttccattcccactggctgagtcctcagttaccgcagggctgtcgagagtctgagacagaggtctgccctacaacattgtgctgagaagtaacgaactgagctgtacactgacacatttgtgaagagggaagatctcatattgtgtgtgtgtgtgtgtgtgtgtgtttaaccacaatcttaaaaaagaaagaaacaacaattttaacaattttaagagactttctcctcataaaaaagattaaaaacaagtgtgggaagatctggtaattcccaatagcgatttccaaaaccaaactagaggaacgactaaaatagcgttaactgtccctcagtcctcatcaacacatcctatacattaatgtattaacgtcataacaacccacgcaggaggcaccattattatcccattttacagaggaagaaactgaggaatagaaagtttaagtaagttgctcaggttatacagctaggaagtggctgagctggggactgagccaaggtatttttggctccagagtttatgttatggaaggagcctctgtaagatttggacaaaagggattttataaatgtccagatcattagctactctatcagttttcccactgtgattagcaaacaccatagggaaggtgtgggagggaggaactgagccccgtgcccaagccaggcttgggtgggcagaatcctgtgtgaagctgttgaatgggaacagatttcaacgcagaaggaaagcaggctgactctctggcacctgcatcaggaaagaaaggtacaggtagagaagctgcctatgactttcgagtcactgtccctccccgccccatcatttctggggaccagtctgcgactcaagaactgatttcacctgtgagcagggtgacttctggaggcaggtggtagtttaggaagttgcgggtttttgtgaacatgtaggtctcatttggacatctctcctaggaaagctcatctcctaggattcataaatcccccagtcagggagcctccttacctcaaatcaggcctttgctcttatgccatgaaaccaaccatgcatttaagatgaaaacctagagcaaagtcatccattagaatttggccacttttaataaatgacttgttaacatttatttcgggcataccaagaaaagttttttaattaaaaagcaagtcaaggccgggcgcggtggctcacgcctgtaatcccagcactttgggaggccgaggcgggcggatcacgaggtcaggagatcgagaccatccgggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggtgacagagctagactccgtctcaaaaaaaaaaaaaaaaaaaaaaaaaagcaagtcaaatgtttcctcatataagaactgaagtacttttcttttgtcttttaaaattatcattattcttatagcaacttggatctaaaaaacaagtcatgctccttgatgtaatttaaatacaaatgtttaaagtgctttccccactctgactgcagtcaaaatgtcaagccttatatttcacatgtctctccaaactttcaccttgcttcatgccattactatatacacgagtttttccctacaaaatggaatcatattattctatatcttgtttttataaaatgtaagaatatatagtaggcattttccctaatcaatacatatagattgatttcattttataaaaatagttacgccatactgaatactaggtatgcactataattaattcaacaatcctcctgctgatgaacatctaggttgctagaaaattataacaacagggggcctctctgtcttgtccctgattggttttgggacaattatctattcatttggagaatgacaaactagttccttacttcatactaatgacaaaaataattccagatagattatagacctactagaagaaaatgcaaagaaacttttgcataatcttaaaataaaaaaaggccttcttaatgtagactaactagaatctaccaaggaaaaagaacctgccaggtttgatgacataaaaatgaaactttctgtgtgactgaaagaactatatgaagtcaggacacttcatatccagatttaatttttctaatatgcaaagaggtcattgaaaataatattaaaagataaaagaaaaatggagcacaaaacagacttcacagaagaggcaatacaaatggaacaattattatacaaactagccatggacatgcaaattttaaaaacaatgagctactgttgctctcaattgggcaatatttttagaaaactgatagcatctaggccagcccttcccaatcgtctgcacctgggaatcgcctggggaccttcaagtaactactgatccccagctaccaatttaattggtttggggtatggcctggggttctacatttttaaaagtttcctgagagagtctaatgtacagactttgaacattaataatttgggaataagtcccgtaatttggaaaccactagtgtacattaaaggagggtatgaggcaaaggaggttttcatctctggtgtgggtgggagtgtaaatcatcacgacttttttagaaagcaaacgggcagaatttattaaaatttactaaaagaagaatgtacataccttttgattcagtaattccactttgaacaatacatcttggagaaataaaagcagcactatcaaaagatacacatgcatatacacgcaagagtgtctactgcagccgtgattcctaacaaaccctggaagaaaccagtggttgaaaaagagatactgagatctctaactcagtgaggatgatggcacaggtaccaatatgtctgtgggacatcgttaagtgaaaaatgcaagttacagaataataagaatagatccaattcttaaaaatgtatatgttgtttgcataagaaaatcaaaaggcctagaaaggtaacataaaagcgggagatgatgtagagagagtagataggaaacttagttttctgtgaaacacaagaggatcttttgtaatcaaaataattgacttttttttaacaattagcctttaaaatagacacatacacagcgagaaagaaatgaggcttttcctaagatgtattaaaacttgaagtaacaaatatactatattattagttatagtacatacttatatatttgtattatttatatctattttattttgtttttatattatacaaatatatacatcattataataaattatactacatactgctataattaaaacagtaatggccaggtagatctaaccattgactagagttcagaataaaaatccagatttatatggaaaccaattgttcggtgaagccaatatattttgagttagtggaggaggatggggaagcttgctgttactgcttgctatcatggccaactggagagagttaaagggcccaaagatggagaaatccagtgcaggtggtagcttggaagcccagccctagggctgaatgtggtgcattcttaacaggtttccaggtaatattgattctttgagccacaggtgagccaaacccactctgaaagccatggctacttacatccctacagtgtccactcaacctgtaaatcccacaaggaggtgtggggcaaggggtggacatggcctccactgggttcctgccaataaatggggtttggggttggctgcctggaattgctgtcgaagttggcagctgcttggcagctttgctttctgagcccaacaacagctccaagaatgtgtccggcaggatttaagcctgagctgggaacgcacatctgtgaggctctgatgtgaatattcagcagggagatctggatttcttctcgattgcctgtagcatcaaatctgtgacgaggcttacccaggactttcttctcctgacataattgcggttttcaaattcagttatgttcccactcttgtattaggtaacaggttaagcaaattcatgagcctgatttatttttctgtgaccttcatattttagaaagattatatccaagtcccaaccggcttcctcagctccctagattaaatgttctcattgttcagcttgtgttacagcacatcaccctgcttctcattaatcattcccaactgtccagcccccttagcttccttcggctgcagaaggctgcaccttgttcatgcacttattcatctgagtgagggttctctcccaaatttaggcctgtctgtggtagcctccagtggattcttggtgcatattttaaaacttcaagggacaggttagtgagaagctgggaattgaagaataaaagtccttcgctttcagtttcattatctttgggtgactttaggtatgacaatcagccacagttaccccagggtactactaaatctaaaattgagatgaccacactcagaaaaacacctgtttcctgaattaacttctcagtgttatacctaagtgaaaaattgcctccatgcttataaaccactccacctgcctccatttctgcagatggacattcatactcttcaaaaacacatcccactgtaacataaactgggtgaccaagaagctaaaagcagaggaatttgctcatagaaaatagagatctaacagctttaatctccctttcctcccctaaattagatattgtttctattaaattcccttctagtttcctcatttgccttcatcccatttcaggacataactggtgctgggaaatatggattcttctctatgtcaaaggcccactggtgactgcttttaatgagtcattaaacaagaacccacccaaatgcccatcaatgatagactggataaagaaaatgtggcatgaatacaccatggaatactatgcagccataaaaaagaatgagttcttgtcctttgcagggacacggatgaagaccatcatcctcagcaaactaacacaggaacagaaaaccaaacaccacacgttttcactcataagtgggagacgaacaatgagaacacatagacacagggaagggagcaccacacactggggcctgtcaggggggtaggaggtaaggggtggggggcaaggggagggagagcattagggcaaatacctaatgcatgcagggcttaaaacctagatgatgggttgataggtgcagcaaaccaccatggcacatgtatacctgtgtaacaaacctgcacgttcagtacatgtatcccagaacctaaagtaaaataaaaaataaaaataaaacaaacaaacacaagaacttctgaggtcctccccgagaggactccccgagggagcttggagcagttcctgccacatagtgggcattcagtgaactacttgagagattaatgtctgttgctctccccaggcacttctggacctatctggtacacactcaggatatttcaatttctccacaatcccctgtgaaggtttggcgatggtgctggtgaattggttgcaccgaacaaggaacctgtccactgggctgctttcaggcagcccagaccagccctgggaggcccggcttttctggacacgattagctttcataaatcatctctctccactattctttgctttacgatcttttatgtggtttgtcaattaagttttgtagctataatgtcttaatatttggccctggggtgtaggctatcaatcaatctactctaacctgcatttttatagtaaatctcaggcctcggcatgttgaatttcccatctgggccttcagaagtcttctcttctcacttcttacaaaaacaagagaagctactgtgggtccattttccaggagggacattcctgctcctcagccatcatttcccaaaaaatcctttcatttctcccgggatttcttattaagttactacttttagattctaatgccttatttttccatgttagctatattggattctttgttcacttttctaatatttcccatttgcttgtgcaaatctccttaccaccatgttattaacccttcccttcccatccttcctggtcagtggatggtctctttatgcccttcctcacccagcactcacttgggacaccattccctctctccaggccacagcagggctcctgactgtcctcactgcagaaatggaagcttcttcagcagccatcagtgtccttttatctccttactattctttaaaccatcccacatcccttccatgaagctttttctctctgttgccagagcaaccgctgggtgcgggtgaggatgctcatggccccatacccatctccccatcatctgcgtctggcgtggcccttgctaaattggccaatcaatcatctggggaagagccacgacctcatgggttcaatgtttgcactcaccagggttccctacttcttcgaaggttctgttgtttaaatcttcaaaaatgtaatggaaatggatgttctacacccctttgggggtttcacagggttttgagaaaggcacagatggaatgtatgctaagatttttcttaattgaaaccaaatgtttttctcagcaacatttgccatttgattcttcagtgacgggagatgcctaggaggaagtcagttgacagtgatgtggagaagaaatgcttctgaagtctctttgcgcttgccttttccacgatgacactcttcattgtgtgggatttccataccccctgaagggcaaaactgctctggagggaggacttctccttccagatatcgggaggagtgacaggaaagtgagggaagagcgaggcctgaagagtgctccatctcagatgagggtgcagggcacccttcaacgccaatggccaccgctgctcacagcctctccagaagcgggaagatgggacactttaaccacgaggtggtcttctctataaaataacagtgggcggggggcgatccatcgtgttccctgtggaacacgatgggttcatgggccataagatacagacaatctgacggcaagaagccgagtagtagagagaagtcttaaatacagtgtgaaagtgatcaggaaatttttcaagaaggaggtggcttgtgagctgagtcctgtggggcaggcaaggaggaatgaagttaaggaagcagagggcagtgcttttcagcagttaggaggaataaagtctcctcaggcatctctttaaaatgccggctcccaggccccatcccagaggttgaactaggaggtctgaagcaagcccgggacttggaaaatctagcaaaccccaggaaccctagttgagatggactcagactacctgcattatggaaagcacagacggcagtttcaggcaaggtgaagggcctcagtttggtttaaatactcaatttagagcaggatttgtaaacttaaatacctctggggctagggtgacacagaccttgagagaagttgaaggtttacaagtacaaagaggagatactctctctctctcccccaattctggaagggacagcagccaacaagctccggcaattactgccatgcaggaatatgtgctccggactagggcaccagagctgtctaccagaagagaagccagagacctgagttttatgtgccccagaattattaaatgatacattaaaatgccacgagcatcacataattccatgaagtccactatagtaggcaagttcagaggagcaaaataaaatctcattgcatatggacttaaatgatagaagaaaactgtattttatccggtagacaatgaacaatagaaggctttgcagcaaagaaggaatctgaacagaagtgtgctttaagaagatttctgtggctgttgtctgctcgcaatggaatggagaagggacctcagatatcagctcctaggaagcctctcccatgtgcaaaaggaatggagaatagaggatgaaaggtttccggaaacaagaattcaggagatttgattgactatggaaggaagagaaaaaaaggaatcacctggggtcttctatgtctaaatccatgctgcctcttgccatccttttcctttaatatacactaatgttccagcttcattcattgcacagaaaaatgatcatttaggttgcattctgatcagtgcctgcttaataatgaaacttagagttatttgtttagggaaaaaaaagcacagacaaactattttataatatctataataaatgcaaagaaatcaatacaaacaaaacttggctttagcaaactgtacatacataaatatctttttttttttactataacattcaacttttttcacataaagccttccatgatcttatttattacatctagtttttctttatacctctaaaaaaaagtgccttttagatttacagcttgtgcttctaaagcaaaggttaaaacatcatgccccaaaggaaaacaaggtaaaaaggaagctgccatataagctcttaaaaattgtatgttacaaggttctaaaatctcttcagcactggttggttggtagattgtacgacactgacatggtgcttgggagggtcatttatctgatggttggagcagcaccatgggaaagctgcccagatggtctactgaagtccttggctgtgcacagaatgggccaagggcccagaattcatgagtccggggaactttggaggtccttactcaatctccttagtgctaaggttcagagtctcaaaccagatttcttccaaaccttcttgttgtctgtttgttcccccgtcactgtttatcttccacctctgaagccataatttgcacacatgtgatctggaggagggctaaagctgccacaccgagggctttcgccaagatcaaggtcctcttgttggtagtttgggattgcttatgacccgatcctccttatgctaccagcacttctgcagatggcatctgcttagttcagagtggaggagggccattcgtgtatctgagcatggggtggaatgaccgggcaaagttgttggagagggcacagctgtagtcttcctctgacattggtacaaggcaggcaagcccgatgaggaggagcaggagaagctgaaggggaagagctgctcggaggactctgaacaggaagccgcggccggaccgacctggccctggctcagaaagggaggaatcggagccaccttttgtggacctgagagaagaatggacataaattactcagataactccagtgtcggagggacgctgctttttgcctctgcaccttcctggaagctaaagggccatgccaagcacaccccagcctggcgatcagctgccagccttccacagtgtgcccaggtcaccccccaccatcaaatgaggttgttggaaactgcactgacaagaaataaacatttagtcagtcaactaaacgtaagtaattaggttcaaattctactccttttaccccttaatgtggtgaaacattttctatcaacgaaaataactgctctatacacattctactagcatgaattaagtagatccagaataattaaaatgtagatatttgatgcagcatatttttgttttaagaatatcatgaacattgttaagcaaaattagttgctgtcagaatcataccaagtatcccatctagccatcctggatatgccaaaatccatgcagcaaaaataaaaacagtctttgtcattttgcacagacccataaaagcttcattaatcatagagcataccctggtttcatcttgcactgaatcagcatcaggccctgacattagcgggttccaaagctgtacgaacaaggaatagcagtggagtctgtctacagaacactggtgttgtatgatgtagatgctaggctgatcctatcactgacgtcattactttggaaaatggacaccattttctgaggaggatggactgtcatcctacagccccttctacactcaaagtgacaagtttttctatttcacttttatcttccttttaaacagtgcattagagattgagtacaggtttcagaactcttaagaaggactgcctggaaaatacagaatctggaagtagattctgagttgggtgctactgttttctttttgtgaacagccattacctttttttggttactagcagaaaagatgaagaaagaaatgttgtttacgacaggcatttggtgtacactcagacccatacaacattgaatgaacaaaaataaaagatgtagccaaaagaaacactccctcacaactagtataaattccttaagagttttaatatcaccaaggataaggacattgtatgtgaggctactgaaataatatgagcgtgtgaaagctgtattggtaactgtaggtttggtccagaagaaagcactatgtttgtagctcacctattacctattaatttctgaagacagactaccctaatatcggtgggggatgcggagtgacacctaagaaaataaatgttaaaaacagatagaatccccttagaagggaacagagggagtattcaaaactcttttattaaaccatcaaagaaaaatgggagagggctgggcacagtggctcccgcctgtaatcccagcgctttgggaggctgaggttggcggatcacttgaggccaggagttcaagccagcctggccaacatggtaaaaatacaaaaattagtcaggcctggtggcgtgtgcctgtagtcccagtcacttgggaggctgaggcaggagaatcgcttgaacccgggaggcggaggctgcagtgagccatgatcggaacaccactgcactccatcctgggcaacagagcgagactctatctcaaaaacagatattggttctgcagaaaccccaagaaacaggcagcacgcagtgtttctatacacttcttgtggtgtaaggaaaaatcaaatcactggtttaaattggaagcatgttcttttctgaaatccacacaagtaacggcagggtaatgtaaccttgaacaactcacttcatctctaggtgtcaacctcttcactaacctcttcaaattagcatagatggtcttctaactttaaagtttactgttcgatgtttttgtcttctactgatttgtcagtataaataatctcccaagaagccacaagagctcaatcaccatctagtggtcaaactgattaactgcccttgtgctaagaccaatgagttattcctaataagctgagggaaaaaaaaagtatattttgtgaaaatatagtagaacataaaagaagtatgtcatataccttattaatggaaaaggaaaatagaaacttcttgagttacctgagcataaaatattcatgttgagacagggccttagagagcatccagttcatctcctaattttgtaggggagtagctaaggacagttcatgtttactcttctaattgctaggcagcactctgagcatttatgttgggttctgtcatttaatccccacagcagtcctctgcggtgtgtacttattaacttcattttacagatgatgtgaaagaaagctcagggaagtgaaataactggctcaagctcacacagccagtggcagaagatttcaaccctgtgattttaactaccagaacctggagactctagacaggctgaatgacttgcttcagattctacagttaaaggaagaggcctagcagggactcaggcttccaaaatccctgcccaccgcactctctgctgtgaaatgttttgctggttggtgataggaataatggtaatggtaattcaggtcgtattcatttcacaggtatctcacatgtagaagcaaagaagagaatcctgaacttgcatcctaaaatatttggaaacaagtggtttcctcgtgtctaaagcctctggtcataaggcctcacagtatcctgcagatcatcaaatccgtgtgtggacgtggggacattttgttttgaggcagttacatgaccatgggcaagtaaattagtctctctggccttcagttttctcatttgcaatgattcaatggtttgccttaaagtgtcttaagaaggataggatagctacccacaaactttggatcaaattttcttcaaaacatccttcccctgactttaaaatatgccctggcaaccaacactcaacacctgtagctagatgagttataacagagtgactgaagagagctcccacaattcctagttattaaatacctgactaattttcattaggagacatttaagaactttagtgatgggaagatttacatatataattgatagtacaatctgacagagctgaatagctcctgtttgtcaactgttaaattctttgtgcaattaggtcaaagatcaagatcaaaacaagggctgcccattgacctgttcactcctgagaaaaatggcaaaccattgaatcataaatcatgacagccaaaataattttaggatattaatgcacccctcatctttgcaaatgagaaaactgaaggccagagagactaatttacttgcccatttttgataaaaatgtcaccatttacagaatgtggactcctatgttggagtctgttgaaggacatggcacatttaacagcatcagagcattttttattaaaatttaatttgtgcatgacttctaatgctgaagaacgccaagctaggaagaagtcatgggctgagatggggacagagagaacacacaatattcagtgactgtccgtgcagctggctgcccttgaaaatatccgaactatccactgggaaaatgcctgtccccttggggtaattaccagagtttcaacatgcccaaagctgcctcatcttcagggggaacttgttctagcgattttagtatcaagaagctaatggtcccagggaaagggttatttttaatatttagctactgtgctaaaaatcacctaagtttctagagtcttgggaaatttcataagggaaagaacaaaggcaacttgttgactacccactggtcattctcctctggtcttattacatacatggatgccagtttagattgtgtttatataggaaaaattaaatgtgtgagcctccttaaggaacatcatcaatacagatatatcagatagttctgtccagcaaaaaacgtgcttatttgctacaagtaaatttttatttatttttctcacttccctcactccttcaaatttccaggtaaatagctgcccaggagttgcttcatctctgtcccaaaatacctagacaattgcgggataaggagaatggcagggagggagtagtggctaaaatcacacccttcaaaagaaagtgtgtaggacacacaattgtgagaagtctgaatgccatgcacatagggtatgactcactttgaaaattgtttataatcaaggaaatgaaaatgagttaatttcgtgcatgcatcatttaaagccaaatgagaagaaacttctaatttattttgttacttttcggctaacactggcagtatgtaacagatttattttgcagaaacatctagattgtccgtgatcttgatcctgcccttatgtgtcttgtctttgaaacccagtgtttcctggatatatggttcaggagacaagtttccagaatcaagttaggacccaggtcttctttttttccaaaccaaacattcttgctaatcctaaactacctgaggcagcctgtggtggcctcagctctaaaaccattgtttaaaggcttctacccatcaatggcccttcagcagagtggtacggttaacggggtagggtctggagtcaggggagacctgggttcaaatcctacatctttacacctctaatccccagtgtccttgtctataaattgggaatatagccatgtcatgggattcttgtgagggttaaatgaggtaaaacacatacaatgcttagcatgtatacaattaagcactaaataattgaaacacattaagtactaaatgaatgtcagcagcttatcactattatctgtataatgataccaagggtgtgccgactcatacccttaggggttggctggattcggccttttctctcgggaaaacatacctgatttattaatagtgctttcaagcatgtgataaatttctcaaactgcctgtcttgttccctagaaacaccaggaaggcctacctcaaatagcaacagagaaacctatcggagccttaccctacagctttccttggggcacgggtgagcaatctgccttagaggggagaggctctgtgctgaggctctttgaatgctttgaataaatagatccccagataatgaaaagacttcaaaacaaattctacaagaaactgagtagtgtttatagtgaggccctagtgtacatgcaaaaaacccccactgcccttgcttaaatgtatctgattaacttgaatacatttttaaatgagggcttttttccctctttcagtgtttcggccagtcatttgccacttctcattccatcttagttctctgtaaagaaggtgccagagacctaaggtgcccaaggcaattttgcattttacaattctaagctttagaatgaagtcatcaatttgctacatccggactacagtgcaattattcctttgccttgctggaaattggagtgaaatctttctagctgtcaatttcaactcagttgcagtagtgttttgaagaattaatggcgataaggttagaaaattttaagtcaaacgtagggaaaaagtaccagctagaccatcataagcatttgctttgaaagcatgcttctaaagtgtgtttaacctcaaataacagtcacaaatatggttattatgaatgtatgcacagatttttatgtttctaattttaagaagttctagggagctccctgtaacgatttagggaatctctagattctgatatactgcaagtcttttaatggtaggaatcacattgaattaattttgtaggcccagggcctaaatttagtaggtgttcagtacctattggcatcaattcatatgtaggtttaaaatactgtatgaagatacagaatcaccaccatcaaatcaaattgaaatatgtaacaggctagtataatattaacatctgactttaaacaacaacaaagaaaccaaatgagtaactcctcccttcaaactaatagtcagtttcttccaactcagtctctttctcctctcaggaagaatgcgtatctaaaaatttcccattgcagactgctggaaacaacattctaaactatttatgcttctgcaataacctttccaatttgctggaccagtgcaagattaaacacgagatatctcaagtctcaatgtaaaggaacaccacgacagcctggactgtgggtgaagttcattcttccccagcagactctgcctttcattctcggggttgggtgtgccccaaacagaggtaccgacggtaacgaagcccaagaatgttcaaccacaacctgtctgtgaaggtgttggatgacgtttgccattcaggtgaagattatttatgttccagtcccacctgagtagcaaagtgaacactgtgctgaatgctcagaaagatgttaatgaaccgtgctggacagagcagagctgaaaggcgccttgcgagtgtcgtagtgagaatgtggctgtcccagctgcaaagccctgttaggaggcatgaggaagcacttgctgccctaagaaacgatgccttcgacattttcaaaagatctatgtggctgtctgaaacaatgcggagagcagatagacgcaatatttgggaaccaaagagtgactgctgttggcgttgcatcataacataagcgctttcccccttctcgtcactatcatttgtatcaaccaaagaactgatctctggtatcctcgaaggaatgctgtggggatattcttcatctctgttcatggtacatcagcaatttgtggggaaaagatggactatataacacaatgatctgcctaaaagaaactgtctctacttatagggggctgagcaaaccttagagcatctgcggatgctcgtcattatcttcaaaagtccccaagagtttttctccatactttattattgctattttgtttaggctagaaaaaaaaaaactcataaaattgtcttcaaaccaaaccaaagg

SEQ ID NO: 36726 - DNA, 110683 bp, Homo sapiens
ttggttaagatagggagcgctccagagaccaggtccaagatcttcccccgtttcacaattagaaggcggctgtctagaggtcattcccttccttatgatcctcataaagttaatttccagtctcttggagagagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctagcggctccgctgaccccttcccgccggcctggacgaagtctgggctcgggagccgcgtgatgcatcccaaagaaggcgcagaacagcacgtgttctccccggtgcccggggctcccacaccaccgcccaatcgctgcggccgcctagtgctcgggccgcgcctgccggccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggccctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggtattgccagcagacgcctgcccccggcgcagagcgggagctccggcccgcacccccaaccggggcctcggcctcgggcaggccccgcaggccccggcggcgcgcgtcccgggctttttgcccgcgtccctgcgcactccccgggcgacctgggctgaccctgctctgccggccacgctgtcgccgccagccgcgcctccggcttcctactgattccctagacccgtatagcgctcccggccgccttcccgcccactctgttgcctgcccctctgacctggtttccgcacatccagtcctcagcttctttccaaccgcgcctgcgtcacgggccagtgcccttcgtctcccgcccggggctcccttcgccctccgagtgcccctcgacctccgagtcccccccttcgcgggtcccttggctgcccggccgcgcgccgctgatggcttcaacagcccaactccgccttggttgggttttgtgtcctcattttcctgctctaattcactaaaaaaaacccaaaacgatccaaccaacgaaactagcgttttcgctaatcctagacagcaatgtgctacttagatttttttcatagatattgagaatgaactaatggaaaaacgttgaatatttccctttttggatttttttttcttttttaatcccagatatatgacaattgagacatgacctgatttcttaaaatactaaaacaatacatgctggttgtaaaataataataaagaaatgtacatagtgaaaacttacagtgtttcctccacacatcttaagcacactgcttgtacacatttatgtatgtgatatatgcatatactttttttttttacaaaaattgtatagtaattctgaatttttgcttttcttgcctaacaatatgttagggacatctttcactgtcactacacgtagatatgtattttacatgtagatgtatattttaaatggcaacaaattattctgcatctaccaatgtgcatttaggttcttttcagttttcctctgtcgtaaacagtagtggcttaattgaaattccttttacagatatctttgaacattcgggagtgtttctgcagagtggattcaaagaagtgaaattattaggtcaaaatgcagtcattttttttaacacttcattaaagactgctaaattatgccctaaaagggtgattatctaatgtcggctcccgccaacagtgtctgaattgagacagctcctttctttaaaggaaatgtgcaaggttgtagactggagtgggtgtgactcaatagttgaagtcaatgaaatgaatgtctctttagaagtttatatgaaaaaaaaaatgggccatttagcctgtaatgatgtagaaacaaagaatcagtaaagaagattagagtggaatgtgtttatatattatccttgttctccttctctacctcactgggcttatggtctggtagcatttattggtctgttattttaccatgacagaattgaaagataccctcttcagtttatcctttctttacagagtattactatttttcatagtattgtagaattattttttaaaataatatctgataattgtaataaaaatggaaatggtgtgaaacaaagatcttccctttccctagttatttagcttttctgatagtcctccctatgccgttaatagtttgcttatgttgctatttcttaaggtaccacaaacttttgtttttaatttttctaatagttaccatataagttatatataattttaaaagttaaaattaggcaatagatattgacacctactggatgctcataaaattaaccatcacacttgttatgaaatatgaggaatttagctcaagttcactctctgtcttccctgctgatttttttttactattattttcagtttttttgataaatatttttctttactatccaagcaggaattattttcagttttgtattaaaaattgactgttgactttctaggaagttactcctataagagaggataagaaaaatattacaatttcttcctgtctcactttggtttattatgacttttacattatcaagttttatataatttatattctattttctaattgttacagtgccttcttgtttaaggtaaatagactgattctaaacatcgtaaattaacagagagctttatgagaagcagggtagccaagtgtttaagagcaaggattctggagccagattgcctgggctcaccaaccagtgtgggatttgaggcgtgtcacctcagctcacaatgaaaggaccaagctgcctaataaatgaactgtattttgtagaataggatatatattaagaacttacaagaggacatatggtaaatgttaaataagggctagttattattttttactatgattattgggaaaccacgttgtgcaattagactcgtaaacaaggaaataaaattttgtgacatgaaaactgtaccactgcaaggaaaaattctcttttcttcactataaatcatgttcagattttacttaaaatggtactagaatttgttttacttcatatttggactgtaatgttcttctacaacttatttaaaaatttgttattaatttttttaacagaagagttaaaccagttctcacaatgtcctagcttaattgcactacttgatgaatgcatattgcttatttcttggaaatagaattttttccttgaagaattaggattcctgttctaattttcacttttcactaatatatggctttctgatatatatatatatatatatatgtgtgtgtgtgtttctgatatatgtatcagttttatataaaatattgaccgttgactttctgttacatagaaagttcattctcataatcctattatgcaggaagttacccctatatgagaggataagaaaaatagcttacttacacattcctctcccttccttactttggcgcgcacacacacacacacacacacacacacacacacacaagtcttagctgtaaacctgagactttaaagaaaacaatcgaactcctatgttagttgcactgttttaaatggtatatcttcctctttcttaaaaaccttaatcatttctttggaaaattttcaagaaatggtaaaatcagagagaaaatatctgagccctcaaattcctaaaatgtctttatttggctttcccacttgattgatcatttggtacagtattctggtcttaaaataatttttcctttgaagactttgcctcagtaatttctagctgataattatcagctgtggctgataattctaatgtgaaactaagcccattcctgttagcagtctgttttatcacttggcacttggttggctctttaaattccaggaattgtttccttcaactcagggaaattttctatgatttctttctcttttttttgttgttcattaaaaaaatttcttctaaaaaatgacatatatgtgcagaatgtgcagttttgttacataagtattatacatgtgccatggtggtttgctgcacgtattgactcatcctctaagttccctcccctcaacccccacccaccaacaggccttggtgtgtgatgttcccctctctgtgtccatgtgttctctatgttcaactcccacttatgagtgagaacatgtggtgtttggttttgttttcctgtgttctcattagtcattgggcacttaggttggttccatatctttgcaattgtcaattttgctgctataaacatacatgtgctctgtagtcaattgttttttcaggatggcttttttattctattgatttttctccagtatctggtagtccttggatatccattcatttttatgaatgaaggatatgctgatcagtaggggtagctgtggtggttttctgttgaagttgttaggtttattgaaaacctcctctaaatgggagaacactccatggaatactgtgtaatttggcagattttgttaaggataaaattccgctcagggtgtgtggctggggagccagcaggcttaagatcgttatcattggcaaagtaaaaagaacttgatcatgaggtgggataatttagtatattttattgttgaatggagtttcctttttttttttacctctaggtctgtcgtgtgggtctgtagacatcacaggatttgtttcacccaatctccagctcctatacccacactagggtcctttccaggaaaccctttccctgctgtgtttagagcatgcttattccatgttggtgatgggaaggggttgaaggaggcaggtgggaaacctttctttcaactcctctccaggctgacatgcgtttatttgttaggtttcctctttcatgttgcttttctagaagacctccctaactacctactgattctttctcgtaacatctgttcctttttcttatatcacttattacaggctaaaaatcacattaactatgctggattggactctttaattgcaagtaacagaaactgaatgtgaaccagtctaaaaataattttaaaaaaatcaattcatgtaaccaaactgaaagaagcatggagtacagcctctctctcctcacttgctttctagctctcactctcttgttctcagatttgcttttctcaggtcttggctttattttctcaagataattgactctgtcaagctaggctttcccacaagaagctcaggactatatgcctaaattggatgtcacgtgcagtgtcacactgtattctcttggcttttcccttaaggcaacaagatggctgctgcagctctgttcatcacatgtgcatttagtggaataagggagaagaaggaagagtggaagaatcatccttaggtattccccataatctaggaagcaaatgttcaccagaatacctccacactcccactttgttttatgtttagaattggccagaactattgtgtttgactacctctgctgcagaagagactgggtgtattagtcagttcttgcattgctataaagaagtagctgagattgggtaatttataatgagaagaggtttaattggctcatggtttcacaagctgtacaggaaacatggctggggagacctcaggaaacgaacaaatatggcagaagatgaaggggaagcagggacgatctgcatggctggagcaggaggaagagagaaagatggggaagtgctacacacttttaaacaactagatcccatgagaacctactcactatcatcatgagaatagcaagggggaagtccacccccatgatttaatcaccttccaccaggcccttcctccaacattaggaattataattcagacatgagatttgggcagggacacaaatctaaaccatatcattccacttccagcccctcccaaatctcctgtccttctcacactgtaaaatacaatctttccttctcaacggtcccccaaagtctcagcttatttcagcattaactcagaagttcacagtccaaagtctcatctgagacaaggcaagtcccttttggctaggagcctgtaaaatcaaaaccacttaattacttccaagatacaatgggggtacagacattggctaagtactcccattccaaaagggagacgttagtcaaaacaaaggggttataggccccacacaagtccaaaacctagcagagcagccataaaatcttaaagttgcaaaataatctcttttgactccatgtctcacacccaggtaacattgatgtgaggggtgggctttcaaggccatgggcatctctgcccctgtggctttgcagggtacagcccccatggctgctttcatgagctggtattgagtgtctgtggcttttccaggcccacggtgcaagctgttgatgaatctaccattgtggtgtctagaggacagtggccttcttttcatagctccagtaggcagtgccccagtgggaactctgtttgggggctccaactcaacatttcccctgtgcactgccttagtagaggttctcactgagggctctgctgctgcagcagacttctgcctggatatctaggtgtttccaaatatcctctgaaatctaggtggaggctcccaagcctaaactcttgccctctgtgcactagctggcttaacatcacatggaaacttccaaggattatggcttgcaccctctggagcagtggactgagacatatttgggacccttttaaccaaggctggaggtggagaagctaggattcagggagcagtgtcctgaggttgtacagggtagtgaggccctgggcctgtgaaactatttttccctcctaggcctccaggcttgtggtgagaggggctgctatggaggtctctgaaatgccttccaggccttttctacattgtgttagctattaatatacaactcctctttacttatgcaagtttctacagctggcttgaattcctccctaaaaatgggtttttcttttctaccacatggcaaggctgcaaattttccaagcttttatgctctgcttcccttttaagtataagttccagtttcagataatctctttgctcataaatatgagcatatgctgttagaagcagccagaccacaccttgaatgctttgctgcttagaaatttcttccaccagataccctaaatcatctttctcaagttcagatttccacaaatctctagagcaggagcacaatgctgccagtctctttgctaaagcacaacatgagtgactactgtagttcccagtaagttccttatctctagctgagaccacctcagcctggacttcactgtccatatcagtatcagcatcttggtcacaaccattcaacgagtctccaggaagttccaaactttccttcatcctcctgcttcctctgagtcctccaaactgtcccaacctctgcccaacacccagttctaaagctgcttccacattttcaggtatctttatagtaatgcacctcttcccagaaccagttttctgtattagtcagttcttgcattactataaagaatgacctaagactgagtgatttatatagaaaagaagcttaattgacttatgattctccaggctgtacaggaagcatggcttgggaggtccaggaaacttacaaacatggcagaaggcagaggggaagcaggcacgtcctacatggctggagcaggaggaatagagagaagggggaagtgctacacacttttaaacaaccagatctcatgagaatgcactttcacaagaacagcaaggaggaagtctgcccccgtgattcaatcgtctctcaccaggcccctccttcaacattggggattactgttcggagatgagatttgggtggggacaaaaatccaaaccatatcactgggaaagtgctttatttaggccagcacattccttccctgaaaaaaattagggtagtgattaccaagaagaatgagtagagtagattttaggtaggcagctaacaatgcatgctacagtttaaaacaaaaatatcatgtacaacatttatttgtgtatttattggtttttgtctcctaccagattgtaaactctatgagtgtagggactatgtgtattttattcattcttttatatcctgcaattgtagttgatacatagtagctgctcagtaaatattggttgaatgaatagagcacagaacagaaacggaggttttttttttttatcatgggctaattacttcttaggtgctttcaattaaattaccctttgtcctcacaacaacactgcaaggcagatattcatttctctgttatataaataagaagattgaggctttcttctaggtctaatctgctatgaatcccatccagtgaaattttattttcagatactgtatttctcatctgtagaagttccattcagtattcttgtgcatctttttcttttgttctcatttagcttatgtttttctttaaattcgtgaccatgttgaagatatagccagtgtccttatcttctcgtttccttatatatgtcatatttgggtgtggtttctattgactaatttttctaacagttattgatagtatttgactacttctttccatgcctttttgagtaaccatagctgagctttatttgtggattattttaaggtatgataaattatattacatgtatttttaagaataaactgttcagaataattttagatttacagaaaagttgcaaagacggtacagagtgttcttatatactccttacccagtttcctctgttgttaatattttatattagtatgacacttgtgataattaaggaaccaatattgatacatgattattaactaggatccagatttcattcatatttcattatttttacttaacatactttttctcttccaataccttatctatatgaccacattacatttattatgactgtgatagtttctcagactttatgtatttctgcaatgaccttaaaagttttgaatagtattcatcaggtattttgcagaaagttgctcaattgggatttttctggtgtttctttctcatcattagacttggattatgggtttttgggaagaccatcaaagtaaagtgccttccttattacatcatatcaaggatctatactattaacatgacttactaccgtttgtgatgactttgatcatgtagttgaagtcatatttgttagttttctctgctgtaaaagttgtgttttccccatatttccatactgtagtctttcagaagaagtcactgtgcagtgctcacgtttaaaaagtgagaagttatgttctgcctgcttgagggcagaatatctacattaattttctggaatgtatttatatggaggatttgtctcttctccctcatttatttacctattcaattatttatatatataggaattcacggatattattttatactttggtttaaatatcttactactttattttcttgttcagtttatttcaggtttggccattgagtactctttcagtgacttctcttttgtgtctctttgacatccccccatctttgtgtgtgtgatttttagtttgtttttgagcacttccttactttctggcactacaaggtgctctgagatcatcttttatgtctccttcctccacgctaaaattggacatttctccaaggagctctgtttgattttattgtagaatgatattagaaatcaagatctgggcagtgagtgtgcctcttccttctgggatattgttgcttgtaggccttcttagctggcaaaacaaagaaatatacatttatattaattatgtatatatatgggaaatatattctttgtaatataaagttctgtggattttgatgatgcacagtgtcatgtattcattatgatagtctcatttcgactagtttcacctccctagaaactcctctgtcttttgtctattcaacccttcccactcctcaaacccttggcaaccactgatctgtttaccatctccatagttttgcctttccacaatgtcaaataattagaatcgtacagtgtgtagccttttcagactggcttgtgtcacttaacaatatatttaatatctatctatgtttttttctgtagctgtaatttctttttattgctggatgatgtcccattatatgtatgttccacattttgtttatttgcctattgaaagacatcttgattgcttccaggtttgggtgattatgaataaacattggtgtgcagatttttgtgtaggtatgaatttttatatcagtgggtagatatctaggagtgggtttgctgaatcatgtgataagactactcagcattgtaagaaactgccaaaccatcttttagagtggcctagtatttttcatttccactggcatagaatgagagttcctgttgcacattttcatcagtgtcgatgttgttagtgttttggattttaactactgtaataggtgcatagtggtatctcattgtttagatgtgcaattctgtaataaatgatattgagcattgtttcatatacttatttgccatctgtatatattctttgggtgtctgttcagatcttttcatttttaaattcatgatttttaagagttctgtgtatattttggatacaagtctttgagagatgggtgatttgcgaatattttctctcagtgtgtgacttattttttattgtagcagtgtccattgcaaaacaaaactattaataaaatccaacaactttttttttctttcatggattatgcttttggtattgaacaaaaaaactcttctccaaatccaagggcgtctagtttttctcctatgttatttttggaagtttttacatatgtatatatttataagccattttctgttaatttttatgttttatataaggtctgtggctaggttctttttgctccccatatggacatccacttgttccagcaccattttttgaaaatactgtccattattttttaaattgtctttattagaaaccacctgactttatttgcatatgtccatttctgtgctctctattcagttctatatgtctggtttttttgaaaccagtatcacactctgttcattactgtaggtttatactaatcttgaaatagtgtagtgtgaatcttccaactttgttcttgttcttcaaaattgtgttggctcttgttggtcatatgcttttcaaaatactttttagattcagttgttgacttgtacagaatagcttgctgtgattttgtgttgaagctatagatcgagttcagaagaactgacatcttaacaatattgagttttcaaacttatgaacatagaatatttctccagttttgttagatttatacataagggtttttggtatgctattttaaatagtatatttagtttttcttaaacaattaaatttcagttgttctttgctgatatctaggaaataaattaacttttgtatctattgatttttgtttgcatgctggccattgtaatttccattgtttcatagaatttggattagtttctgacagttaagttacttgtggattagcttgttctatgtaaggttcctcttgaaggtttacaaaggcaggtctctaggaaggttagtgcagccccactattaagcaatgaactctgggttctttactgaatgcctcatgtattcagtgccccaagatttcctcactttgtctggtggagactaaaatgtttcccagttctgtgtaagctctgcaagttgtctggcttacaattttcagaaatttttcttttctttctgtttgttctttgtatgactctgtcaaagtttacgttatgcatccacagattgacatgcagccaaagaatctaggaaacttttatgcagatttatggacttctttgtctgcatagctttctcatctctggtatttaactctcactttgttctccccaaatgtgagagtaaagtcccacatccctatgtcatggtttggaaatgccctgaagtcagaaatccatggcatttatatcattcatcttgtttgttttcttctcttagggattatagtcctgtactgccctttattcaacattcaaaaacaattattttatgaattttgccatttttctagttgttctttttgttggcaggaacagaaatctctactgattttaaaaaattttgcaggcaggtatttgtccagcatattcttaaattttttgcaaaataataagtcttgattttgttatttaacttatttctaattcttttggtatacttgtgtgtttttgtgttctgtgtgtatgcatatgtatatagtctaaattatatctttcttgtgaaattagattatttgttttggaactctcttccttcatgctgaaaatccttaactctaattataatgtgccattagattgacatgtccccactcagtgatactctgggtgaggttttatattcttagattttaatggccataaattcagccttctaattatcactatttttttactccactctttcatttgtcctgcacaaactgtaatttaccttcatttcatattaccttttgtgctacagcatttatgttagagcatatttgatataaaaattttgaatccttaaataatctattataatttaagaagattaaacaaatcaacatgaaattttatgtctttaaaataacacatttgtttgcgaaggcagccataatcaagtaccgcacactgggtggtttaaataacagaaatttatggttccacagatctgaagcctaaaggcccaaaatgaaggtgccgtcagagttggtttcttatgaaagctgtgaggtaattatctgttccaggcctctttctttggtttatagatggctatcttctccctgcctcttaacaccatcttctctttttgtctctgtgcccaaatttcttcttataaaggcactaatcatattggattggggccacccctaattacctcattttaactttattaccactgtaaacatcctatcttcaaataagatcacattctgaggatctaggagttaggacttttatatgaattttgggggacacagctcaacccataacagagtaaatcttttctaatacttcattcaccaaattattctaacatttcgggttatgatttagtattcccttccataccacattacctctactaggcaggacatggaaatttggcaagtaaattttaatatcccatatagaaactctgagctctagaacttattagggagaagttctttgtgtttgtgttggctgtgcggtatctttgtattatcagtaagaagagaattgagagaaaatgccaacaaaactgggaggtgagtagagactctgtttattccaactggtccttttccttgacttttctcttaatttccccatccttcttttccaaaataaatattcatttaatgtgttgtttcagccaaaatgattcagagtttttgagaacattatcaagaagtacattcaaatccaaatgaaaaggcttttcctttactcttggattaaaccaaagtcttctacaaatccaaaataaaattatgccagactaaaataatccaggtgtataaattgctacagtttctcattctatctccccccgtatctgatcttccatcatttaccagggttaatgataactgaaatgatattacttgttacttttagatgatttattcatgttccatagaagcagaatggaggttctaatattagggcaaattaaagaaagtagtgttgcatgctcacaggtgagaagagacaaaagttatgaatttttccccccaaaaggtagtaaagcagctacaatgttatgaagtgttctttggtgacctaccagaaacaaaataatagtttgaataaagtataagcttaaactagtataacatattttatgatttctagagaaataataggcatctgatagagattttttatttgtgtaaaaataatgctcatgtgtttgagatgtgagagtgaatgtgtttgagatatgagaatgaattgtgaatgaatgagagtgaatgctcatgtgtttgagatgtgagaatgaattgtgcttgcagaaagccagtaaacagatagttcaatgagataagagctgtcttaggagattgtacctttttctgaaagagctgtggtaaggctgacaggtcaagattgactgactggctgggccttcaccaggtgtgagaagtcttagtaccattgttggtcccaggacttctcttccagtaagctcattaaaatgttttatttttccaacaccatcaccaatttgagtttcattatctggaatatcttctaagttttttgctctgatgctggcatcctgggcaaagtccagatagctcaggcctgtagtgccgccagtacatacaggagtgagaagcccaacagtttcaattccgtgatctttatggttttaaatggtaaattgtaatgccacatgaatgtagcgttttatcctgaattttagctaagtaaaacttcagagaattaagggaatgatttttttctcttttttatttgacagggtctggctctgtcacccaggctggagtacagtggcatgatcttggctcactgcagcctctgcctcccaggctcaagccatcctcccatgtcaaccttctgagtagctgaaaccacaggcatgtttcaccatggccagctaatttttgtattttttagtagaaatggggtttcgccatgttgcccaggcctgtctcgaactcctgaagcacaagtgatccacctgcctaggtgacccaaagtaatgggattacaggtatgagccactgcacccggtcaggttattataaaattattgtcttttaaaccttagtcaaaaggctcaatactgtttctatgagcaaagagaaatttcatcatggtttgatctattaccaacatttttcaacattatatttgtagattttatgaactctgtatgttaggaagaagttagcataacatttacattcatgccttttgccataaaataccaaaatattaccatctctgttgtttggagtcagcaaaagtctatctgtttgatgaatatgacaatcagtatttggtacaattccagaactggaacaatctggaaccccacacatggaaaacaatatttgggggtcacactgttatttccatcatcttcgatttagagctatccttaatttcacccatggacttctgaggtaaaaataattctgaatgttgtacaaaaagacattagtttaaagtgttgctttaacacttactagttcagaataattatgaggaagaatttacttaatatatatgagtattgcttgtaaatggaagtaaaactattttatgtaaaaatattgacaatattttgtcattggtttgtgtttcttagttttgacaatgtctcatgttttctctacaatgaagaagtatcccataaaagaaatacttatttaaaaagttctttactccagagctatgtatgcttttttgcacagacttcagtctttacttaatgtggttagaagtttgaatctgaaattttagcttgataatgttgtctttttattgtggttgaagaagttttattatctcttagagggatgtacttagaatccattagtgaatcaatctaactagagatgagaaatgttgagagatatgatccaaatgaaacataaaaaaacactaaaaactcttctaggtattctggtaatacaaaaatgtgttaactttattaacctcaaattttagtattgtttaaatcgttattttggtattaaccactgagaagagatctctattacttttgcaccttcagttaggaaaactaaaaccctaacaaatcagagtcagtatttgattcacttattcaactcatggaagaacttggaagctcagttatacacctggaattgtgataggtactgggataccaagatgaaaaatttacagcccttgaggttaagagatatttttagttgaggggaaaaaatgtttattgtcaagtaaggactaaagcagaagtctgaaacctatatgcaatgtttttatttatttatttattattattatactttaagttttagggtacatgtacacaatgtgcaggttagttacatatgtatacatgtgccatgctggtgtgctgcacccactaacttgtcatctagcattaggtatatcttccaatgctatccctcccccctcccccaaccccacaacagtccccagagtgtgatgttccccttcctgtgtccatgtgttctcattgttcaatttccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttataatcctttgggtatatacccagtaatgggatggctgggtcaaatggtatttctagttctagatccgtgaggaatcgccacactgacttccacaagggttgaactagtttacagtccaccaacagtgtaaaagtgttcctatttctccacatcctctccagcatctgttgtttcctgactttttaatgattgccattgtagctggtgtgagatggtatctcattgtggttttgatttgcatttctctgatggccagtgatgatgagcattttttcatgtgttttttggctgcataaatgtcttcttttgagaagtgtctgttcatgtccttcgcccacttgttttgatggggttgttcgttttttgtgtgtaaatttgtttgagttcattgtagattctggatattagccctttgtcagatgagtaggttgcgaaaattttctcccattttgtaggttgcctgtttcactctgatggtagtttcttttgctgtgcagaagctctttagtttatttagatcccatttgtcaattttggcttttgttgccattgcttttggtgttttagagatgaagtccttgcccatgcctatgtcctgaatggtaatgcctaggttttcttctagggtttttatggttttaggtctaatgtttaagtctttaatctgtcttgaattgatttttgtataaagtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgaggcctctgttctgttccattgatctatatctctgttttggtaccagtaccatgctgttttggttactgtagccttgtagtatagtttgaagtcaggtagtgtgatgcctccaactttgttcttttggcttaggattgacttggcaatgcaggctcttttttggttccatatgaactttaaagtagttttttccaattctgtgaagaaagtcattggtagcctgatggggatggcattgaatctgtaaattaccttgggcagtatggccattttcacgatattgattcttcctacccatgagcatggaatgttcttccatttgtttgtatcttcttttatttccttgagcagtggtttgtagttctccttgaagaggtccttcacatcccttgtaagttggattcctaggtattttattctctttgaaggaattgtgaatgggagttcactcatgatttgtctctctgtttgtctgttattggtgtataagaatgcttgtgatttttgtacattgattttgtatcctgagactttgctgaagttgcttatcagcttaaggagattttgggctgagacaatggtgttttctagatatacaatcatgtcgtctgcaaacagggacaatttgacttcctcttttcctaattgaataccctttatttctttctcctgcctaattgccgtggccagaacttccaacactatgttgaataggagcggtgagagagggcatccctgtcttgtgccagttttcaaagggaatgcttccagtttttgcccattcagtatgatattagctgtgggtatgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatgtgctggattacatttactgatttgcgtatattgaaccagacttgcatcccagggatgaaggccacttgatcatggtggataagctttttgatgtgctgctgaattcggtttgccagtattttattgaagatttttgcatcaatgttcatcaaggatattggtctaaaattctcttttttggttgtgtctctgcccggctttggtatcaggatgatgctggcctcataaaatgagttagggaggattccctctttttgtattgattggaatagtttcagaaggaatggtacccatatgcaatgttgtggaagaagttcttctgggtgggaattcaggaggaagaaaggggttgggaagactttatagtagggttagtattttgaacttggtatttaatgaaaaataggatcttttctcatttatttttgtgttgcaattatgggaataaatacaacaacaaagctgtttttaaaaatctgatctgaatccaagaagaaatgggtgctcaggctctatcctccatgtgagggagacaggagaaaggctgattttattaaaatggcaaggaaagagccaaagttggagggtttcagagatgtttaagctttttgtggtggggctccctgggtgtgtggtggtgatgaggggagagctgcatgaatgcattttggggtgaaggaatcctgagtgagaagactgccacagttgtgaggagcgtgggaatggcagctgcaggaggctgtggggcggccactccaggataggggtagggtcttctttcttgagacctggaggacgtgggcagggatcacctctcttgctgcatggcttacctcgagcagtctctactgatattttttcttttctgtcaaacataaaacatcagacaactttctagtaaattttctaggccacaccagtgatgccctgtcctggaatgcattaggatcaccttgggagctttttaaatcacagacctgcagaatcttcatgggtggatcctgggaattcatattttttataacagcttgctgagatgtaattcacataccatagaattcatccatttaaagtgcacagttcagtggtttttaggacacttagccttctgtccctatggattctgcatctgtggattcaaccaatctaatattcagaaaaaaattccgcaaaattctaaaaagcaaaacttgaatttgctgtctgccaagtattatgttgattccacatgagtggagtgatgtgctggcattgcattaggtatttgatagtataagtaacctagagatgacttaaagcagtggtccctaacctttctggcaccagagaccagttttgtggtagataatttttccatggactggggaggtggggatggttgtgggatgattcaagcacattacatttattgtgtactttgtttctattattattccattgtaatatgtaatgaaataattatacaactcaccataatgtagaatcagtgggagtcctgagcttgttttcctgcaattagatggtcccatctgtgggttggagaagacagtgacagatcatcaggcattagcttctcataaggagcccacaacctagatgtctccctgtctcccaagtgcagttcacaatagggtttgcactcctatgagaatctactgtgctgctgatctgacaggacgcagagttcaccccgtaatgtgagtgatggggagcagctgtaaatacagatgaagctttgctcactcactcgcctgcttacctcctgctgtgtgacctgattcctaagggaggaagttggccagaggttgggacccctgatttaaagtacaacatatcctcaaataacatctttcattcgatgttgtttcattacaatgttaatgagaaaaagatcacttcctaccagggcccctgtctgcagagtctgcatgttcttcctgtgtttgtgtgggttctctccaggtcctttgttttcctcccacatctcaaagctgtccctgtgcggttctttggcatgtctatatggtcccagtcagagtgagtgtacctgtgtatgagtgccttgccatagaagggtgtcctgtctggtgggtgcctgtctagcacttgcaggaatgaaatctggccacccttgatcctgaactggaataattgggttggtaaatgaatgaagaaatgaatataaattattgtcaaacagaaatctgtaaagtatatgataatcatacaaatgcttgacaacaaataatatgctaccaaagtgctcagtgagcctccctgtttgtgatcattttagaactgagcagtggcaggaggtgctcctttttcactttgcaaacatttgttccttgatataacccatcaccacgactattaccacagtcactcactgactcaccactaattggttaaataattttcttacttgttgatgtggtttggctgtgtccccacccaaatctcatcttgaattcccacatgttatgggagggacccagtgagaggtaattgaatcatgagggcaggtctttcttgtgttgttctcgtgatagtgaataagtctcatgagatctgatggctttagaaggtggagtttccctgcacaagatctctctctctttgcctgctgtcatccatgtaagatgtgacttgcctctctttgccttctgccatgattgtgaggcttccccaaccacatggaactgtaagtccaattaaacctctttcttttgtaaattgcctttctcaggtatgtctctatcagcattgtgaaaatggactaatacacttgtctttattcatctttcttaaatatgtgtatagctcacatttatttcagtgtttaatatgagaagtgtttgtggtatttattgagaagtttggtgatgtttttatgaccagaaatacgccatagaaactccacccttatttatatcacttcgctatagtagtaaaattgatttgttatacatcatttcacttaaagtcacagtttccaagaacctatctaccatgttaattgagggcttactgcatacaggaggatgtgtgtatgttatatgcaaatactatgccattttatatctgggacttgagcatctgcagattttggtatctgctggtggttctgggaccaattactcatgggaactgagagacaactctacattcacaaaatgttatgtaactatcaacacttatgacatttttgccattccaaaatgaaactctgtgctcattaccagtcaatctttattcctcccttccctatcctcaggcaaacacgaatgcactttctgtctctagggctttgcctgttctggatatttcatagaaatggagtcatacaatatgtggccctttgtaactggctgctttcactaatgttaatgtttttggggtttgtacgtgttgtagcatgtctcagttcttcattaacccttattgctgagtaatattccattgtatgggtgtgtcacattttctttattcactcaccagttgatggaggtaaaagctgttttcacttttaaaataatggtgctgtgaacatttgcatacaagtttttgtgtgaacatatgtttttacttgtattgggtatgtacccagaagtggaactggtgtgtacccagaagtggaatatggtaactctatgtttaactttttgaggaaattccagactgttttccaaggtgactgcactattttccactcaccagcagtgtatgagtttcagtttttccacattcttgttattttgtgtatttttaattttagccattgtagagggtgtgaaatggggtcttattgtggttttgatttccctaatgactaatgatgttgagtatcttttcaggtacttattggctttatgtcaatatggaagatacacacatatgtatcttctgtacacacatatgtgtatgtatcttctttggagaaatgtctattcaaatcctctgcccattttcagtgggcttatttgccttttcattgctgtgttgaaagggtccaggtttttaaaataatcacctcagatgacattgttccagataatcctcagatgggctataggaaaccacaaaataagcagtcaatgcacctaacttggacaggacactgaagcttttagtgtgaaatgcacgcattagtttcgtacagtgctttacttcattgtaacaggtaaagaaatctcagattcaggaaaagatgtactaacacatctgttacaagtgggagcttaaaaaatttgtggaaaatggaattaaaagataaaaataaaaaacacaaactttatttctcaatgtaacttccatcacagtcaagacactttttaaacgatgatagcagctattagtctatccctaaagaactgacagttttagaaattaaaccatgtcaatgcagtcttgtttttacattattaactgaagaaaaattggtgccctttacagatttgttaagatgaggaaacaaaaagaagtcagaaagagccaagccaaatcaggacagtaaggtggatgcctaatgattccccatagaaactttcataaaattgcccttgtttgatgagatgaatgagtaggagcatagtcatggtggagaaaaactctctggtgaagcttttccaggcatttttctgctaaagctttggctagtgtctcaaaacactcataataagcagatgctatcattttttttgctttccagaaagttaataggaaaaatgccttgagaatctccaaaactgttgtcatgataccttctcttgaccatcaacttgtggtttgattgggccactttcacttctcagtagccattgctttgcttgtgctttgtcttcaggatcatactggtaaagtcatgtttcagctcctgttataattcttcaaagcagtgcgtcaggagcttgatctcatttgtttaaaattttcattgaaagccctgctgttgtctgcagctgatctgggtgcaatggttttggcacccattgaatggaaagtctgttcaactttaatttttcagctagaaattgtgtaagctgacccagctattgtttctgctgttaattattggtcctcttcctatcaagaagaatttttatttgtaaattgatgtggatggtctgttgctgcaggcttcatcttcaccatcatctcaccccttcttaaaatgaattatctatcataaaatgctgatttcattggggctttgtcttcataaacttttgatgctttttgtaaagcatcaatgatttcaccattcttccacctgaacttcaccataaatttgatgtgtgttcttgcttcagttttaagcagaattcatgttgctctaaaggggctcttttcaaactgatgccttattcttcttagtgcctcaaactagaccttgttcagatatgttatagcaagttagtataagttaattttagttccaaaaaattttgaaacctgtgcatagtttttccacgtatgcattttctgtgaactttttgaggacccgctgatgtttcccactggaaatttttttttgaggaaaaatgcattttaaagtccctgaaaattattaggctctattagtccaatgaaaaatgatatcaacttttctaaaaaacatttgatttaatggaattatctgttaggtatatttatccttcctttgccaactctaatactatcatttatctgcacactactcttagatttaggtgctctttgagctctttcatgacatcatttcttatctcaagctaaattctttctctggaggaccttatctaatcctaggatgttgtatctctagctctaatctctcttctgggctccagacctgtatatcctcttgtctacaagacttttacatctgggagtcctataagtagtttaaattcaatatattcaaacctcaactcattatcaatctctgtaagatcctttttctgtgttcctgatttaaagacactgcagctcagtcattcaagtgtgtggaaacgtagaacttttgtaggctgggctgtctgtattacaagctcctgcggtataatgagtatttcttcagccacatcctttaaattttaatttaatagttctgggattggccagggaatacaaactttataatttccccaggtgcttttgataatcaactggtttggaagaccactgttagagactctgcagttgaaatatttcaatcccccaatcctttttttcttttattatactttaagttttagggcacatgtgcacaacgtgcaggtttgttacatatgtatacttgtgccatgttggtgtgctgcacccattaactcgtcatttaacattaggtatatctcctaatgctatccctcccccctccccccaccccacaacaggccctggtgtgtgatgttcctcttcctgtgtccatgtgttctcattgttcaattcccacctatgagtgagaacatgtggtgtttggttttttgtccttgcaatactttgctcagaatgatgatttccagcttcatctatgtcactacaaaggacatgaactcattattttttgtggctgcatagtattccatggtgtatatgtgccacattttcttaatccagtctaccattgttggacatttgtgttggttccaagtctttgctattgtgaataatgccgcaataaacatacatgtgcatgtgtctttatagcagcatgatttataatcctttgggtatatacccagtaatgggagggctgggtcaaatggtatttctagttctagatccctgaggaatcgccacactgacttccacaagggttgaactagtttacagtcccaccaacagtgtaaaagtgttcctatttctctacatcctctccagcacctgttgtttcctgactttttaatgatcgccattgtaactggtgtgagatggtatctaattgtggttttgatttgcatttctctgatggccagtgatggtgagcattttttcatgtgttttttggctgcataaatgtcttcgtttgagaagtgtctgtcgatatccttcgcctacttgttttgatggggttgtttgttttttttcttgtaaatttatttgagttctttgtagattctggatattagccctttgtcagatgagtagattgcagaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacagttaagtttttaatccatcttgaattaatttttgtataaggtgtaaggaagggatccagtttcagctttctgcaaatggctagccatttttcccagcaccatttattaaatagggaatcttttccccatttcttgtttttgtcaatcccacaatctttttgagttttatcttgctgcctctgccctggattatttccttatgtcttctacatgatctaaagaacttctacaggaactactttgtgtttcttctctattcaatccttcctctacaagctactagaattatatttctaaaatacagatgggataatgtcacatgtgtattcaaaatatttagatgatgtattagtctgttcttacactgctaataaagacatactcgagactgggtaatttataaagaaaagagcttttattgactcacagttccacatggctggggaggcctcataatcatgttggaaggcaaaagaggagcaaagtcatatcttacatggcggcgggccagagagtgtgtgcaggagaactcccctttataaaaccatcagatatcgtgagacttattcactagcacgagaacaggatgagagaagccctcccccatgattcaattacctcccactgggtccctcccatgagatatgggaattatgggagctacaattcaagataagatttgggtggggacacagccaaaccatatccttctgccctggcccctctaaaatcttatgtcctcacatttcaaaaccaatcatgccttcccaacagtcccccaaagtcttaactcattttaatattaactcaaaagtccacagtccaaagtctcatctgagacaaggcaagccccttctgcctatgagcctatcaaatcaaaagcaagttagttacttctcagatacaatggggatgcagacagtgggtaaatacaccagtccaaaatgggagaaataggccaaaattaaggggctacaggccccatgaagtctgaaaaccaataggacagtcattaaaccttaaagttccaaaatgatctcctttgattttatatctcacatccaggtcacactaatgcaagactttgcagtgtccagccccactcctggctgctttcatgggctgctgttgagtgtctgtgtcttttctaggcacacagtgcaagctgttggtgaatccagcattctgaggtctagaggtttgtggccctcttctaacagctccattaggcagtgccccagtggggactctgtgtgggtgctccaatcccacatttttcttctgcactgccctagcagaggttctgcatgaggaccccgcccctgcagcaaacttcttcctgggcatccaggcttttcatacatcctctgaaatctaggtggaggttcccaaacctcaattcttgacttccatgcatccacaggctcaacaccataccggagctgccagtgctttgggcttataccctctgaagccatggcttgagctgtaccttggccttttttagccatggctagagtgactgggacacagggcaccaagtttctaggctgcatacagcagtgggccctgggcccagcccaggaagccattttttcctcctgcttctccaggcctgtgatgggaggggctgctgcaaaggtctctgacattccctggagacattttccccattgtcttggtgattaacctttggctcatcattacttatgaaaatttctgtagccagctggattttttccccagaaaatgcgtttttcttttctattgcatcatcaggctgcaaattttccaaccttttatgctcttcttcctcttgaatgatttgctggttagaaatttcttccaccagataccctaaatcatctctcaagttcaaagttccacagatctctagggcagggcccaaatggtgcgagtctctttgcatagcaagagtgacctttactccagttcacaagaagttcctcatctccatctgagaccacctcagtctggacttcactgtccatatcactatgagcattttggtcaaagccattcaacaagtctctgggaagttccaaactttcccacatcttcctgtcttctgagccctccaaactgttccagcctctgcctattatcctgttccaaagtcactttcacattttaaagtatctttatagcagcaccccactctactgataccaatttactatattagtctgttcccatgctgctaataaagatatacctgagactcagtaatttataacaaaaggaaggaagtttaactgactcacagttccgcatggctgaggacgcctcacaatcatggcggaaggcaaaagaagggcaaaatcacgtcttacatgacagcagacaagagaacatgtacaagggtatacccttttataaaaccatcagatctcatgagactcattcactatcacgaaaatagcacagggaaaaacccacccccatgattcaattacctcccaccaggttcctctcatgacacatggaaattatgggagctacaattcaagatgtggtttgggtgaggacacagccaaaccatatcagatgatttcctagttcctataaaataagtctaaacttcttagtatggtctttctggtttctcacaatctggcaattatttacttttgcctgctcttcccctgccacttcctatcttagtactgtaccattttcttggatttctgacaaaatcatggcagttttagttctacaataaaccatgatacattcactacattgactttggtgtaataatatggaaaccaatcagaagtagtgtcttagccttttcaggctgctataacaaaaataccttagattgggtaatttataaacaaaagaaatttatttctcacagttctggaggctgggaagtcaaagattaaggcaccagtattaatagatttggctttctctttgtttccaaaataataccttcttgctgcagcctcacatggcagaggggaaaagggatgaactcattccctcaagcccttttataaagacactaatcccactaatgagggtggagccctcatgacttaatcattttccaaaagtccctacctcaatatcattggattggggattaagtttaaacataaattttggagcaacacaaacacttaaactatagcaagtggcctcttcaaataatttatatttattatataattcttaaacatagcaagcaattatacaatataaaattattgaatgtatttgaacaaaaccatcttattaatacacaacactaacacatgcgtatacacattcctttggattgggagtacagcggcatattattttaatctctatgtgttgtctgccatggtcttttagtgcattgtaggtatagttgctctgtttttctccagtggctacctaggccatcagtgttgattggatttagtataaaggctttcgttagagcttcttgtctgagacttaaccttccagcattagcagagggaaagaaaaacatgcacccttccagctggagcaaatgttattgagctataaaaatagcatgcagtttagtgaagttacatatttcggttatatatgtggttagtgcactttctggctttgttgtcctcactcaactgtttgcaggtttacatatatataaattaggtaacctaatgtgttgattctaggtataatttttgtacatcaggctctgacacaccacctacctggctatagttttgtgtatatgcccaataagcaaccctacagtgtaattcctgttaagatgtgggatccttcatgggatacaggcagctcttatggatttacactgataaagtactatgtccagaactgggactttgagtcttaatttatactcacaaacattctaaataccttttctctacttgtctaatatgtagtcatttgcatcttgaatatctgaaacctaaacattccaagtcttccagccttctatgcaaaccccttcttttcatatttaaataaattgcttgaattcccatcacatatacagagagatctgatctctttcttccatgttacccagcaccatctttccttggtatatcttggaaatgttggagcatggcaggcgattactgtttaccagtatccatgtcctctccccaggggaagattgttcttctttgctctgttgaagaagtatatctttgttatgtggcttgctttggccagtaaaatatgagaggaagtgctgtgtgtcatttcctgttgcgttgcctcattctcctttctctttgccaagaaattgttgctatttcaaatagggattgccttgatggtcagcatgaagatgatgacaatgtgaacaagagcccctagccaatctataatgaactctaacatgggagataatcaaacccctgcactttttctttgtttgtttgttttgagacagggtctcagtctgtcgcccaggctggagtgcagtggcgtaatcttgcctcactgcagcctagacctctctggctcaggtgaccttcccacctcagcctcccaagtagctgagactacaggtgtgtgcgccaccatgcccagctaacttgtgtgtgtgtatgtgtgtgcatgtgtatatctatctatctctatatatatctatatatctgtatctgtatctatatctatatatctatattttgttgtttgtttgtttgtttttggtagagacagggtttcaccatgttgcccaggctggtcttgaactcctgggctcaagccatccacccaccttgacctcccaaagtgctgggattacaggcgtgagccactgtgcccagcccaaacctttgctcttttataccactgatactttggggttgttattacagcaagccctaggaccaaaaacaatgcctgtcatgtagcagatgttcattaaatgcttgataaatatatgaacttgagcaaggcactttccagaaatttcaaactggaatacactccatcttccttcttcaatgtgattatgtgcctggaaatttgtaacatgagataaagatgcaacgctgtcttaaagcataagtttttctaaaagacatttgaggaaaaaagcattatttagaaattaaaacagacacatctatcttatggaatagtacacaaatctcaaaggaattttaaaggaaaactagaagtcttctaagaatattaataccatttgggtactgcctcaggttatttttccaagaacccttggacgtgataatctttgagtctcagttttatcctctatgaagtacaatatttggacaaagatggaggtgtcaaaggctttttaggaggggttatatggtgtgaacagcagtgaactgagagccagcagccttgggcttcagtccttgctttgctgtataagtataggactgtcaggtcatttaatcttgaaatttagactcaggaaaagatgtactaacacttccgctatctgtcccactggattttttgagaaacaatacattttagaatactttgaaaattattaaactctattattccaaatgaaaagcgataggaaattcttaaaatcttttcaaatttgaatactttatttatattctgtttccactgggtggcagtatttcacttgcactctactgtaatttttatagtttgtatataatcttatagaaaaaaatttgataactattttaaataagtacctcattgtttcccaaccttatctttctcctttctcatcccatgcactccctttctctcaaagaattcagataaaccactaccattcatttaaaaaatctttaatgaagtaaatgtgactgcagtctctttaagcttagcaatttattaagaacttctgcttcatttgggaatatgtattagatagcttaattttgctcagatataagcagattactttgatgtaggtaattaaaagtagttaaaaataacctacaaaaatcttgctattggttctttatgacaattttaaaataatgtttttaaaattaagctgatggatgtcctttttaactgataataccagtgatgcctattttatcctatcatcagaagatcatcacacagttgttatgtgaaatccttgatgtttatgacatgttcgagaaacactttatcatggtttcatatcagttaactttgtgtcagaatttcctagaaaattagtcccacaagatgagttaaataagaaaagtatacttgtaaagcttggtgaataattccttgctgacttttgttgatattaaggttttgaggtaagtaatggcataaatgtgttagagtagttgtatcctacagcatgaagatcagagtcattcagcagcgtaatggattgctagttttcacttgtaaagagactatcagtgcaatttttaaactgacataatcactgtattctgtataagagagtaattgccttgaaaaattaggctgtttaaagttgtttataaaacttgatgtagatagaataaatatttttaaatggctaaaatgctatgtaacattttaattgttttgtgccaaatctttgctgttttcaggaagaaaaaaaggaagtttttttttaaagaatatctaaggtcacatgtggtggctcacacctgtaatcccagcactttgggaggtcgaggcgggcagatcacaaggtcaggagatcgagaccaccctggctaacacggcaaaaccccgtctctcctgaaaatacagaaaattagctgggcgtggtggcggacgcctgtagttccagctacttgggaggctgaggcaggagagtggtgtgaacccaggaggcagagcttgcagtgagtgagatggtgccactgcactctagcatgggcaacagagcgagactccgtctcgaaaaaaaaaaaaaaaagaaacatgtttatcaaatttgctgataagagaaagttgggagagatagctggtattttgtttaagatgagcactattcaaaatattttgtcccacagataggaataaaccaataagaagagattaataaaagttaactcttacatttgcattaagttattttataaaaatagagaacaagagaaattgcattgatcacaagtcaaagagaaaagagtttgtagtttcagttttagggtaaagctagcatggttgggcaggggttgggcagaaattgtaaactatgtgagttactgaaaaatcttgtaccttggaaacacataagcccaagtggagttactgttattatggtcttgtcttgatacatataggtctgaacaaggttattgttaaaataatttgagtttgttttagtagtatacctcttttgcattagtgtacagttttgcaaagactaggaggactggaagaggtgtaaggtaatagttaagagctgttactggttgttgaacatcaactgtgatagtttctatgttaaatcttttaaatggattatctcattgaattctctcacaacagccctatgaggcagataggcatttttctttttctttttttcttctttttgcaaataagaaaacagacacagtttgcttaaatgattttctcattactgtttacaaagagtaaatcatacaacttggaatgaagtctgagtctgaatcttgagcccatgcacttaactgctataaaatactgtctttcaagaaagaagttttacggaacctacaaaggagagtttcgacagagggtggtcactctcattaagtattgcacacaggtaaagaaatgtgaaaaattattatggaaactagcagatgactttgtttaaagttttttttccatagagcattgagtgcagatgccatattgcaggacgctgaagaatgaatagggaagtaagagtgctgggtgagcacagggctagctagaggcaagagaaggcaataagagatgctgttgggcagagatgattggaaacctggaagaggagggatttggggagatttaaagccaggaatagaatgagaagattctgtgttatagcgaagaggtataagccagacacaatcaagaactagacaaataactggtactctctttcttgctcgctttttttgtgtgtgtgtgtggcaattggcaagttttaagagtacattaaaatgcttctacttttactgctgacttgtttaaataaaaatcagttgcaattaaaaatgtaatacatggaatagttttgaattaaatcaggtggagatgtgatgcctaaggaaatatgatttatcctccaaaattacttgctggagaaagataatgtgttccagtgcatcactatcaccattatttgtttctctccactctccgcagccaacagaatcctgatttctttaggtagcaatggaatgaatcattgctataaccagttatggtaatcttattcctcttgggtagcaattggcctagggatgttaatgtcacctagttctggctcatgagatatgggaaggcaaggctctcaggaatgcttttgcttttctcatgaaaaggaacaaaggcttagctggcatggtccttcacccttcttcatggttaggactccagacatgatgcctagaggtgaccctatgaacatcaggttagaagcttgacaaaagtcagcatgtgaaggacggcaaagcagacatttaggaagatcttggtgttgaccagctctgggctacctggcttctcacctctagttatgtaagacagagtcttatattaatatttgtttaggtcactgttaaccagattttctgttgcttgcaatcagacatagttctgaaagaaagaaaattcttcttcagttgtttcttatacatgtgtagtttatgattacggcaaattttaggataatctaattgccaggattacgccctcttttattttcagtttataatgtcttattaaaaggatttaaaacaacctagtttctcaatttcatctttaaagattgtatttggtcactttatcctccatttcaactagctgtatatttctagtttctttccaatgcatatgtgatattcatgtcaactgtatgcccttaatattcgtaaaatatttttgccatggaagaaagcaatgtgtgaagctatcagggatggtttttgcagcagaactagatcagctcaagggagtgttttactaaattatttagtccacattctggaaaatcttaattgaagacatattttatgccaaatatgttcttactatgaaactgccaaaatgcatgtttacctagctagctgggttaggatggaattaaatgtaaaatatttctcaatgttctgaagagttccaggatgaatagttatattctgtgttctctgcaactaaatgttggacactgttgagatatagctactagggaagttatctccttctgcctcagcattatttgtatatttaagtgcacaaagataggtttttttttgtgtgtgtgggctttaaggtatacgaaatgaagtagcaaaatgtggttagaaaaatttgcttatacaatgagactaatactgatatagatgctttatctatttttaacatatgacttggatttgtgttcaggctatgaatagggaaatttctagttaattctgagagtgccatgaaggaaaaaaaatgaactaccagtcttaacaacaacaacaaaagtctagacactgccatgaaaattgttttaatgacagtaggaaaatcaacattaaagattattagaataattaaatcaaaatttattaaacacaaaaataaacatctctgcatgtgacatagaaagtaaatttcagtatccagcaaatgtttccaataatacagagatggcacattttaataggttgatctttagtcatagtataataaactgccaaaagttttgatcacatcaaattaggtggtcaaatcttttggcatctctttagattattatcacattgaatgaattattaataattcaatcttgatggtttgagtgaagcctattaagagtaatctgagtttcagatttgattttaaaattatatttcaagaaagctctgttattgtgtttaattttaaatgaaagcataattgtctggtaatgccattgtggaattttttcagcataatctacaacctttgaaatgcttcctattttgaaatatgtttatcatcatgaatcattaactaatgtaaatgctttgcattaaaaaatgccttcttaaatacagtaatggttagagatgtgtaattctgttcttcactttccaagtcatgaaatccagttgttttacagtgctggctttggaattcagtcagtaatatggacatcctatgggccagtgttgtcactctacccactgaaataaacagatttgttcttatccatttcctaacttgaatcatacttattcatacattcttgtactctttgtcatgtgtctaaagcatatcctgttgttcatcacagcatagcacccattccctctattataaatcctttctcagtaattctagcccatactgatattaccttctccaacatagtccatttttagttttctacattcatatgcacaccacaaacctatcataatttttctctcccagtgagccagttgatccttagaatacaactcagcatagcctttcagtcatcatacatggaaagtggcatttgagatgaggcctatttgcaatcctttggtactctgttcatgtttcagttaacatacagttttaaaattattttcataatttagtttcgtttcactcactaatggcttcctataacttttatctaatcaacagaagttcatttattgtgggaatcatgttttaaacttcatttattaccccttcctagcataggactggatacataacaagctctcaatcatacttgattattaactggattaaattggaatattttgcatatatgagtgtattagtctgctaggactgccataacaaaataccacagactggatggcttaaacaacagaagtttattttctcacaattttgatgactagaagtcatagatcagggtgctggcagattccgttactggtaatgcttctcttcctggcttgcagatagccaccatctgcctgtatccttacggtgtttcctcagtgtgcttgaggagagagagatctctggtgttttttcctcttatggggtgtaatggcattaggacttcactctgtgatcttgttttaccttaattaaggtcctatgtttaaatataatcacattgggaggtcagggcttcattatataaattttggggtgggggagacacaatacagtccataacaatgggatattcaattattagtattttaaaaaatgcacgattaaattttacttttgcttttaccttgttttttttttttctattatgtttcttcaaattaacttggtataagcctccatttcatccatgtctttttataatcatagaagttttttgttgtactattttctgctctgtatggtttgacagttgttaattaagtcttcccttaaaattcttagctggaactgatcaaggtccttctgggagttttccctcaaagatccccactggaggcttggcagatagtgaatccaaggctaagctttgtcaatcactccttctgtttcctttttctgcatgccttgagcttacctttgagagggctaacgcgtcatactggactgctaaacaactgtctcaaggacatttgtctattttctcatagaatttgaagcataacaaatgtctcaaggacctttgtctatgttctcataagcatttgaatgaccttaactctaattgttgagaacaaattgttgcgggaggtcagggaccctgaacggagggactggctgaagccatggcagaagaacgtggattgtgaagatttcatggacatttattagttccccaaattaatacttttataatttcttatgcctgtctttactgcaatctctgaacataaattgcgaagatttcatggacacttatcacttccccaattaatacccttgtgatttcctatgcctgtctttactttcttaatcccatcatcttcgtaagctgaggaggatgtatgtcgcctcaggaccctgtgatgattgcgttaactgcacaaattgtttgtacagcatgtgtgtttaaacaatataaaatctgggcaccttgaaaaaagaacaggatagcagcaatgttcagggaacaagagagataaccttaaactctgaccgccagtgagctgggcggaacagagccatatttctcttctttcaaaagcaaatgggagaaatattgctgaattctttttctcagcaaggaacacccctgagaaagagaatgcgtccctgagggtaggcctctaaaatggccgcttcggggggcggccatcttttatggtcgagccgtagggatgaaataaaccccagtctcccatagtgctcccaggcttattaggacgaggaaattcccgcctaataaatttttggtcagaccagttgtctgctctcaaaccctgtctcctaataagatgttatcattgacaatgtgtgcccgaaacttcattagcaattttaattttgccccggtcctgtggtcctgtgatcttgccctgcctccatttgccttgtgatatcttattaccatgtgaagcatgtgatctctgtgacccacaccctattggtacactccctccccttttgaaaatcactaataaaaacttgctggttttacggctccgggggcatcacggaacctgccgacatgtgatgtctcccccatacacccagctttaaaatttctctcttttgtactctgtcccttatttctcagatcggctgacacttagggaaaatagaaaagaacctacgtgaaatatcgggggtgaattttgcccaatatctggctgaatttcccccaataacaaatgaggccaacctattatgcaccaagttatgagcccactgagttgtaattctaccataattctgtgcagtaattgtcttaggctgtgtggctcattttttgactaaaagagctagccaagtttacatatacagatgtacagaaaggctggtgctcatgtatccaaaatttcacaatattatttgtcatcaaaataacaataatcatagtaatcagttttctaccttgaaacacaccacacacacacacacacacacacacacacacacacacacacacacacacacatacccctacctgtgccagatgtttgattcattactaggatcatactatcatatttgatattttctttcctgatcctccaaattctaacttccttatcaaatatattttcatttattttagaaaaccctgttatctctaattctagtacctgttttaatcattgctgtatgggttacttatttgtctttataattcctatttctattattgatatttttaagggaaaaatcataattgtatatgtgtatggggtacattgtaatgttttgatatgagtatatatgtggaataagtaaatcaagctaattaacacatatcacttcacttattttatgtggagagaaacctttgaaatttatactcttagctacttccaatatattattgactttagtcaccctactgtgcaatggatctcaaaaacttattccttctgtctaattgaaatttctcctttttttgatataggcatttattgttatgaacttccttcttagaattgcctttgctgtgtctcataggttttgatatgttgtatacccattatcatttgtctgaagatgttctttaatttcccttttgattccttctttgacttattagttgttcaggagcatgtttaatttccacgtatttgtaaattttcccagttttctcctatgattgagttctagtttcatatcattatggtaggaaacaatactggatatgatttcagtcttctggaattattaaagacttgttttgtggcttaacatatgatctgttctggaggatgttctgtgtatatttgggaagaatgtgtattctttgccatatatttctgttaggtccatttggtctaaagtgtaattaaagtccaatgtttccttattgattttctgtctaaaaaatgatgttctgtccaatgctgaaagtggagtattaaagtcccctactattacagtatttcagtctatctctccgttcagattgcttaataactgccttaaatatttaggagctactatgttagatgtatatatatttataaatgttgaagaattgacacctttatcattatataattaccttctttgtctttctttactgatgtttgacttaaagtctttttcgtctgatagaaatatagctacctctgctctcttttggcttccatttgcatggaatatatttttccatccctttattttccatctacgtgtgttcttacaagtaaagtgagtattttgtaggcagcatctagttatgttttgctttttcaatctattcagtcactttatatcttttgattggagaattcaatccatttccactcaaggtaattatagtatgtaaggacttatcttactgccttttcataatttgttttctggttgttctgtgtatcttttattcttcctcttgttgtctttctttgtggtttgattgtcttctgtagtgatatgtcttgaatcccttatttttatattttgtggaagtataatagggttttgctttgcaattaccatgaggtttacataaaacattacctgtaacaggctattctaagctgttaccaacttaactttaatcaaatacaaaagctctccatgtttactcctccctaccacattttatgattttgatgtcaaagttggcaactttttgtaatttgtatcccttaacaatttatcaaagccacagttgtttttaatagttttgtcttttaactctcatgttagagataaaattgctttacacatcacctttcaagcaaaagactattttgaatctgactgataccactgaattttttcccttcatgtattttatgttattaattagtggtatgttttctcagcttaaagaactcactttaataattcccataagacaggactagtggtgatgaattcccttattctttatctcaggaactgtattctctccttccactctagaaatctgtttgtgaatgtggtaggttgtactgacagttggggaggaggagaagagagaaatattacagaagtgcataaaacttcacattaaatattaaaagatgcttgccatttactgctctttggtggtctcatgatcagggtattttgactatcttttattcttacatagtttttctagctggatcttctttcttctctttctgcatctcacctttccttcttcttgtcaatcttaacacctcttacttcatcctctccttcactgattgtatctcaggtttccatttcattagcaaggacagtttagctgtatctaagactacccctgaactcagctattttctacgtttgcattttgccattcatcaaagtgctcaactggaacaggattcatcatctcaaagaggcagttggttgaacaaaaagattttttgtgcgttttatttctttgtttttgccattagaagagaacatcaaagtgccgaagagtttgtaatgactatatcatgtttgtacaactttatgcaataatagcttccgaggtagtaacagatggggcatgagagagatcagatgtgggtgagttaatagttaaaattagagattaatgtgttagaatcaaagcttatgttcatatgctagaaatgaaacatttaaaataattaaaatccaaagaggatagttcaaataaaataatatgaataataattgtaaaatttattttgcttaaggagactacacctatccaatagatatttaaccaatataatttcaaaacttctggatttattaagaaatacacatattttaaccgaaactctcaaacttatagaactatgtaaaataatgagttagttgtgagtttttaaattctagggtttcttatttctgtggctttaattggagtgccagacagcagttcccttactcctacacatttactcacttcgtttgaaatcacctaacttgccttgatgaacaaataacaaagtagctaaaactgttctgaagaaatagatgtttttgttaattaaaccaataattttctacttttctaccaaaaatacagattagtttatcccaacatagtgagcgatttatatgtttactttttaaattttaactttgataaatttattttttaattttaacttttacagatttaggggtacaagcacagttttgttacatggacatattgcacagtggtgaagtctaggcttttagtgtgtctgtcacctgaatagtgtacattgtacccagtaggtaatttttcatccctcacctcttcctacctccccacattttgaagtctctaatgtctattatttcactctgtatgttcatgtatatccaatgcttagcttccatttataagtgagagtatgtggtattagactttctaagttatttctcttagaatgattgcctccacatccaaataggaagacacgaagtcaaactatccctgtttgcagatgatatgattttatacctagaaaacctcacagtctctacccaaaagctccttgttctgataaacaacttgagcaaagttttaggatacaaaatcaacatatgaaaatcatagcatttctatataccaacagcatccaagctgagagccaaatcaagaatgaaatcccatttacaatagccacaaatagaataaaatacctaggaatacagctaaccagagacatgaaagaattctgcaacaagaattgtaaaatactgatcaaaggagtcagggatgacacaaacacatagaaaaatattctatgctccttgataagaggaattaatattgctcaagtggccatactacccaaagaaatttatagattcaaccctattcctatcagcctaccaataaaattcttcacagaattagaaaaaactttaaaaattcatatggaatcaaaaaagagctcgaatagccaaagcaatcctaagcaaaaagaacaaagctggagacatcacattacttgacttcaaactatactacaaggctattgtaaccaaaacagtatggtacttgtaccaaaatggacacatagaccaatggaacagaatagagagcccagaaataatgccagacacctaaaaccatctgatttgacaaagttaacaaaaataagcaatggggaaaggaccctattcaataaatagtgctgggataactggctagccatatgcagaagattgaaactggaccccttccatataccatatacaaaaattaacacaaaacagattaaaaacctaaatataaaacctaaaactatttattattgatttctagttcaattctgttaatgtcagaaaacacaatttgtatgatttaaattttctaaaaatttgaagttgttttatggtacaggatatgttctatcttggtttatgtactgttgaacatgtgcattctgctatattgggtgctgtataaatgtcaactagataatgttggttgatggtgttcttgaggtttctaatatccttgctgattttctgtctaattgttctaacaattgttttgggtgaggtgttgaggtcttaaactataattctggagttttaaaattctttcagttctctcagttttttgctttacgtatttaaccaccttactgtttgatatatacacagttaaagttgctgtgtcttcttgttagattgatactttaaacattgtataatttcccctctctagtaattttcttttctctgaagtatactttatataatagtaatataactactcctgctttttgattaatgtttgcatagtatatctttttctatgcttttacttcccacctgtgtatataatttgaagtgaattgcttctagacagcatataattgattcacttaaaaattattctgccaacttttgtattttcattggtgtatttagactatttaacataattattggtatgttagagcctaagtttgccattttattttttgtttctggttgttttctcttcctcctttttctctgattgtgtggcatgtctggttcataattgaacatttttttagaattctgttttgatttacacatagaatttctatatacattatgtatattatatacctaacatcatagttgactggtatcaaccttttacgagtttgagtgaattttagaaaacttacctcctttttcattcgtttgtccttcctcatttgcaatataattgccttaaatatttcctttacatacatgtagaatagcatcagacaatgttagaatgtttgcttatttacttataattttgtttactgtgctcattcttcctgttttcaaagagtttctttttgtttagacatcttctgttagtcatttttaagataattcagcggcaaaattttcttagttttccttcataagcatgttttgattttccctttttttcctgaaggaaatagtcacaaagtaagattcttggttgacagttgttcttttttacagcacttgaaaaatgacacttcctttggtgacttctgatgagaaatctgctcatattagaatattttttcctttacattgctgtttttctctggctacttttatgattttctctgttgttagttttcagaagtttaaatatgtcatgtctcggtattgatttctttgggtttatgttgtttggactttgctcacctgcttgaatttgtaggttttgcctcttgccaaatttgaaaagttttccggcattattttcttaagtacttttaagccctactatcttttccctcttcttccaagactccaatgacataaatttagatcttctgttaatagtaccacaagtccctaagtgtctgttttttttttttttaattcagcctacttttctgttgtttgctgtttagattgggtaatttccatgattctatcttgaagtctgtgaattctttcctctgtcccttccatattgctcttaaacccatctattgagttttgaaaatttcaaatattgtgtttttcagttctaaaattaatatttagttcctcttttcatcttccattccattgctgagacattccgattcttcatttgtttgaaatgtgttctaatgggttactgaggccttaaaatctttatcacataattatcacataattctaacatcattgttctcttggtgttggcctttatccggcatctttttttttttccatttagtttgagatcttagtggttattggtataatgggtaacattctattgaaacctagacattttgggtattatgtaatgaggttagctcttttttttttttttttttttttcttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcacccggctaattttttgtatttttagtagagacggggtttcaccttgttagccaggatggtctcgatctcctgacctcatgatccacccgcctcggcctcccaaagtgctgggattacaggcgtgagccaccgtgcccggcctgaggttagctcttatgcaaacctttgattttaactgaattcttctgacaccactccagcagaagaatggaggtcccaccttattacccaggttcctcacactgtttccattcataaccaaaccaaacagactcctccctgagtggggtggtagttctaactctccattaggcctccattgatagctccctggctgagacagggaggaatgccttgttactgcttcctacatggcatccactgatggtcgggtgggaaggaggtggaaatcttgactttccactaggtcacctttgtcacgatctcagtggaaagaaggggcacctcgttactgccaaatggaggtggaagtccacctttccacttggactccactatattgccaacgatgatgctgaaagtttcagacccctactcatccttctctgacaccatgatagtgagtgggttgaggcactgcaatacagcttggcaaacaaaagtggaagtgtacccatgcttggcctttgctggcctgagtgggtgtggggccacattttttcagtgggtttgactggagtagtgtagttattatcaaacagatttctgtctggctaggcttgtcttttcatttggctagagagaatggacttttgtcatgttttctttttctgtccttgtgttaccaggttgctggcttcttcagatctaagtctgggatatataaggcaaaaagaaaatgcagggaactcaatacttaggtcttttcttaggtctcagtgtccctggatagtctgtcttcttctctttgtctttcaaagttatcttatgtttgtttatttataattttcagggttttaaattatacttagtgggaggactagggaaaagtacatttattccatagttctccatgcagaaatctccaaaaccaaaattattttactattcatttttgccatttcattaggtgaaattaaaaagacaataacccatcctctaaaagacattttaattattagaacatattttgaataactcagtttactatccatgaaagacttttaaaaatgttgcctaaaacataaatgtgtaaaaatgagtaattaaagaaatcactctaggaatgaagaattcttatgaagatgatgacacataaataattcttcttgaccattgtaatttatgaatatttgatctcttcaacaattatatttttaataggtaataattcaattgttgtaagtcaattatactgaccaatgggagccacagatattgttttatttaactaaaaaagtaacacccgctccttgtaactaatccaatcaattcaaaacagttgactatgacagttcccctccatccaattccatttcctagaagtaaccatatccagtttgtagtctatgtttacactttcagtcatgctctgctgcttcacttagtcactcctacttttccttttcagctcctctattcatcttttgtaagtttatccttctctcgctggctgttaaacattgaaaaactttcagactttgttctagaacttttttccttattaatattgtttttctttgtgactcatctatgttcctatttcaattaccatttacactcaaattactcatatatttatttttttagttcagatttctggtcttaatgtcaaatgagtaactccagctctcttttgaggactccttttggatatctaaagagcactccaaacccaacattgccagaactagatagatgatctttccttacagcctctttcagattttgcatctcagtgaatagtgccactgtatattgaattattttcactagaagcttaagaggcattgttaatcccctttcatcttcaccttccttttccaattaatcaccaagtcctgtggcctttccctcttgaatctgcataatcctttcaaagtctgtgaccaagcttcatcataaactacctaggccaatatagtagtttcttaaatggactctctgcttctatctgattgttcttgaattatttttttactctgtagccagagaggtatccttaaaataaaatctggttatgttacatgcctgcttagaatatttcaaatttttagttgctcttatgataaatatctgagttcttaacatgacctagcacagtacctgtctcaataaatatctgtagaagaatgaaaaaaaacttatatggtttacagtattttctattaaaatagtattactgtacgcatgtatctctgtgtgcatcagaaattcttttttcttagtaatatttctgttggatatgtttctagaagtgaggttgctagtgtagtttggtttttatctattaaaaatgaaggttaatagagatgtggtgcagcaccttgtagtcgtcgagaaaaaaaatccattaagagaaaaaagaggagactgatctaggaagatcagtaatggtttattaagagagtcatcctgtaccttctgtctgatggaaggagttatatctcaaagaaacatcaaataatttaaggattttttgagagcttacgccaagcaaatttaggttaaatattttgtaagacagaacaaagagaaaagaacaaatgaatcacatttttgtattcataacaaatgtgatttatttctgtaaaccactcatgcatttagtttgcttacatgtctttcttacagtacattatacttaggtagtataaagagaggcatgatttgaaatgggatgataaaaaggtagtaaaaataatgtatgaattataatttttgtagaaatcaaggtttactagtatgtaagaccatttgagctgctataaacaaaacaccatatattggttagcttatgaacaatagaaatttattgcttacaattctggaggctggggggtctaagattgaggcataccagattcagtgattggtgagggctcacttactggttcatagatggcgacgacttgctgtgttctcacatggtggaacagagcaaggggtttctttcacccctcttttataagggagctaatcacatttgtgagggttcttcttcatgacctaatcatctcctaaaggccccagcttctaataccaacaccttgggtgttaggatttcaacatataaattttggggggacaaaaacattcataccatagcaactagtgtagttgatactgggcaatcgtgaaataggcaaataatatttttagagatgtgtgtctgcttcctttgatccatggccctggaaggaagatggtgtgtctttgtgcatgtgacatcagcagggagcatcacaaaggcatcagacgccagaaaggtgggggactaggagaggcaggtgctactagctccgcactactagttttgtgaccttgggcaagctagttaatctctgtgagacttgttttcctcatttgaaaacaataataataactgttttacctgtaaagtagatttgatgtggtcatttattacttattaatgcatttatttataattatgcatttttttgttgagctgatactacaacactttattcctgattttattcgtaaatttgcataccagaaagatagaagtgtataatacaggggcattaatagctttaaaaactttttttaggagcttctcaggctgcaaagtgattcataatggcctcttagagcactgagaggtaccatgaagctctgaaagagttaacatgctttttataacccatgtactcaaagggagtaaaaaactctgattttcctaagtagctctttacaaattcctaccgttctgtttttcactctagtcttttttgtttatactgaaatgtgtagattaagtagctttatgtttatttttttcttgctattaattttgtatcagctgctttgaggatatttaaacaaaacactgatttaattgctctgtttatcattttttcttgttctaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaaggtaaaaatagtgctatatttataggcatagaagtaggacaagagatagcattagcacaatggaaatatttactgtgttcgaaactgcagtgcctcacttgggaggggtctataggcctgtagtactttgaggagaaaattacagtgaatcagtgtgtgagattttctgggtctagatgtggaggattttaaaaatagaattctttaataaatgcataccctagcatcaatatgttttgaccagatagtagctaaccaatctgtgtacttatgtagtggattaaaaataagaactacactaaaatagactaaattaatatttgtgtcctttatgctactgactaccagtgaaacaaaaattggtatttccttatacaatcttatccaaataaatatgtgtgaaaatacaggcacagaactagattgaatgtgattatctgctttattatttgttaatattttgatttatttgttcatttaattcctaaaccaggaggttgctaaataaaacataaggcttattatccttttctcctttcccactcatcagaagtgattatttttaatcactttatggttagtttttcttgagattaaatctaaaccttaaacaatatgcatatgtgttgcttgttaatgtaccagtttaaaaatagctattgattcccctctattacacataagaaattgacatctctcatacttgtcctctctccccactccagtccctaccaggcattttttgagaagttccattgttacttaccatcatacaaattctatgtcttgacccatcaatttttcacagtgtctcctagtttcctacattgtaagagtagagattttttttgttcctgtatttttttccacatctatttccacctactaactcctgcttttaaattacttttataatttcaaggcttatagaatttacattaaacttagtaaatataaatgtctttcacacttcgattatttaaaatttgaaagcaattgccaacatttaaaatattatgtaagtgttatttattgtagaacttacagtgtttgtaccatacacaaggagatgcattctcatattcttaaagaatgtgttattttgaatgagagatacaattaatataaaccgagttgtgagaggtaaaagagagagaaaatgcaatttcacaatagttttagggaattaatagtcctcttgaacacatttttctttcaaacttctggtagatgttggctttgctgatgggttgtatgcacagaatgaggaagacaagagttaagcatgtctcgtggttttatggcctgagctactgtaatggtgttgccacttactgagatggggaagactaggagatgagcaatttgaagtagggattgaggtacaagttctactttagtcattttttgaaatgtctgttagattacaggaaggaaattgatttgatgtcagaaattttatggagagcttggaaataaagatataaaattggcagttatcaagacatagatagcattcaaaatgttgagtctagatgagacaatagtaaatgagtgaagtatagaagagacaaagagaagaagcaaaaatattgagccctggttcacacaatttagaagtcaaggagaagcagaagatccagagaaaggaatgagaagcaacacttcttgagatggtctgacatttaatgaggatatgtttatgggttcttttaaatgatcctgaaccacatttcctgaatgaacccttttttctgaagagtcatatcttgggctctggagatttttttccactgaatgattatttcttctccttgattgcctttgctctttgtcattagagacactccttagatggatgttggacctcttggatttacattttatatttgtcatcttttttattgctttacattttgagaggcttctttttttccaattcaactatcgattatttttttcttaattttggtaattgtattcttaattttcatggacttttacttattctgttattcactttttgcatattagtttgttcttgtttatgaatgagtatattcatgaatctttcttagaatactaatgagagttatttttaagttctcttctcttactggaactatactttttcctcctgaatcaattgtttttcattcattttgatctttcttttttgtgttattattgttttaggtaacatgattattagttgttcatatttactatgtgaaagattaggttgattgttgtatatggctgtcataattttcctctgctattactggcctctgtacctgtgagaggtgttgggggcaagctgtgctcaggtgggcagatcctatctttctcagcagactctgatcagacaacccacctgcatacttcctccgccccaccctgaatgaaaagacaggcagggtctgttgtggggtacacctctcactctgagaaaatttgctctctgagttgatgttttaatttttaaatagagtatttcttcagcttcacttacagtatcaaagctgtatgtgcaggtgagagtgaaccttagttcatatactcaactgtgcaagaaagcgtacgtttctttattttctttaaagcaacatagttttacatccaagtctctatcctactgaattctcaggtaattcaacctgttatccactgcaaggtgtaaatatatctatgcttataaatagtaatatattaaaatgtatgtatactatataatactttatatattaaaataataaataatatatgtgtatgtatacctggagtataatatataatctaatatatacacactcacacacacacacacacacacacacacacacacacacaccaaatcctgggaatctttatttttcaacatctccatgtgatttttacatgtgtgaaaggacagtagtttagaatagaaaaggaatattttaatgcaccttcagttgtttcagtccaactccccttaaaaattccagcataattcaccttcacatgaaactgggtaagatgaaaatctgaattcagtttaaaagaaaagagtcagaaaggcattttatatttcattattaaattgaaaacatcgaattctatctgtttgctatgttcatctgacaatgtataatgctaagattatttgtgaatttatcttagctgctgaaatagatacagacaggtagattatatgtttgagcatttatacaatggaggtattcaaactcaactaagaatttgtaattacagactctcactctttagtttgaatataggaatggaattatgcctagaatttttttatggttgggataaatcatatcagaatggaattgccaatatcctttataaggatgaggctttttagaacatatatatctaaaaattaaatgttatataataagataaatggtaacttcatttattcagtaagaattgtgtggattactctgtgcagcccatcttgagtgctggaccatcaataatggagagacatgatccttgctctcatggaacttatgctgtagtggaagacaacatgtaaacagctgcaatacagttaaatatttgctgtaatgaagttatatatgtagtgtaaaaagggacaggaaaaatctttaattcaaggaaatctttatgaggacgtagaacttgaacagaaatgtgaagccatctttttctcaggacatttgggaaagggaattcaaggtaagaagaatagcgatatggtttggctgtgtcccgacccaaatctcgtcttgcattgtagcttccacaattctcatgtgttgtaggagagactagtgggaggtaattgaatcatgggggcgagtctttcccatactgttctcgtgatagtgaataagtctcatgagatctgatggttttataaggaggagtttccctgcacatgctctctctttgtctgctgccatccatgtaagacgtgacttgctcttccttgccttcaaccgtgattgtgaggcctcccgagccacgtggaactgtgagtccattaaacctccttcctgtaaacgttacccagtcttgggtatgtctttattagcagagtgaaaacggactaatgcaaatagcaagtgtacatatagagaggtgtgagagagcaatattagggtagccacctaattttctccaaccaggatgctttgagagtaaaaagaggtactttacataattagcctgaacatggggtatgaaaataggactttactgggaatgctaggacatatggcaacctagagaacatgtcatgtaaaagagaacattctggtacttctcaatattcagatgcatatataagctgacaagcacctgtctccatagagagactacagttatcctttgatagatcaatggaacagaacagagccctcagaaataacgccgcatatctacaactatctgatctttaacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactgaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaattagataccatctcacaccagttagaattgcaatcattcaagagtcaggaaacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacacgtatgtttatagcggcactattcacaatagcaaagacttggaaccaacccaaatgtccaacaatgatagactggattaagaaaatgtggcacatatgcaccatggaatactatgcagccataaaaaatgatgagttcatgtcctttgtagggacatggatgaagcttgacaccatcattctcagcaaagtatcacaaggacaaaaaaccaaacaccacatgttctcactcataggtgggaattgaacaatgagaacacatggacacaggaaggggaacatcacactctggggactgttgtggggtggggggagtggggagggatagctttaggagatacacctaatgctaaatgacgagttaatgggtgcagcacaccagcatggcacatgtatacatatgtaactaacctgcacattgtgcacatgtaccctaaaacttaaagtataatgataataaaataaaataaaataaataaataaataaataaatgaaacttacgcagaaaaaaaaaagaaattagcacccattccatgttatgatttatctagagaggtttatgtgttacattttagtttttgatttttagccaaggcatacatgccaattctttaaacatgtgtttaaagaatttatcagatctacaagttttattatgagaaaaagaaatctttctccctcttctttcccccacccaacctcccccaattttgtctttccacaggcagccactttcatctctttaagttcataatttgctacttaacttcaggtaaatgataaataatatgattatattactactgtttggttttagatctaggtattatctattgactttacaacttgaaatatgaatatctagctctcttttcttctccttctcccacatccatcctattgttcattcttcccaatatagtaatgcgttatttttcatgagatcagtattccacgtgtatattcgtatgcctatgtaaatgctatttaacaaccaaacagttcgcagatgtttaaagctcctctgaagaacttacagctctcaaggttgctattgagaagtcaaagccattatgctttccaatcttttatgttcaagtgtttttgtttttgtttttacttccgtaaacgaagaagcctgcagaatctttgcatttccaatagtgtgaaattccatgatgaatgtcttggtatgggtccattttatccattttgctaagctctcagtgcagaagactttaattctgcaaagaagtaaaacttacttctttggaagtaaatttcttcaattatttctttgataatttcctcccctttatttctggaattcctattactgaattattgggtctctggcctgagttttcaattttcttgtcttttatattttgcatttcttttttttctttttaaatatatttttcttctccttttttgttttttattattatactttaagttctagggtacatgttcacaacatgcaggtttgttacataggtatacatgtgccatgttggtttgctgcacccatcaactcgtcatttacattaggtatttcttctaatgatatcccgcccccagtaccccaccccctgacaggccccagtgtgtgatgttccccaccctgtgtccaagtgttctcattgtgcaattcccacctatgaatgtgaacgtgcagttcacagaaaacatggttttctgtccttgtgatagtttgctgagaatgatggtttccagattcatccatgtccctgcaaaggacatgaactcatccttttttatggctgcatggtattccatgatgtatatgtgccacattttcttaatccagtctatcattgatggacatttgggttggttccaagtctttgctactgtgaataatgccgcaataaatatacgtgtgcatgtgtctttatagtagcatgacgtataatcctttgagtatatacccagtaataggatcactgggtcaaatggtatttctagttctagatccttgagggattgccacactgtcttccacaatggttgaactaatgtacactcccaccaacagtgtaaaagcattcctatttccccacatcccctccagcatctgttgtttcctgactttttaatgatcactattctaactggcgtgagatggtatctcattgtggttttgatttgtatttctctgatgaccagggatgatgaacattttttcatgtgtctgttggctgcataaatgtctccttttgagaagtgtctgttcatatcctttgcccactttttgatggggttgttcgtttttttcttgtatatttgtttaagttctttgtagattctggatattacacctttgtcacatgggtagattgcaaaaattttctcccattctgtaggtttcctgttcactctgatggaggttcttttgctgtgcagaagctctttagtttaattagatcccatttgtcaattttggcttttgttgccattgcttttggtgttttcatcattaagtccttgcccatgcctgtgtcctgaatggtattgcctaggttttcttccagggtttttatggttttaggtctaacatttaagtcaatgtgtaaggacgggatccagtttcagctttctacatactgctagccagttttcccagcaccatttattaaatagggaatccttcccccatttcttgcttttgtcaggtttgtcaatgatcagatggttgtagaagtgcggtgttatttctgaggcctctgttgtgttccgttagtctataaatctgttttggtaccagtaccatgctgttttggttactgtagccttgtagtatagtttgaagtcaggtagcatgatgcctccagctttggtctttttgcttatgattgtcatggcaatgcaggctcttttttggttccatatgaacttcaaagtagttttttacaattctgtgaagaaagtcattggtagcttgatggggatggcatttaatctataaattacctgaggccatatggccattttcacgatattgattcttcctatccatgagcatggaatggtcttccatttgtttgtgtccccttttattttgttgagcagtggtttgtagttctccttaaagaggtccttcacatcccttgtaagttggattcctaggtattttattctctttgaagcaattgtgaatgggagttcactcatgatttggctgtttgtctattattcgtgtataggaattcttgtgatttttgcactttgattttgtattctgagactttgctgaagttgtgtatcagcttaaggagatttgggctgagatgatggggttttctaaatatacaatcatgacatctgcaaacagggacaatttgacttcctcttttcctaattgaataccctttatttctttctcttgcctgattgtcctggccagaacttccaacactatgttgaataggagtggtgagagagggcatccttgtcttgtgccggttttcaaaaggaatgcttccaatttttgcccattcagtataatattggctgtgggtttgtcataaatagctcttactattttgagatatgttccatcaatacctagtttattgagagtttttagcatgaagggctgttgaatttgttgaaggcattttctgcttctattgagataatcatgtggtttttttcattggttctgtttatgtgatagattacatttattgatttgcatatgttgaatgaggcttgcatcccacggatgaagccagcttgattgtggaggataagctttttgatgtgctgctggatttggtttgccagtattttactgaggatttttgcatcgatgttcatcagggatattggtctaaaatgctcttttgtttgtgtgtgtgtctctgccaggctttggtatcaggatgatgctagcctcataaaatgagttatggaggagtccctttttttatattgattggaatagtttcagaaggaatgataccagctcctctttgtacctctcatagaatttggctgtgaatccatctggtcctggatattttttggttggtatgctatcaattattgcctcaatttcagaacctgttattggtctattcagagattcaacttcttcctggtttaatcttgggagggtgtatgtgtccagaaatttatccatttcttcttgattttctagtttatttggatagaggtgtttatagtattctctgatggtagtttgtatttttttgggatcggtggtgatatcttctttatcatttttttgttgtgtctatttgtttcttctctcttttcttctttatttgtcttgctagcagcctatcaattttgttgatcttttcaaaaaaccagctcctggattcattgatttttttgaagggtttttttgtgtctctatctccttcagttctgctctgatcttagttacttcttgccttctgctaccttttgaatttgtttgctcttgcttctacagttcttttaattgtgatgttagggtgtcaattttatatctttctgctttctcttgtgggcatttagtgctataaatttccctctacacactgctttaaatgtgtcccagagattctggtatgttgtgtctttgttttcattggtttcaaagaacatctttatttctgccttcatttcattatttatccagtagtcattcaggagcaggttgttcagtttccatgtagttgtgtggttttgagtgagtttcttaatcctgagttctaatttgatttcactgtggtctgagagacagtttgttgtgatttctgttcttttacatttgctgaggaatgctttacttccaattatgtggtcaatttaagtgcgatatggtgctgagaagaatgtatattctgttgattttgggtgaaaagttctgtagatgtctattaggtctgcttggtgcagaggtgagttcaagtcctggatatccttgttcaccttctgttttgttgatctgtctaatattgacagtggggtgttaaagtctcccattattattgtttgggagtctaagtctctttataggtctctaaggacttgctttatgaatctgggtgctcctgtattgggtgcatatatatttaagatagttaattcttcttgttgaattgatccctttaccattatgtaatggccttatctcttttaatctttgttagtttaaagtctgttttattggtgactaggattgcaacccctgctttttcttgctttccatttacttggtagatcttcctccatccctttattttgagcctatgtgtatctctgcacgtgagatgggtctcctgaatacagcacactgatgagtcttgactctttatctaatttgccagtctgtgtcttttaattgaggcatttagcccatttacatttaaggttaatattgctatgtatgaatttgatcctgtcattatgatgttagctggttattttgcccattaattgatgcagtttcttcatagcatcgatggtctttactatttggcatgtttttgcagtgggtggtaacagttgttcctttccatgtttagtgcttccttcaggagatcttgtaaggcaggccttgtgatgacaaaatctgtcagcatttgcttgtctgtaaagtattttatttctccttcacttatgaagcttagtttgggtggaaatgaaattctgggttgaaaattattttctttaagaatgttgaatattggcccccactctcttctggcttgtagggtttctgcagagagatctgctgttagtctgatgggtttccttttgtgggtaacccgacctttctctctggctgcccttaacatttttttcttcattttaaccttggtgaatctgacaattatgtgtcttgtggttgctcttcttgaggagtatcttcgtggtgttctctgtatttcctgaatttgaatgttggcctgccttaccaggttggagaaattctcctggataatatcctgaagagtgttttccaacttggttccattctccctgtcactttcaggtacaccaatcaaatgtagatttggtcttttcacatagtgccatatttctcggaggctttttttgtttttactcttttttctctaatcttgtcttcttactttatttcattaatttgatcttcaatcactaatatcctttcttccacttgatcaaattggctacagaagcttgtgcatgtgtcacaaggttctcgtgccatggttttcagctccgtcaggtcattttaggtcttttctacactgtttattagttagccatttgtctaaccttttttcaaggtttttagcttccttctgatgggttaggacatgttcgtttggctcggacaaatttgttattactgaccttctaaagccttcttctctgtcagcttgtcaaagtcattctctgtccagctttgttccattgcccccaaggaactgcagtcctttggaggagcagaggtgctctggtttttagaatttttaacttctcctctggtttctctctatctttgtggttttatctacctttggtcctacagacctacaggtggggtttggtgtagatgtcctttttgttgatgttgatgctatttctttctgtttgttcatttttcttctaacagttaggtccctcagcttcaggtctgttggagtttgcttcaggtccactccagaccctgtttgcctggttatcaccagtggaggctgcagaatagcaaatattgctgcctgatccttcctctggaagcttcatcccagaggggcacccgcctgtatgaggtgtctgttggcccctactggtaggtgtctccctgttagactacacaggggttggggacccacttgaggaggcagtctctttgttctcagtgctcaaatgctgggagaaccactgctgggagaaccactgctctcttcagagctgtcagacagggatgtttaagtctgcaaagtttctgctgcctttttttcagctatgtcctgcccacagaggtggagtctatagaggcagtaggccaagctgagctgcagtgggctctgtccagtttgagcttcctggccactttgtttacctactgaagcctcagcaatagcagacgccctcccctccccccaccaggctgcagcctctcaggttgatctcagactgctacactagcagtcaacaaggctccgtgggcatgggacccgccgagctaggcacgggagagaatctcatggtttgctggttgctaagaccatgggaaaagtgcagtatttgagtgaaagtgtcctgtttttccaggtacagtctgtcatagcttcccttggctaggaaagggaaatccccctaccccttgcacttcctgagtgaggcaatgcgccgccctgctttggctcaccctccgtgggctgcacccactgtccaaccagtcccagtgagatgaaccaggtacctcagttggaaatgcagaaatcacctatcttctgcgtcgatcacactgggagctgcagatcagagtgcttcctattcggccatcttggaatggattcctaaagatatttttcttaagtttatcatcccacactcctatttagttttgtatttctgctattatttatttttgaggaaaataagtttgagttttttaaaaatattattctgtttttatcatggttagattatttctagggagacagcaaacaattgtttttttttttaattttaaaaacaaatttctttccctgacattgtttttgtgtgttccaaattgttttaatgtatttttttctcttcggtttgtctcaatagctcacattagaggatttcctctggtacctggaaattcttagttttttgcttctctttaagtgtgggagacaaaagcacagattagaggctctgagtatatagatgggtgtgtgactacatgatctgactgccctatttagatgggaaacctctgatgtgagatctttaggtctttccttctatactacttttttttcctagacaaggctttgccaaactcctgcctggagggtgaaggtctgtactgggacctgagtgtaggaggctggctgaggggatctctgcttccaatgtacataatacacttaattcctctgtttttattgtgatgtttcttccttgtgccggggttcccccagtccagagacttctttaaccttttcaagagaataaacctcgtcttttgctaggactggggagggaaagtttcccagctgaggagagtgtaaaagtgaatctggcatctggctgcttcttaaacaggctttcaactagttcttatttctttttctcgtatctaaaagtatctggtggtacccatttctgagcctgttggagattccgtagtatcattgtagttagttctcaccattccctactgctggcattaggactttgttgtttgttgtagctctgttaaatttttcaacaattaaccaattgctttccaacttctataattttattgttaccgtcttttcatttctgtgaccttaggggcgtgtgttttaaagggatttggggaaggagtcaagaatttggtgaaagattctagatgtgtggaatcaatttgtgtgcaataaaataaactgaaataaaatataaaacttggtaaatagctcaataaatattaaatccacatttagcttgtactatgtttctttggcccaggtaagattctttcatgctagaatgagattttaaaaatcaatgtgcatttttatattcaggctacagttaggaccaaactacaccaccctcttcaatagaattatttttcatgcaaaagaatggatatttgcattaaaggacacatataactaacttaatgagatgttagtggttaaggactgtaatttctgttccttgaaaaggcttattgccaattaaatacacttcaagaggcataaattagattttatgaacatcacacttcacactctttcaaaaatgttacagtttagaaaatgtattgtaaaagcatgtttatacttttaccttctttggctcagaaagaaattctatacagtaaattttgaaactcaaaattattttacacactatagaacaataattttgcacatttaaaaatactattttatctggcattcttttaaatgaatgaagttaattactttggagacagactaaggagctagggttctagcctcagctctctcatttactcatgggtaaccttggaacaatcctgtaacagttctagaaattttaatttcctaatttgcaaagtgagctggttgaactagatgactattaaaagtatagttctggaaataatcaaggttaacacctgattaatgtcaatgttaatttcaaaagctaaggcttatatcacattttgccaacatgtaatattgactcacaatgactatagttcatatcagcttctctgctttcagatccagggaccaaaggcctgaattccagttgtgcctcaagatggtgctttccctcatttttgtagctcaagacgtacattcaactcaagagtccagctctacagcagctatatttggaaatacacatattttatggccagtatataaatgatttttaataagtatgtatacacttcttgtataatgataagatttttttttttttactttgctcgcatttataaatcaaacttcgacaagaatcttttttggagtaaacagagaatagccacagaatttggtgggcaatgggacctaattacatagtcctgcttctatagttcacagtcaagacattactgggcaaagatagacactaatttcaattagcatttccatctgattcaatgatttgagattcttttaaatcttaagaccaagattacaattgttcatatcagtaggaaaggaaaacaacatgcttctcctttttgttgaattcttctgactggggaatgatttttattgagtattaactgggcgtgtgagagttctctaagagtaccttttttctatctgaataatgctgttcatacggtcaaattaattgctagatatcctctttttcttatgttttcgaaatatatttttatataagagaaatatatttaaatatattaagcaaaatacatattttatctcatatatatcattatattaggatgatttattttcaacaccatatcaaagaatattagtgttagtagcatcttaaaggtaatagggcctagtgcaagcatagtcccttaattcttgtttcttaagagtcatttagaacctatcagctaaagtgtatgaagaaataaatcagttttggcagaccatgctgttctggaatcagtacaattgtaaaggaagcagctgtatttttgtgctccctcgtgtattatcagcagcattgttgtttaaatggtgatggaaatgtcttgaccagtggtgaatgaaaggaagactggaaaggagagagcttgactgctagatctcaggttgtatcataggaatggtggtaagaaagataatgattttatcatataaattaagcaaactggatttattataagtcatgaatgatgtgggtaagatatggtggttttactgtaaaatatagaattttactacaaaagagatcagagcaatgagggaaggttagaaaggtgaaggaaatttataaggtgggagccatagcagaatattttcatgttaataaacattatcccagagagtagagaaaaattaatgattaagaagagaaaggagagaactgcaggagcaaaatctgtgtgtaagcaagagtgaaccgaaccaggagaataaacgattcatctctggtcctaggaggaaggcagagaacttggacatggatccagtaggttgaatcagcagtgagagcatgtggaagtttggtttttgatggctcttttctcagtgaaataggaagcaaggtcatcagacgataatgagaagagaaagaagatttaggtttgaatgagatacatggactgggtgactaatggaatataaatgtactgactcatgaattttaaaataaaactctcccaattccaatatgacagtggccatgacaaccaaagaagagttattctttcttataacaaatacagaagacagaatatttttgacaagcttggctagcctttttccagggttttctatgtgacgctagccagatcagaaagaaatctaagtaacatgctgaagtggaagcttggcagactggaaattttatatgatgtttttcagtgctagaattaaatctattatgtgaaccattatggaaggtctgcttcaggaagcccagctgattatattagggtcagtgaacacatcagggaatatttatatcttgttttcagaaggtgtattatggtcactttgccattcattgattatgattatttaaattggcttcaaatgacttgtttcttagatcatagtccactcttttgtggaacagatgggaaggattatcaaacccttggaagaaggttcagttaaaaaccagtagtcaaaatgcatatattacttactatgtattagaattaattctgctgttacctatttctatatcataaaggccctattataacttttctgttcacagacttttttatgaaacatgaactctttgttatcttgttttgataagttgtaaaatgcctttcctgtcttcctttttctaagtccttttaatttttctctttggatgtcatgaagacttattgttcctgataaatgagtcaatagtgatgaaaatatcagcttgattcattagcaggtataaacattacactgaaaaaaatactgagtgtatcaacacacagacctactcacacactcactcatatatacacacatgcatgtacacacacgtatacactgataacatctacttgtacaggctctcccttgtataatgaaagaattattttctatccaaagaccatatggtgtgtttgatggtcctgtagcaggactctgggatccacactgatgaaaataggaagtagattttagatgttttacaaataatatactgggcaagtaaaaccatataatgctttataacccttagctacttctgactatgagggaaaagtcatctcacacagtgtcccctcatgctatagatgaacaaagtgggaacgaaagccatggaggtactgctctgagatcatagcagccaataagtagcagaactgccattcccagattctcctccatccacctcttaattattgtatcttcacaagacagggtctctactttcttgccccagagtagtctatcatcaatttctgaccaaaacataaaaaaggatacaaatgaatgccaaaaaaatcgtgcctattttcattaatcaaattttaaagcttatatattccatataagtctagataagttgaattaattataaaaaggacctgaaacctttttttctctccaaggaccttcatgccattttttaaaaagatctatttattcagtcatttgccttgtagtttaactcacctcattgtccttctccatcttattatcttgaccattatgttaattgcttgtctcattatcctttttttcttagattgcagatcctgtcccaacacccctttcttctataagacttctttggcctgtttagctttactgaggcaattattattaaccttttttttttattatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtggtattccccttcatgtgtccatgtgatctcattgtttaattcccacctatgagtgagaatatacggtgtttggttttttgttcttgcgatagtttactgagaatgatgatttccaatttcatccacgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttggttatatacccagtaatgggatggctgggtcaaatggtatttctagttctagatccctgaggaatcgccacactgacttccacaagggttgaactagtttacagtcccaccaacagtgtaaagtgttcctatttctccacatcctctccagcacctgttgtttcctgactttttaatgattgccattctaactggtgtgagataatatctcattgtggttttgatttgcatttctctgatggccagtgatgatgagcattttttcatgtgttttttggctgcataaatatcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggtgttatttctgagggctcttttctgttccattgatctataactctgttttggtaccagtaccatgctgttttggttactgtagccttgtagtatagtttgaagtcaggtagtgtgatgcctccaactttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttcttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttcttctgcctgattgccctggccagaacttccaacactatggaataggagcggtgagagagggcatccctgtcttgtgccagttttcaaagggaatgcttccagtttttgcccattcagtatgatattggctgtgggtttgtcatagctagctcttattattttgaaatacgtcccatcaatacctaatttattgagagtttttagcatgaagggttgttgaattttgtcaaaggctttttctgcatctattgagataataatgtggtttttgtctttggctttgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagctcctcattgtacctctggtagaattcggctgtgaatccatctggtcctggactctttttggttggtaaactattgattattgcctcaatttcagctcctgttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggctttgagtgagagtcttaatcctgagttctagtttgattgcactgtggtctgagagacagtttgttataatttctgttcttttacatttgctgaggagagctttacttccaagtatgtggtcaattttggaataggtatggtgtggtgctgaaaaaaatgtatattctgtcgatttggggtggagagttctgtagatgtcgattaggtccgcttggtgcagagctgagttcaattcctgggtatccttgttgactttctgtctcgttgatctgtctaatattgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgccttttttagttttccatttgcttggtagatcttcctccatccttttattttgagcctatgtgtgtctctgcacgtgagatgggtttcctgaatacagcacactgatgggtcttgactctatccaacttgccagtctgtgtcttttaattggagaatttagtccatttacatttaaagttaatattgttgtgtgtgaatttgatcctgtcattatgatgttagctggtgattttgctcgttagttgatgcagtttcttcctagtctcgatggtctttacattttggcatgattttgcagcggctggtaccggtttttcctttcgatgtttagcgcttccttcaggagctcttttagggcaggcttggtggtgacaaaatctgtcagcatttgcttgtctgtaaagtattttatttctccttcacttatgaagcttagtttggctggatatgaaattctgggttgaaaattcttttctttaagaatgttgaatgttggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctaccttgctagattggggaagttctcctggataatatcctgcagagtgttttccaacttggttctattctccgcatcactttcaggtacaccaatcagacgtagatttggtcttttcacatagtcccatttcttttcacccctttctttgactcggaaagggaactccctgaccccttgcgcttcccaggtgaggcaatgcctcgccctgcttcggctcacgcacggtgcgtgcacccactggcctgtgcccactgtctggcactccctagtgagatgaacccggtacctcagatggaaatgcagaaatcacccgtcttctgcgtcgctcacgctgggagctgtagactggagctgttcctattcggccatcttagttccccccaattattattaatcttaatgtatttgctatcatttccattgctataccccccagttggacatgtttactgcataccccattaggaataggcacttgatgttagagaaaggcattttatgagaggattttacagtgcagagtatgtcacattttttttactgctattccaacctaattatattaggtatgactcctcatgctaagttttatggaaacttaaatgtgtaaaatctcgaagctcagacccatagttgcattaaataggaagtcaccaacgaaatttatttaaatgttgacctctccaaggtcttaagattgtattttgacagcaattttttgcttggccaaactttagtcaggtccctgaacctcctcctagaccacctgtaaaagggcctatataagcactttccttgtaaaatccatttttagcaaagaacccagctaagtcaatttagcaagaaccccatccttgatatctgatcgggttcctcattttccattatcctcaactgatatctgatccccctgacatgactttagtgagaatcctgtggataggtttagccagaatcccatttacccctgatatatcctcttagtaattttctatccactgatccccaccttgctccttgactgtaaattcctacttgctcatgctgtattcggaggtgacccagtctctctcctccaccacaaaatcccattgttttagcctctgtacctatcatgatcagtcataatcaatcctaagtttaccttaccttgctttaacaagtatcattaaatgatttttttgaacaattttcaggctaatttttcttggtctagttttaggcagaatgagaaacctaaagctaaaattaatgatcaatcaggaaagaaaattcagcatatcaaaaatgataaattaattagaaaaatgatcatttgttataaaaataataggtttatacaaatgatcaggaatgattttttttggtgccaagtgtagtatatttacatttatatagctacttgtatgtttacagtttgttcctagtcatttcttacacaaattagaaagagagagaagagaaggaagtgggaagaagggaggaacacagacttctcatctggacttgaccagttttcattcagctattctgtgacagtaggtggggaaatggttttttcaaaaacccatttcctttccaagcatgctctgtcccttgaaattttactctgaataatctgttgtttctgatgttaccagacgtttggaaatagggctttttgtgtgtcttattgcttatagccataatgatgagttttttttacttcagatctttccaaagaaagcaaagcccagagatgcagtgaatgtgaaagaaccattatgatagagatcagtgatcacacgtattgatcaaagatgctcagccggagtaatggttatttacagttgagggggtttcaagagccattctttaacttaggataatcaaatccgatactgtgaattaagaaggaataaaagggataaatcaagtagagtaaaagttggaaaatagatttgaacattcatatgcctagtttcaaaatctttttcatgagattgtttaacactatttcctactgaaaaaagaacacgtaaaaagctgagtttagaagtatcattctgattacataccattttcccagtattgtattaagtactgtgaaagcttttcagcttaaataaagtgaaattagatggtgtttgtttttaatcacaaaggtgttcttcactttcagaaaggattcccttgcatttaaacaagttcacattctcaggatagagcagtggggttgggattcctcttcagcctgaattaataatagctgaggcatgattttgttctggtcactatgactagaaaaattcaaaagtagaaaaaatatacactcaagattctatacagtaatgcaccagttaattcacacttcaaagatgagtaatgagaagtttaaaagctgaaatttgtggcctggtgaactgcagattgtgaaagggcgtttataaaactttacataggaatgtgcctcatctatcaggttttgccccttctgttcccctttcttattttcttctctaccactgttttgatttccagtctacttctttctcggacccgcacccgactttgtttttcagggcctctgttgctgtgccctgtctccctctctaaccttctctgtcttttcttgtcctctcttcctattttagtgccctttccccttttctttattgtcttcttgatactttattaactggccacgatatgagattgaagtccaagtctaaacacatatttaaaacgttttgtactgtctgttctaaatatgctgattaggtgactttgatctgctttcattcttttcattcagcaattttttaaaaaatttattattttatgttattttatggcagagtcttgctgtctcccaggctggagtggagtggcgtgatcttggctcacagcaacctccgcctcctgggttcaagcgattctcctgcttcagcctctcgagtagctgggactacaggcatgcgccaccatgcccagctaatttttatatttttagtggaaacagggtttcatcatgttggccaggctggtctcgaattcctgacctcaggtgatccgcctgcctctgcctgtcaaagtgctgggactacaggcgtgagctaccgcactcagccagcaaatgttttttgagtgcctacattttgctaggagttagatattggagtaaaaagttaaacaaggcttagtgtctccttcagaagctaatagtctcatggtagagacaaataaaatatgtattattgttcccagtattgtattaggtattcttaaagtttttcaacttaaataataataaaataaaatggtatttgcttttatcacagaggtattcttcactttgctttcccttacatttagacaagtccacattctcaggatagagctatggggatctcttttcagcctgaattaataatacctgaggaatgattttgggttagatattggggtacaaagttaagcaaggcctagtctcttcttcagaagctaatagtctcatgctagagacaaataaaatatgtattactatgaagatcttaatatcgttgttaaaagataatttttcagaaaaattaaatttaatagagtttaattgagcaaagcatgattcacaaatcagctccccacctcccacctgccctagcctgcaaccagaataggtaggttcaaagcgactctgctacatggttggatgatatttatggattttaaaaaaaagcaaaatgaagtatagaaaatggaagtaaggtacggaaacatctggattgattacagcttagcatttagcctatctgaacacagtttgaacagctgggtgcctgcgattggctggaactctgtggttggtacaagagtaggttacagtctgtttacacatccagttaggttacagttcactatgcatggataaacctttaggacaaacttaaaatatgtaatgaggcagctttaggccaaacttaatttaacaaaattaagtgactttttacttctctgtgatttttcaacttattttctttaattgatctctagtttaaatcttgctatatttagtatgtgatttgctttcacaaatttagttaatatttaattttaaggaacaattattttttaataaagggagagtcgatggtacttaaaattttatgaagtaaggaaatgaacaaaaattgtatttacctcatattctgattttcttatcctaataaaatcttttcaataattatactgttgaagtacagaaaaagccttctgggtaaagtacaatgctgcctcaaaattgtgctttatatttttatcattattaaagaataaagtttcatagagtattgggtataggactgttgctttgcacaattccagagtgtatgattcatgcagtagtttacgtgaatcctcccaccccatcccaccctatcttgtgggaaaattggttggttaataattttagatatcacacagaaagttagtggggattgtaatatttggattaacatttacttgaaaattttatggtaaattttttgaccaaagacatagtaatagcttctaggaagtgacctatattaatcatttttagtttgtaagtcaagtggctggtattccttcacatctcctttgaaactatttgaatgagttaactaacgcctcttatatcatttaattctcatgcatatccaactttatagcctgaaaaatctttctggaattggtatatgaaaaagtatctaagcctaaggaacaaatatttacaaacacaataggaaaatggagatttcacaataggaaaaaaaagtatagaaaggcagctaatccactgacaagactaagagttaatattaatttatttaaaaatcaaaaccatttttgagatttgaattttaaatttagaaaactactgtgtcttttcactactttaacttataaaagcaagatagattttttttaacttattttgatttgtgaaatagccttaaaaggcatttgtcattccagagtagatatttttgtcttgcttattaatttgtattttaatgaaaataacataactttcatctggtattcagtgaactatgctattacagaataagactgaagtaagatcttttggttgtattttaaatgaaaagaataggaaaagcatccactgggatttctgctttttaacaaaaacaactaaatctctgatagaaaatgtctcagagttctagtaatagtaatgagagacagaaataatgagtttaggagcaaaagtcacatctattgtgctgtaaatggtaaattcaagctacagatcctcattaaaaataagaaggccataaatttaacaaatgctatagagtgtagaacaggtcagtcattgaatggaaaatatctataaatacaatgcaaaataaatagaggctaaagaatgactgcatgcgtggacagatgcaggcagtatttactatctaacttggcttaaagtattttatcttgttggcctgactaatttcttcaacttatttaaagatattgtcttgggctgctttcttgctaatgcagatagctttttagggggaacattaaaatagtaaatatagagtgcacataaaggtacacatagctagtgtactgagaaaaaagaaggtaatgaagttttattccagacacttgagcaagcaaacagtcttatgatatactaagctgacgggaggttggtactatcactttaggacaaagttgaagggcagtccaaagaaacgcatcacctgagtgcccataagtctgagttcagcagactctggggacagagattgtaaatcttctactgtcttaaaagtgaaatgataattttttgattagaacttgaaattgttccttaaaatgaacttgaaaatcttaacagtaggctgctgtgtgttcctaaagttctaataaaaatctgccctgtggcagcctctgaccaccactgaccaaagaggttgttagaaaaattccacttgtattgaaaggcacatctattattacagaacaaataattaagagtgactagcatagaagaaggaggaaactgaataaaggaaacagagaagattataaatgaaagaagactaaggtcagaaagaaaaattaaatagaatctaatagtgagaataaatcctgtcagttaaataggaagaagaacctttgtaaaaaaatttttaaatgcatgcctggaaaaataatcagaaggattaaatttttcaaataaaaaataggaaaaggctgggtgcagtggctcgtgcctgtaatcccagcacatttggtaggctgaagtgggtggatcacaaggtcaggagttccagactggcctggccaatatggtgaaactccgtctctaccaaaaatacaaaaattagccaggcgtggtggtgctcgcctgtagtcccagctactcgggaggctgaggcagaagaatcacttgaacccaggaggcggaggttgcagtgagccgaggtcctgccactgcactccagcctgggtgacagagcaggactccatctcaaaaaaaaaaaaaaaaaaggaaaaatgacgggcttatttttttccttattataatttcttgctcttcaaatttcattgttgattctaaatctgttattgaaattctctaacacgaattctgcctgattttgttagtgaacactgaaaaaatttctagcttttctttaaaaataaataaacataaaagcaaagagaatattttatctttagtagtacattttcatttataagactggacaaattccatgttgccagaccattaaaggaatttaaaagagtcttgtaaatcaagaatttttccagcacttccagtactgtagttggtatcctgagaataagaacataaatagatatgctgggtgagaaaatgatcccattcagcttcatacaactcctttggcaatagcactataatcatgtcaaccgttttctatgatgttgacatcatgtcatcatgttgccaaaacctgatattgatcaagccctctctctaatgccacctcttctgtgaatccttccctggtaatgagggtagagatattgtttgtttcattcactgttatatgccaaatctcagtgtccacactttgcttactcgatattaaagttacttaatgatgcatgttaattttcccatagaaagactatatgttagtttcagggcccactagggtctaggtgctctcctgtggtgaggtttgcaggagttggtggtggggatgtggacttctggaggtctctcacttaccctttctccacactgtggaggctctctgggctcccatctggcctgagctggcttcctggcatccctctccttccatgtctccagtatttcctgtgacttctctgttgaactcaagtgttctctcttagatgctttattcaaaatgtgattagctacttgctagtttagtttttctttgtggaggaagtgagtgctgtatgtctctagtcagcccccttgaggcttctcttcctgtggcttcatttttatcatcattatagatttttgaaaactaaagatataacttctgtactcttgcatattagtggattttttgacttgctctgaacatttccgtttcaaatcttgcagaaaaaataggtcttagatgaatctttggattgcatttttggatcaaacccctgaagatatccagtaatagaagtaatacagcctcaaaatactttccaaacactaagaactaagcttatttcttgccttatgatatagctgattccagggtcacacattcatgtatttataacttaccttaaaaacagtgttcgaattagtaaatgccagtgctctgttatgttcccttttttttccgcctagtatatcctttagcttttttgggaccatttcaatagaaaaaaacacacaaaatatttttatctatggcaatccctgaagaaactcttatttaaagctttaggaatgtctaaaacctgacaagcaacatcctcttcaggtaccatatttctcatgaattttggcccttttcatattaaattattatttttaaaagtaattttgttttgtaaatataaaaacatattacagcttctgcctttcaaatattattttaatattattttaaagttcacttttttgtgaactttttgacattaagaattatatcttatttacctttgtatccttgcaacctatttcagtgcctgggtacagagtagatcctccaaaattactaaacagttctttggatttttttcttggtcatagaaggtacacgcaagtaacttttacatacttaatagctaccctgcacttctctaggtcatttggacagaatccaacatgtaccacaatagacatttgggcacttaaatagatattatagcatatagtggtcagaaaccactggaaaagccaatcctgtttttttttttttttcacagcaaaatcacactgtttgaaataccaggatcctggaacttagaaaagtctagatttgttacagtgtcaacaaagcatgatatgtgttttcttgtgcttccacatggtcacacacacaaattcaacaaaaccaaatcaaacaaaacgatgcgtgcatttttggggtgtgaaaaagccactcacaatcgtaaataatgtacactcaagaagctgacagtctagggcaggaaatagacttatgaacaaatactatcatcggtaaaaaaaaagtccaaatttgtacaagttcaactttatacaagtgaagtaagagaatctagaaacacagaaatattaactaaaacttcaggagccttgaaaaacaattttattgaaatacaggactcaaactaaacggaaatagattttgtgttaatattagcaactcagtagacagttatcaagccataagctaaactctccattttattttcttcttaaacttccttttacataatgaggaagtgatatcaatgaacagattacttatacctaccgtttctgcggaaataaaggagttagaatctagatcaggtataatgaacttgacagactttgtaaagttctgtaggcaactgggaatttcggttggactttgagtatggcagatcaaaacttttttgtatttcctacaattgagaaaattttccataacacagaaagtgaaattagtatgtttttatttctgctgcctagtcctgaaatgattttctgcttgtctgtgctttaatacagtattatgattacaccagcctgaccaacatggagaaaccctgtctctactaaaaatacaaaattagccaggcatggtggcacatgcctgtagtcccagctacttgggaggctgaggcaggagaattgcttgaacccgaaggcagaggttgcggtgagccaagattgtgctctagtctgggcaacaagagtgaaactctgtctcaaaaaaaaaaaaattgcatagtctatgtagaaaatgttaaaatttacacttaataatatatatcacttgatcaatagatatacagtgagttctgagatcaggacagtggaagataaaagaagttcaagaaaagctcactgccctactggagcttactgtttacttaaaatgataaggcattaaggcctggctatttcagcagcaatatataaattaaataaatctagacaagatcagaagagcacctaggaggccgcatgtaatatgcatctgtgagagttaattttatgtgtcaactgggctaagccatgatacccagatagccagtcaaacattattctagtgaaggtgttttttagatgagaataatatataaataagtagactttgattcaatcagagtacactccataatgtgagtgggcttcactcaatcggttgaagttcttaagaaaagactgacttccccagaagagggaattctgccagcagactgcctttggacttgaactgcagctcttccctggatctccagctgccagcctaccctgcaggttttggacttgtcagactctgtaatcatgggagtcaattcctgaaaataaatttcttttcctaatatacatatgcacatgtcctatttgttctctttctctagagaacactgatagataaaaaaataacagttgagtgctgtattagtccattctcacactgctataaagaacttccctgagactggctaatttataaagaaaaaaggtttaattgactcacagttccacctggctgaggaaacctacaatcatggtggaaggaaacctacaatcatggtggaaggcaaagcaggcatgtcttacatggcagcaggtgagagagagtgagcaagagcagggaaaactgccttataaaaccatcagatattgtgagaaatcaccccctatcacaagaacagcatgggggaaacccgcccccattatccaatcaccttcctccatcaatacgtggggattacaggtccctccttcaacaggtggggattataattcaagatgagatttgagtggggacacaaagcctaaccatatcaagtgatgtggcttgagcagaaaaaaatcagccaaaggcttgatgattattgtacatctcttgtcttactttctctttccatgtttaatcttctttcctagatggtgagctcctagagttcagtggcacagtatcaagttctgatatagataaagacttggaaagggaatatcttttaatccttatatttaaagcagtcagaaattaacatgcaaagaggtaggctggtcatctagattcctcccttcattggttattaggaggacttttagaggctgcaggcagttctgtagaagcacactacatgaaaagcctagatttcactcttcaagagttgcaagacactgtagaaattgcttcatgtctccacgcctgtgtttctgcttgtagattaagtaaggtaatagaagttcatgtacccatgaaaataggccaaactcatctgtgctattttaagtcagaatagtggttatccttgtgataattacaaagaatatgaggggagtgttctaggggctggcaaaagttctgcttctggatctaggtgctggctatatggatatattagtttctaaaataattgagtggtactcatgtatttttaatgtatattacattttagtacaaagtctttaaaagttcatatgttctgtcttgtaaacaccttcagaaaattgacaggatacaaaaattctaatgtgtcacaaggataacccaaattacttgttgcagcatttcctttcaacagtttccatcagaaaattagaatcccattaacaacaaacaaaaagaggtggcaaaacagaggcaaagaaaagcaaaaattttttgaagtccattaattgattttcagtagatccacctaaatttaatgtgttaggtctttggcactatctttattttacttgttaatgtttaacttaagaatgcagtgaaaccaaatgcttgtatttgtgaaagtgcttttcgatatttgttaaaacacgatggaaaaactaggtaatagctgtacaggcttttttataggtcataaaaggaaaaaataaaatatcttataagtaagtttgaagctccacagctcctagtcagaaaattgaattatttagtgtttcagtaatgtgatggagccatccttcttttatgaacaacaaatatcatgccagttgcctaccttaaataccaatgagaagagggcggatagaattttcacacacagacattcttggaaataaaacatacaacatcttctgcagacctccctttgacccgtttaataaaataacagaatcccaaactatgaaatatttttcctaaccacctgagtagctgaggggcatccttattgagggtgtgttggtctctagggctggatatctgtatatcttagtactgttaatcactgctacactttccactcctttttctctttcagttattttatattcatgagcattcttctttctttcctcgtgtaaatctaaaaagtacaccgtttaattcctgatttctttgaatgaaaatgctggatacagaaggcatttcgttagtacctcactcaataattctggttgcagaaacactgtgcgttgctaagtagaggaaaagactctcaggaccagcttcctttacattgatagaaacaggtgttctcttttagttgtcaagtcagctcccttctgagaatctcagataagtggtccaaattacatctaagaggaaaattcgccaaagcataattacttttcatcagggtgccacaaataatgaaaggaaaagaacacttgaagtatattgtagtctacttaatcaccatcattttaaaaagctgatgtagaattccttacttcaagacaaattgtatggctttggtggtaaattaggcatattttctaaacactaaattatatttcctctaattcacatttggctaagaaaagctgactagtctttgtagcaatggaatataagagataaggtttgcagctgccattttcaaacagttcatttttgtctattcttcaattgcttcctgtgtttctattcatattgaataaaatccctttctttcatgttaagataaatttcatcagggttgctatccatgcaggatgcggcagattctttactgcaccttgtctttccattttccatttcccacagccctacccaagagctaaatttgtggagagcaagagataattagcataagtagaaattgtaaagctttgctcaacgataaacaattatctagcacagtgcctaagaaattctggttatcagaattttaggtaacatttatctgcctttaagtgatgttttagaactgaataactttagttgaggcacagtagaaaatctgagagtgataaaagtaggtttgactacaaggttaaccactgattagatatggagaagttgcttaagctctacagaatttggcttatttataaaattaggataataatacctatcctttaagaatcaaatagcataacaaaaacaatttcctaggattgtacttgattaatagtagtaattataaaggacatctaattttttttttttttgagacagagtctcactctgtcacccaggctggagtgcagtggcatgatctctgctcactgcaacctctacctcctgggttcaagtgatccttgtgcctcagcctctcgagtagctgggattacccgcatgtgccaccacacccagctaatttttgtaattttagtacagacagggctttcaccatgttggccaggctggtcttgaactcctgacctcaggtgatctgcctacctcggcctcccaaagtgctgggattataggtgtgagccaccgcacccggtcaaggacatcaatatttttgagaaggtatatagactattggggaaatgagaggagaaagtgctcatcatacaaaagcatctttaaccagggccaaagccttcaagttgccttctgttttcctaattgctttccgttccttcccatcagcagctcttctatctgtgatcctcatcttttatcctttccagcagatgtttatccttatcatcgagagcctccacccccatagatacttgctctttgtaccctgtatttgatgaacgtttcttttctccctacaggcaactggatagatggaatagaaatgcccattcataacttaaaatttgccatgatgattaacttactatggggtagagctatgggtttcccgacacattatacatctaaggcagggatcagcaaacattttctataaagagttgggcagtatatattttaggctttctaggctaaatgatttctgttgcaactactcaactctttgcagtgggaaagtagctgtgacaatatgtaaacaaatgagtgtggctgtgtgccaataaaactttatttacaaaaataggtggaagactgaatttggcccatgagctatagttttctggtctctcgaagacacagaaatgaattaaatgatgctagagtttaaaggggcataccagtcatgtggtccaggtttccccaaagaatgttcccatagagagctgtcttcacacaaccaaaagctaactggtcaaacatatttttgacgtgttacacaatttgcccccatcatataggcttaccaacacattagtattcttaagtccctgacttttttagggtataatattcataataggttagtaactaatgctttaatactgcttgctaagcgctcagaaccattctaaatgcttttacctatatgatttcatttattctcacaatgctgtgagatatgcattaatcccattttatagttgatgaagctgaaacactgagaggtaaaatacctgtccaaggtgacatacttagtggagccaggattcaaatgtaggcagcctggctccagggctccagctctgagccaccttcctacctccatgtcacatctcgaaatctatgagaattactgtgaaagctgggaaactgcttattgaatccagttctctcagtgtacacattagaaaagagaggccacgagaggttcagatgactttgcaaaggtcacaagcataattaataactgagataagtctacaaatcaattaaatcactacttggtacttgaagaaatgcttaaatgaatcctttatcaagaaagaaaatcctctgaaaatgaataatcacctctaacttccctttttcattcagatttttatgaccagtttcatttcaatgaggtaaataaatacaaagcttgatatttaaaggtagaattttttttcacttttaaaattctgataggcaatcccccaacaaggggaagatgacacatctttctctgcaactgtgatctctctcccaggctctgaatcagtgattcctaaaccttaatgtacattagaatcatttgggagtgcctagacaaaatgattctgggtgccaccccactgcctcagatattctgaacttaattgaggattcagcagagatattttgaaggagacctccaagagattctagcatgtagccagggctgtgaaacactgctctagaatcacatttgtcattactactcaacttgtccacctgcgttaacagctaacatttaaaatactacgtggcatgaaatggaacttatggttatggtccatgggttataattaataaaaatgtgagtatactccaagcatgaatgaaactttattgcagatgaattgtatgggtggctgtaatattcagtacattttaagtgagacctttggattgacaaacacagctgcagaactagactgaccaaggactcgggattctgttaggttgctatgaatctctctggttcaaatagaggctggtctctaccttttatgtggctgtcataatgcaagagacttaaggtcgaagaaaaagtgttttggagaattaggttttgccaccatccaccacctatttacaagtatataatcatttttaacagaagactttaaagaagaaataatgtgtagtaaaagaatttagcatagaaatagaccatctatgagaacacatagaatagaaattaccagggatttgaggcggtctaattactactattgaacactaaatttgtcttttttctggcagttaaagcaagaaaggaaacatgttgagttacatagttttatattctgactaaaaacagctttcacatttgtctgcagagaaaattgttattttgagctaaattcaacaaataatttaacacatacatccttgggataagacagttgacaatgtcttcaacacagttttgtgaaagtcaaagaagtgcttttcaattgatgatagctgaatgaaccctctagaatatcttgagttagtaaagtccttccttcttcccttcctcttcccctttcacttccccttccccttccccttcccctttccctttcccttccttccttcctgccttccttcctttgtatttgcttataactatatgctggatgcaatgttaagtgccgtgggtactgtaaggaataagatagcatccttgttctctaggaagtcacaatacagacgatgaaatgcttaagaaaactcataattcagagcaagagaggccagagcctgaaataaagatgtgttattgtttgcacatatctttacaaaggtatgtataagatgccatgggaacacaaagaagcaaagagcaaagtgagcctattggagatcaaggaagatcatgtaggcttggttgaatagatgagcaggggaatgcaatggaagatgtgttccaagaggaatgatagcagaataaggggaagggaaaggagagtgcatggctctttaggaaaattacaaatatctgccctaaattgaggttcatatggggacatgggattagtgacacacgtaggggtcagattccaaagagtcaggccaaaagattgaactttatataaaagcgatggatattcagctcagtatttcaggatacggagtgggtttcacatgctttatgctttaaaacgatcactctagtgacagtgtgtaagggagacagactgggaggtcattttggaggctgttgatataattcacttcttaagtgttgtggatctgaaggaaagaaataacattctacaagtctttagggaattgacttttatggtgggctaatgactctgggggaagggatagggagaagacaagcgatgtttcctggcttacatgactgggtggctgtggcacaattcctggagactgggaaccacagagaagaatcgtgcacgtttgtaggtggggagcaaagaggaggagagaatgaagatgagttcatttgactctaatgggataggcaggagagaattccaatagagggttgaagtctgagctagagataatggatttggagtttaccagcatatagatgacagtaaaagcgatgtatgtcagtgagatatctaggagtgtataaattgaagggagaccagagtttggaactctaaggaacactcacacttaaaaggcatgtgagggacacagtttatgaaggggacggaagcatggtaagaataaatgtgtgtagggtaatagggtgatcagtaggatacatgcaatcacctagtgatggaattttcaatagagaatgaaagaaagtgtatgtggccaagtgcagtggttcacgcctgtaatcccagcactttgggaggccgaggtgggcagaacacaaggtcaggaattcgagaccagcctggccaacatggtgaaaacccatctctactaaaaatacaaaaaataaaaaattaaaaaaaaaaattagccaagcgtggtggcacgtgcctgtaatcccagctactccggaggctgaggcaggagaattgtttaaattcaggaggtggaggttgcagtgagccaagatcgcgccactgcactgcacccctgggtgacagagcaacactccatctcaaaaaaagaaaaaagaaactgtgtgttaaattgtcagtgaaacaacagttgtgccaggtgggactcattaggtgctgggtctctggctgctggagtgaatgctcttaataagagtctatggataatttacattgtttaagggaaaaattaattagatatcagaaaatttgagatccagactcttctcgttagatgagaacgccaagcttagatgaggtttccacacaattaagcacagtcatgaatgcagaataaatgtccttaaaagttttgccagggccgggcacagtggctcacgcctattataatcctagcactttgagaggccgaggcgggtggatcgcttgagctcatgagttcaagaccagcctgggcaacatggcgaaaccctgtctctgcaaaatatacaaaaattagtggtggtgcatgcttgtagtcccagctacttgggaggctgaggcaggaggagtgcttgagcctgggagacagaggttgcactgagctgagatcacaccactgcattccagcctgggtgatagaaccagaccttgtctcaaaaaaaaaaaagtttgccaggatggtggcttatccctgtaatcccagtgaccttcgaggctgaagcagaagggttacttgaggtggggagttcgacattagcatgggcagcgtagcaagacctcgtttccaaaaaagtagaaaagaaattacctgggcattgtgacacatgcctgtagtcctactcaggaggatgaggtgggaggatcacttgagcccaggaattcgaggctacagtgagccatgattgtgccactgtactccagcctgagcaataaagggacccctgtctcataacaacaacaacaacacttttgaaaatattgaaacatttgcataacataagatggaaatgtgaatgtcctgggctatgaaatgtggaagagacaattttagttgataaaaatttaagatcaatttttaccaattaagcacttcactcaatagaagctaggtatgctcattagaagagatgatcttaaataaaactgtattctgaaggtcttgccaggatgaattaactgcaaacaggaacatgtgtaaccaaatgcactcatgacgattagagttgtttgagatataccaacttaaatatgacagtttcagtttgggtgggattggtacttaattctccttgttaaatgtattatgctacatgtctaattgctaatttacaatctttcctacttagtaataaagtaaatagatcaagtattactgacaagtatctgttttcccatatgtatggatcctcaggatccttgggtaatttaaggaggacagaggcctttctgattttcacatccttggtaggtagtagctatcatgacttctctctcatgtcatgaagtatactctttgtactctgacttcaggatgaatgaaagaagcaaaacttcccagggatttgggaagcatcaatattataatatttttaattaaaaatataatatttatcctctgttcctgccatcctaattactcacatctcatagggaagaggaagtgtttctttgtctttctagaaccttatctaatttttgatatccctgactgcagcactgctaattgtgtcagttttaaaccatttaaattatttgatgccccataaattttaagtcttatgtgtattttcctaaattttcagcatccatatataaaaaaaacttatgcagcttttcaaaatatagcacaattttaggcttctatcaggaggtcaatgagcactgtaaatagtagaaaaggggaatgatttagaaccaaggaaggtgattctgtaaacacaaccatttggtttcctgcagcttgctcactgggaattcacgaaaaaaaggcaaaagagattttaaaatcatctatagttagtagaattttttacaataatgagcctggttaatattagcattaacaacagagatacaatgcttgtctttctgtttgctttagcaggaggatcttacttagttaacatcccagtatagctgaacattatgaactgtactgcaccattgcaatgtataataatatgataatagtatttagattaaattattagagtatttgttgatactcgaactgtggtccaagggccagcagcatgggtgttacatgggagctcgtgaacatgcagactctcaggctccagctcacatgtcctacgtcactatctacatcttagcatgatctccagatgactcatctccacattaatatgggagatgcagtggtctagatgaataataatcatacacctatccaaaactatttttttttttcagaaaattataatgttgttgctcaaagtatttaatggaatccctttttatcccaggaattccttgtatttcaacaaattaaatagttggcagtgaagaagacattaacattaaaaaaggaagaaaatcatgatattttcattttccaactgtcttgttttctaaattcatttttgttttggagctgaaataaagacccacaagtccaaagaataacttaaaaaatctatttagtgacttgattacataaataaatctgtttcattgtgtactactttgtctacagtggatatttctatatgagttaaatttaaaccataaattataacatgaattaaatgtaactcataaattatcagttaaatttaacccttaaatttgatgggctacatatccagtgtataaagtttttacttcagtcaaaccctactttattaacatttccataataaaaataaagatttgagggaaaacaaaaggaattgaatagcttgatattatcaagttttgggccatatgcaggccattaacatgatgcctaataaataaaatgttgatgaactctgagtcttgtaaaaatatatagtaaagaaacttgtagatattagttttattgagagtagacctgattaagaaaatttagattatcatactgctttagtaaccttggggtcatgtttaaatcttctcttttcctcaactattgcatccaattaatgtgcaagttctgttggttctactgctaaagtacatcttgaacttatccacttctctctatctgtaccactaactgtattctgagccatcaccatccgaaaggtcttccctcttcctctctagtctctgctacacctgctacccaatcaaatttgcatatcactgccagagtcaccatttaaaagctctaagtccatgtcactcttctacctaaaaacctttcattggtttttcattgcttttatattagtatataaattccctagcatatcaataaggcattgcctggtcattttatatttatctcattccatattcttccttgttcaccacactccatgtccctaggtttctcacagttcctaaagtatacctgactctcgctttaaaaaggactttgggtatctgcctcttctgatgtcagatctgttttaatgtcaccttttcagagagcaccttcctgtcttatctaaaatctcgttcccctgtagttctctattttaattccatgtttatgtccttaaaagcacattacaaattaattctatctaatgtatacatttggtaaatgtatttgtttgttgcctgtcttcatcaaagaatgcaggctcaaatgaaggcatactttgtcttgcttactgttgctcactattggttgttgaattactggcaaaaagcaggcatcatttcatatttgttgaatccacagattctttaaaacaaatacaagaaaagtcacgtatttaattttttattccttggtcttttgtgcttcctaattcagtatgcaagggactgattttaaacaagtcttttcaagttcactaagtaaaaaaaaaattaaatatggcattttaacttttcaaagaatgctcagcattggaaacaacattaacaaaccaatagtctattttcaaggcacattttgtttaaatctgtatcaaggtaaccaagtcgtagcctggttatttgcctcaatctttgtgctgcctcatgattgactttaaggaagcaaagtttgctagttgccttatttacaattataatctattgacacggcatatagatcaaatttcagggctatatatgctcaaaaacaagaaggccaaactctcttggactcagtcttaagaagttgtgagtctgagagactgtgctcttacatcatgggattcttcattgaggttcattctctgagagtcatgtaagaggacccaggactataccacatttattaaacctagacaccccagaacttcagtaccaaatcattagatcaagaaggggcccacgtatttcagtcattttagtcggagtctggtgatcttttccctcatgtgagaggtgcgcaggtgatagatggaaggacatcagtgaaggaaggaagaagggtagtattgtgtaaagagagcatttgggaactaccatcaaatgctagttgtatttgcaagaattccaaacatcaggatgaatggtgaaaaaagatctattacaatgctttaaggacgtctggtgtatggatatttgaaaagagtctggatgattgaatgactctattttaagcctgaatgtttagacttttattgggttgctaaggctgctttaacaaagtgccacagacagtgtggcttaaacaatagaagcttattatttcacagttctggaggctgaaagtctgagatcaaggtgtccacagggttgactccttctgagggctgagtggcagcatctgtttgaagccatcttctccctgtatcttcacattgtcttccctctgtgtctgtgttgaaacccccctcttataaggacactagtcattttgggtcagtgcttactctgatgacctcagtttaacttgatcacctctgtagagaccctgtctccaaatacagtcacattctgagttcctaagcgttaggactttaacataggagtttggggagggggacacaagtcaacataataggcctttataattaatgatatggcatttcataatatggaaaataaaagagcattttgtcaaaaattatttgctttcatatggctctaaactacacagtacatccccaaaatgtaagaaatgaactggacttacagaaattaacttgtgctctatatacatagtgtatgactcataaaaaactataataaaactatggtttaataaagaagctaattagtatcactttctaaattggaatttgtctttgagtagttattcagccttaactggagcctgttataagcacccttttggggtagaagtttggcattaataacttaacactggatgctagaggacaaattttcagcagaaggagctgtatgtgctactgaagcctggagcttactagaggttgattttaatgtttctcttgctttcccactaatgagatctaaattataggacggatagactttttttccctttactcattatttaagagccagttcatattttaatttctcattgaattgcccgtaaaatattaaataagataaatgcaacacaattatccaacttaggaaatgtgcttttttttctttccttttaaattcttagctgggttttgttaagagcttcagcaaaatcgattttctctattttttgaaatggtgctccgtttgtatggctaggaagagggcactgcagttcaacagttggagtctttaggtgtgataaataaacaaaagctggttccattattcctgtggttttcctcatctttttttctttcgatggacacaaaataatgctgattttcacctttaggaaaaggttattctgccatttctcatggccattagtgatggaagctgtaatgtgaagtccattgaatggacttgtctcccaataccttttgtcttttagacacccacttctcctgtcgataccctgtggtgatttttacaaagtgcttggatggtcattctgtctgatgtgccagtgaggcttcctttgactgacagttgagcgtctgattcatacgcttcagtagctgttggaccacaggcccaagcctgatgggtgaaacaaatactgtagtattatgatatggttacctggaaccacaaatccagattcactcaaatgagttaaattgattttgatttgcagtctaagaaaataaggttccagaatgtcagccatctattctttcccctggtctttagctaagttgtaatactactagggtagattttatttatgtataatctgattatagcacagcagaaatagtcaaaaccctagttaataattttttttctacaaaagtacattcttatgcataggactatattaaatatttgtcgtggctcagaagtagatttagttttgaccagttagaaggtactgtgcattaaacacatggatatacattgtctctcataacaaataatttctcactctaggaattatttgtagtcttgacactattttttggacaaagataagaactcaccttaatttgtagatatgtcagactgaggaagcccattttttctcatctccatattttttactgatatttaaaaaagatattgggctctatatattaagcttctcttacatgcatatggagaccttggactggtggtccaaggtggtggttctggaatctgctgcttacacaatctagttaatttctaaacagaccaaaaatcaaagaacctacagaattataggcctaactcccaagcctctctataagtatctctgagatggatcctggtaatagatgtttttataaaagtacctcatgtgacttgaatgcatagccaggtttgaaaacttctgtcctgagctgactgagtgtcaataccctgttggtttagttggcgtctctttacctccaaatagtctatagtggagctgccagaaatctcttgagttcatgattgatagtggattatttatgaaacaagtctctggaagttttatgatataacttataattgtaagctataacttctattccattatatctttgaattttggtatgccttgcattaaaactactcttacagagaatttttattctctaatctcatatgtcaacaggcttcttttcaccctaaaaatcctgatgttaaaaattgtttaaaataacattgataccaaaagaagactaaaactgagatgagatgagtaaaaatgaatttttaatggtatcaaattatcctcttttgaatggatgagtaaaagtttaattactttttagaaagcatatcatgtatcttgttacccccagtgaatcctataactagaaatatatcacctacttttggaaaacaaactgaaataggatgcacatgaagggcactttagctgtctgattaagcagaatccattgatgtgtttgtttccaacaggcccagtctttgtctctgcatcccatacaatgattcagtacaaatcactttataaccttacttttctatctttcaatatagtgtttgttttcagagtttatctttagttatctgtctctaggtttagaacatcttgttttaaagtagcagaaattagttcatactcatttcttaaatatggactctgacttccaccatgtctggatgtatattttaagggcttatttccatcagaaatgttatgtgtgagatatatgtgttaagctactggctttgggcctgtttatctttgacttgttctgagtttccctatcaccttaaaaacatttgaaggccagggctgaaggatatgatagaataacacctcttttagcaacaacatgtgactctatagactgactctgatttgggatatgctgactctgatttcttatattgcaggctcaaatgtcctaatttaccctttgtgtatctctatgaactattcttgagcttttatgcaatcctgtgtgaaaaatcagccagccattttattttggcatttaccgactagcgaaatactaactagtacccactcaaagagtgcaatattcaagaaaatgctgagtggtatttggattttagcttgcctgtcatgaaattctctttaatattttaccagtcctctttaaaattttgccagttgaaaaaaacaaacaaacaaataaaaattactgtcttataatagtttctatttcttggttatgtaacggaagtgtccacttccctcttttccagcttaggagctttagtgtgctcagttgaaccccaaagtatacatacgtgagcccagcactatcacctcactaggcatccagcaggtccctgggtaagggatctttgaaagatctggaaagagggatgggacatctagttagaggcaggtctcactcaacagccagagggaaggggcaatcagcaagtgggtgtgacatttcccccgaatactcagctatccaggtcctgatgaagctcggctcttgggcaccctgcaagtgtccttgctcaaggtctttctctcagtacactgggtccagtggaatatctaagaattatctggatccagggataagatgaaggccttggatttcatgcctctctttccatcaccattaagtcttttgccatttctaacttttcttttatcatttttttcccataataatcctcaataaggatttctgcaaggaaattcctaataaccctttagacaagaacacaagtagaaaaaaaaaaaaagttgttcttctcctgcaggggaagcagggctcaggctttagacagatagtgccagatcttatgagataattttcactgattatgggtcatgaccacattagaggattagttaattggcttctcctgttaacatcaacaatgacaaccaccaccaaaaggaaaaaagcaaaaaacaaaaaaagctagctttcatacaaaaaaatagggtatcttctactctgtagcattcaaatgaagaatataggaaacaatgaagaattaactgaataatctttacaatgcaatgcaaagtaaattacaaaaataagtaaatcactatagctacacatgaaatccgcttgcacttactgtgcatccacggtttcagtccaattcaggtacattaattgtatttattccttacaagatttttatgagttatttttagacccattctaaagatgagtacaccaacaggttagagttgataaataacttggcctaacatcatacaattgttactaaatgttatacgaaatcttttttttttttaatttttttttttttttcagacaggttcttgccccatcgcccaggctggagtgcagtggtgtgatcttggctcattgcaacctctgtctcctgggttcaagcaattcttaggcctcagcctttcaaggtagctgggattacaggtgtgtgccaccacgcccagctaatttttgtaattttactagagacgaggtttctgccatgttggctgggctggtctggaacttctggcctcaagcaatccccgcctcagccatccaaagtgccagactacaggcgtgagccactgcgccagcttcttttttggtttttacatttttccttttggctgttgttgtcaacattgttaacatgagaagccaattgcccagttccctaatgaagatccaccactgtctttctaaaacttcagttctgcttaccctacaggagagaataaactttttttttttttaagagatggagtctcactctgtcactcaggctgaagtgcagtggtgcagtctcggctcactgcaacctccgcctcccgggttcaagcaattcttctgcctcagcctccccggtagctgggattacaggtgtccaccaccacgcctggctaatttttgtatttttagtagaattggccaggcttgtctagaactcctgacttcaggtgacccgcctgccttggcctcccaaagtcctgggattacaggtgtgaaccactgcatccggccagataagcgtgttttatgttttttctccttgggttcttgtctaaagggttattaaaatttttctgagtttttaactttttcatttcattatttttttctataataaacctcaatgataatttccaaaaggaaactatattgctatttctccttcttaccttgcagcattagatgaaacctatagaacactgctaggtactaatggaattaatgttgattctgatcttattaaaagaagtctgttgttttttagcttctgttctttagcatatgttaaaagtctcatactatttgaaatatttgcatagacttttaaaccggaatgcctgctgaaatttgtttttcagaatttatttatataattacaggaattttcacctctaatttgttagcatttgaagtctattgatggatttttatcatgtggaaccatatatgcattcatggaataagtacaacttggtagacttattttaatatattgcttgatttggtttgcaaatgtccatttcctggcgttctagttaattgaaatacttgctttccccaaagcagcaacaccagtactttttctttcaataataacattggtgttcatattctaaaatatctagcttttcctgtgccagacttaaaggttagttatattttaatactacatgttttatgcagctccttaaacctcaaatcagaacaacactagtgatagttgtctccatatgttctcattagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggtaaggatcagaactgttctgcctccttgctgtatttcagagaaacccttgctgtctgtctgtctatctataatttaatatcttaaaaatgaatggtagaaatggaataaatataagattttagatttaatatatataatacatatgttttgacactgtggctaagattctgtttaatgtggcttctttgtttattcattcaacacatatttattgtgtatgtactgggtatgcggcattatgctagtagctaggaacacagcagtaaagaaagacaggcacaacttctgcccccacggagcgcattgtcctatagggatggcaaatgttaatcaaatgactaaaaatagaagtttaaaactatgatgaattttttgttagaaaatatatagatattgctatgagattatgtacaggtaatcaggccaagaagtggggtcaaagagggttttcttggaaagtagtgtttgggctaagatctgagggtgggctggaggaagagtgagtggagggagtgacccaggcagaagcagcagcttagaagaatccttgtggcaggagagagcacagagtgttgcaaaaactgaaagaccaatgtggcttggatcagagaacgaggaaagatgatcctgcaggatttgagcgacaaaaaggactttagacgctatcctatagcaggaagaagcagttgtacagtaagacgagttcgacactaattacagcacagaggggaatgggtaagagaggagtgaggaccgtgctggaggagggttatgcatgggaagagcacattctggggagcgacaaagggaggctgcgtgaatgccatggcacttgaggtgggcatggctttgataggtagatgtggagggagaaagggcatgctagggggaagcagcagcacaggctatggcacagaagcatggaattttagaggaatgatagggattttagcctggttgtagaatagggtacttgtcgaagaggagtagagataactacagtcggcagaggagagaaccaagttacaccgatagtatcaagcagctgtcagcagggggcagcagagagcttcagaaatgggagaggctaaggagtttgatgacctcctctgctggggaaaggacagtgatatccagctcagagacgtttctatctttagccctcttcccccaaatgtatattatgtacaaaacactctcctaagcaatttacaagaattagcttatttaattctcataataagactccaggcagatattgtagctgtctctattttgcagacgaagaggctgaggcatgaaaaagttattgcccatgtcatagaactaaaaagaggcccattctgaatttcaaggctggcagtcggacccagaacattgctccagacagcaactttaccagctatgaagcttctccctgcattcttacacagacgcttcaggcaggttcttcagacccatgcaatttcaaccccttatgttcatgatcatctggagttaggcagagcctacaaattgcaagggaagtagcttgtctccccaagagtgaatggtctgcaagataaaaaaccatgaggaccacaggaaatctacgtttctggaccttgcccacctcagccctttatggatctcaggtggtcctcctggccaggctgggcccctttgttgatctgtgtctgagctgaattgccattggggatggggtataatgtttgttcctgaaggtggagagagctgctgacagtctggttattcctcttggtaacctgacctaaggaagcatgatttagctgtaagagctctgcccttcttcaaggaagaaaaaaagaaaaacttcatttgcgaagatgcacattggttgaatccaggtgatatttaccttgtccagctggttttcctggtttcaaaacagagaagatagttaggatttgaaggactgtagcttccagagagcattttgatgttagcatctctgaatctgatttgacagcattgttatcctgttggagaatgatgtgagacgaggctgggagaagttaggctgccaactgtgccacgcatcccccgccatcccatcccaacccacacactgattacctgaaggctctgctgacagatagtaatttgcttgatagtttgggactctgcagaagcctgagggaaaactgtatccccaaggacccattgtagttgtgttcacgaaccttttttgcggtcagtgggttaccaggtcacagtcgtaactgttagtgcagtagcatagcttctttcaggctgagacagtgcagtggcatttgagctgcaaaatgcaagcttccacgtgataaaggcccagctgtaagaccgactaatggatttctttggcttggcctaacctgggggtgtaatctaagggttaataaccacttctgagtggcaggggaactttttaccaatagaccaatgtctgtggctcacagtattagcccaatgaacacatagattaatcagctgaatatttttagaactctagagaaaaacccagttggaagtgttttgagctgcagcataatgctctcagttgaagtctgagaaagaagacagtttgttaggcttgactgtcaccgctagttgtcacagacctgttataatcaatcgtgtgatcgatccttactcttgcatgcttttgtcatatgtggaatggtggtgtagatttctttttttaaaaaatcttttataaacattttggtttgtgtctttcacctagggaatgaaaatctgccaaatctaacactcacctgaacaaaacaaaatgaaacaaatctgctcgttaaaattttctttgcatagaaggtattcaggttgtgttttgacctctgtcactgcagcactatttataacaaatgtctacccttgcctcccaaatgagttcacaggcttcatgaagtcctcagctacccctctgttgtcaaagtctgacttcctttcccttgctcaacacactgatttcggctctcccattgcacggaaatgctgaccttggagccaagacaactgggctaaagccttgtcaccactgggtagctgggaggatatcggcaggctagttcctgcattaagaaaatgaggatagtaatttccaccttacaggactataacagtagaataagataattgatatgaaagggctttgaaaatcacaaagttggaattgtaggattagttccaagtctttaagtttctaccaaaggatgttatagataatgtagatcctatctatattacacttcaaagatggaaaaaaatatgccccccacataatatattcatcatatatctgctcctggagtaagaaaggaaagtgtgtgtgtgtgtgtgtgtgtgtgtgtgtgagagagagagagagagagagagaaaggctgaaagctgcagatttctttcaggatcaaccttggataaagcatatctttagggccttttgacccctctcttttatctcaggccctaatacctcaggctacttgacttacctgcccaaatgctctacctctccctctcctcacaaccttggctggctcaatagtgctttcaggaagcttttggttggtccagagtcagattagcctggagctggtgtgaaccacaggttaggctagaagtgcttagtagtgtctcagatcaaataggcttttattgctgtttttctagtcttgtgtttattcatggacttaatgagtgtgtatggagcatctactgagaactagggcctgtattaaattacagagtcagaaactcagagggtagaatgtcttgtttgacctgcaaaggatttacagtttttcaacttagttgtcagcatttaaagtttggaatactttatgttaaaagatctggatttctgtcttttcttgaggttttattgtttttaagaatggaaatgtcttatcaaattaaattctatgtggagcctatctatagctgctctggttgacactggctttgttgagctgggtacatcaagatgaaccttcctggggaccctctttttattccttagtgggtcacatattaggttagacttcctagaatgggtttcaagcagagagacatggtcctcttgagagggctcctctagggtggggcagaggtgttaatcctcaaggaggacattattctcacccagggtaagagcagcagcatgggctggtaagtgagtgcagagggactgactgagaatccagattgacaagatgggggccaacaaataccattaaccaggtggattagggaaggaccacagtacagtggttaagacctgcggcttcagagtcacactggctgagtttgagtggccacttaaggaataaccttgggcaaatgtctgtgctcaatttgttcatatataaattgaagatcacaacagtgctgacctcatagttgttaagaggtggttgtaaatgggctagtgcatgtaaaatgcttacgagagtgctgggaaggtagaaagggctcaataaatgttatctaccatcaaccaaagcgggtgatttgtagtcacaggagatcaaaataaaccaggcctccagctgtggccaggctgagatgagtgggcaccctggaccagctacttctctggtacccttcttttttagatggagtcttgctctctcccagaggctggtgtgcagtggcacaatctcggctcacagcaacttccacctccctggttcaagcaattcccctgcctcagcctcctgagtagctgggattacaggtgtataccaccatgcctggcttttttttttttaattttagtagaaatgaggttttaccatgttggccagactggtctcgaactcctgacctcaggcaatccacctgcctcggcctcccaaagtgctgggattacaggcatgagccaccgcgcttggcctctgatacccttcttaagtatttattctttatgttgattaaacatttgctcattcttcagtgcaatggttgagtgattccgggagaagatcactgatggctgtgcccaatgctgaaatctgtgtgaggctgggagccttgggagcttctgcatgttagctgacatgtacctttcaggagtgtgtgcctgagatcacagaacctcaaactaacacatgcccctttttaacttctaaactgtgtacatacctcttgaagaatgttttacacataaaatgaaaaggggaatgtattgcatcatttgtgctatttggtgcagacccatcctaggggaacctctggccagagaacaggtctggggaagggatcttgactgggaccagggaagatcttgtttgcaggctggttacactgatgttgtatgcaccgagtgccaggggctgggattctgagtccagcagctcctactgcaaatgaccactgtgggctattcacatactgggcatctgaggcaagcctgaacctacgttaaatgattcttttttgtttcctgccaaggcacatagtatctggagagacaggcacagcagggagcttgccatgtgatgctagctgtggcaggagcaggaagaacctacgcttccagctcgagcagcagagttctcctcccacccagctttccctggagtgaacccctcataccctcagcagaacagaagccccacagtggagcaggcctctccattctcagcagggctgatccatcatacattggaggttttggtcctctgatcccccagcgcaaatagtggatctgccatgcagtgctctccctgagacatgctgagacatcttgctgtcacacatgatgctctcaccatcctgttgcatctccagtgatattttagtgcctctaggagggcaccatgagtaactgagtggcagacccacctcgctgtaatctcacggtgccgtggaatcaggtgtggtggtttagatgggttaaagttcatggttcagtttggactatgaggaatcagatatacatagaagctggtaactctaatacaaatgcccttggggaccaggcagggaacaacagtgtatggcaacaggccagagaaggatggagctcaaggaactgaaaccgtgtcctccctgccggaaggcattccaggtacaaacgttctaaactgctgtgtggagcatgcagtcttagatctcttcactagggggttaacagagctccagcaacaaaattagaatattatcctggcttccatgtggactctgctccttctcagagcttgatgagcctgaagctgaggatgatgcctggctgggtggaatggccagtgagaggcctttcaagccacactgtggtccttggtaaactctgtccttctcaggtgctgatgcctcatctcagtgtgttgtgttggctccttcaggggcacttgtatttcaccaaaggacatctaaagagggaagtctaaacatgggagtggctgtcatgggagaattctgggcctcacggcagatccccaggtgaaatctttcgagggaggggtgttcccatctctttggtcatccaataaggatggcaacgtgaaagccacaaagaactcttgtgtgtgaccgtcggaggatcctttcgggccactgtgttcctgtagctagagaatgccaagtcatgagccctcaaaagagggctttctcatttccctcttcctttccctttgaaataatttacattgatcacccgctgaaaacaaacaaaaaacccaacttacaaaatatctctgtactgagaacctgtgagcaggagaaacttcaggcatccaggagctcaaggaagtgactgtggggcgcttctctgtcccacgggatgagagagcggagcagagtctaccaggcctcagcagggcataacgtgtcctctcctggcgtgttgagaagatatttgaataatctaataatcaaaatggtaaccttgaagtaaaccccaaattataaaatttcctgaaaatatagaaattaaatcagttttagtattcattgtaactcgagggaataaatgaacaattggttatccatctgtatcgaatgatgttagccattccattgaacaaatgaaaatgagtgtatgttgaatgaacagattgattcctttaactattatgggccgcttctgtgttttacatttagctggaagatacttttggatttactgaaattcaggtggccagacctgacaactatttttttttttgaatcctctaaaattctgaccaatctctgcaaaaacttcatgtgaaagtgcattctgatgacaggcgataggtcacttttctttggagggatatttgcatggatggcgaagtcacccaaaggagcagcaatacccagggaaggattagagagagcctctggcctctggaatgctctttccactttgctattagcagattgtaaaatggtctcactttttccttcacaatgcagaaagaaagcaaactctcgtatccctgcctggccctgtgcagccctgtgatttcaggctgtgctggaggagacctcagcggcggtatctggtggtttagttattcacatgtgtgctgtgctttccccaccgcaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcatttaaaaagac

SEQ ID NO: 36727 - DNA, 53192 bp, Homo sapiens
ccgggacccgcccgcccgcgggaggtgagcgcttccgcgacgcgggttctgaggcgtttgaggggctctcggagggaggtgacagggaggggtgcgtgtgcgtgcgtgtggggcttctgtgtccagaggtctgggggtgacgtcctttgttttgggcaggaggcgggctgggggcttgcgggacctgtgggcgctgcggggacgcggcgtcgatgctcaagaaaccagaaactcggcttgaggagttgctgcttttttgtcggaaggtcttcaaatgagagtaaagcgttaagagcctcactcctgagtctttttttttttttaagataaaaactatactagagtccagcgacttcttaccactctgaatgtgagtaacaaattgtgaatcaaagcccgaatccccgtggaattcattccgaggctgattgcaatcacttggagtcgggcgcgtcctacctaaaccaggcagtttatggcaaatacctgccttgaccgtgcttaaattagtgaacttttgggcaccaactggtcgatttaccatagaaattggtagttgctgcaaaaagagtaagtaaacataaaacgttaagaaaactctttcctgaaatctatagaataccttcgaataaaaaaaaatctgtaatttccttgttttaatagtaaccagttagagcatttgaactagtagcatttgaactctgttaaagaaaacgagtaaggatggaaattttattggccttaatgcataatttaaccacaccgtagaattaaacgaagtaggttcttggctttcctttctatcgggtttgcattggagcgttcgtggggtgtgttggaagtcagcaggaccaacagagctgagttttcaagctgccactttagaagggtgtaccgaagatttctggcctgataatagccggtgtgattgcttctgataaataccacttttgattgggttctcactattcaggagcagctttagttgattgtttagaagtgaataaacaacattaaaaagggtagatcactgttggttgacatggtgtgtgtaaggagaggggggcctcagggattaggggtggtctcacacctacttctctttacaactaccacggagtcgttttcgcaagctatttcccaggctattacttataatttaagtattggagcggtttcaaagtaaaaagttgtgtgatgttgttgtagaggcatgtctccaaaatcctctctggccagataagcagtttaattgtattttcttacattcttaaatcagatattcggtgttacaaacatattttaatatagatctgagacttgcttactagactaattaaaacagtgataagatatagtagttttaaaaatgaccttttcataaacataaaatatttctaagatctatctttagaaatttgtaattagttctctggaattttaaaatggaaaatctgacatagatttaggttattctaaatttatttgaatatatattaaatatgtctattttataataacagttactgttattactacagcactatgttgagtacttttgttatgtatcagagccaggtgctgggtcaggtgctttataaatcatgtctgtaattatcacagcacattttaggtaagtgtcattatgcccacaccaactgagagtttagcgtaagatcatataactaataagtcactgtgccgagattcaaatcatggcctgatcccaaagcacatgctgtattgcttctgtgtgtctgtttaaatctctgctgtgtctctggattccatttgtagggacaagttctactttaaagatgcctttaggtgctgtgttttgttgtagcttcgcagaaatatttcaatctttctgttggaactatcttgcttcattattttataaatcatcttataaatcacattatattttcaatatcttcttaatcatctttatacaaaacataagtgaagagtaagacttttctgagtttcttacataaatatgaatagaatctttactgtggagaagaaatgtattacagtccggttttctcactattgtaggattctttggcctcgtcataattcctgtcttcttcccagggaagaaattaaagtttgttgggcctctcttatgtgcaaagcaatgtcgttggtgttgtgagatgacaagaaaatgcttcctattcagtagttgtttctggagtttttgtagtatttttcttttctccccattcctgccttatatgttgctgctggtttatcttcctagcagagatccaacttggctattcctttgtggggaaaaaataccagcaaggttccccattgtgtaaataaaaggctgaggccgggtacggtggctcacgcctgtaatcccagcactttgggaggccgaggtgggcggatcacgaggtcaggagttcaacaccagcctgaccaacgtggtgaaaccccgtctgtactaaaaatacaatagttagcccagtgtggtggcacacgcctgtaatccaagctactcaggaggctgaggcagggaggcggaggttgcagtgagccgagatcgcgccactgcactccagcccgggtgacagatcaagactccatctcaaaaaaaaagggggggctgaatatgaatatatgcttctgccacatgttcagagtccctcacagtttgttactgttctaccttctcagccttctctttcactactctgaatactgtgtgcttatcctggaacacattctgtgcatttctaccctccctttttcttgagccattcttttcccttgactggaatgcctttccttcatttggctaataagatctacccatccttcaaggtgctgtacaaaattccttgcttccaaaaagttttccctggtccttttcagttagaattattattcccatattatcacaaaacattattgaatagaaacatttattttcccacagaatggtgataacttttgggaagagaagacaaaatcatgtttaatatattttcctatggagaattctaaactcaaactctctagggaccctttctaagcatttataatatttctgcatttgggatttatttctgctttaaaatgtgtttgggtcaggtgcagtggctcacacctgtaatcccagcactttgaggggcccaggtgggcggatcacttgagaccaggagtcgagaccagcctgcccaacatggcgaaaccctgtctctgataaaaatacaaaaattagccaggcgtggtgctgggcacctgtgggaggctgagagaggagaatcacttgaacccaggacgtggaggttacagtgagccaagatggcgccactgcactccagcctgggcgacagagtgagactccgtctcaaaaaaaaaaaaaacaatgcttagtggaaaggaccatttcttttctatttcactattgagctttaaaattatgtatatgtattaattgattgaagctgatgactggaccatcgttggtaataataaatggctatgcttaccaaaaaggtttatatatagttcagatgatctaacctggtggcaagaaaagtaaattatatttattgtctgatgaatgttaccagtttgtgtagatccatggatggaagaaacagaccaaaaacaaacaaagaaacagaccaaaagttattggcatttaagtggcagtcaggatcagatagtttagataaattcgaagaagcacaaaatgtaacctggtttgcaaactttttactgccagtggagtaaagcagggctaggatttctttgataaagagctagcctttcttgtctgctctgattgcataccttggacagtgcctggaagtccacctagctgtctaaagggagtctgtctattttgacttcctaatcagataattaaatgtgaggcagttagagttatgtactagttgatctttctatatgtctctgtcaattcccgggatatggaaaaaatgattgccttttctttatggttagatgccgtgatctagcaattttgttaattttgaggtttttggagcattgcttggaagatgctattaagagacagatttgttccttgcagattgttagttgtaaatagtagtggaggttggaggttgaacttgatgacttctcaatatcctttcaaacctacaaattattttccagttcttcgtcctgtgattaaattttcttatcctaatgatcaaatttgtaatttaatatttgttgcaaattttactagtcttacactatatacacacacattgtatctaggaagtaggtttgttaactccatgtaatgaggaacatgagtgaacacattattgctaaattggctagagagttcttaaaacatgaatcatgaatcaagaattgcttgtttgttcagtgaatatttttttgtgtgaagtgctacctaattgttatggagattgtaatgtaagaggcacttttaaagatattcttcccttgagaatagtaagactatattataaattgctcttattgaaatagtgaatagcattctgtcttcttgcttattttaatggtcttagaaatggttctttctacatgcagttttcatcaagtaaaatattttgcaactttatttatattcatttacttattcgttaatttgtgaaacatgtaaatgctacatgtttacatcttaaggagtatgaaattaacattttataattgcaaaatttagaatttcattaagaactcatggatgagaacaatattttgttttatttttttagagacagggtctcactctgtggcccagactggagtgcagtggtgcaatcatcgattactataacctccaactcctgggctcaagcaatcctcctgcctcatcctcccaagtagctggggctatagtcacaggccaccacacctggctgatttttcaattttttgtagaaacggggtcttgtacgttgcctgggctggtcttgaactgttggtctcaagtgatccttccaccttggtctcccaaagcactgggattacagatgtcagccaccgggcctacctaagaaaaatatttaaatttaatatcagtatctgtggggaattggttccaggaccccctgaggataccaaaatccatggatgctcaagttccttatataacatggtatagtatttgcatataacctatacgcatcttcccacaaacttttaatcctctctagattatttatgatacctaatacgatgtaaatgctatgtaaatagttgttatatggtattgtttagggaacaatgccaaggaaaaaagtctacatgttcagtagagacacaacttttcattttctttcctgaatatttttgatacgcggttggttgaatccactatgcagaacccacagatctggaggacctactataatttaatttaattctaaggtaagttaattctaatacctctctttctgctccattttataaataacagcccaaacctcatagtggataacgggagataatatcattgccagtttagctgtttgtgtaatctagacgcctttggagctattgcaatgagtatccacactaattccctttattaatttttttattaaggaaaaaagaggcacagtggaattctgaacaaaaggaaaagagatttgatgtgttgatagctgctatttgatgtgttgatagctgctacctttttgttctttcttaaaatactgctccctagcccgtgctgtggcatgcacctgtagtcccagctacttgggaggttgaagcgagaggatcaccaagagttccaggctgcagtgtgctatgattgtgatgtgaatagccactgtactccaacctgggcaacatagcaagatcccatctctaaaaaaacaaaacaacaacaaaagatagtgcttcctttgttggccaagggaagagataagaggagtactattttgtgtttcttgcaggctaaacttgttattaatgtgaaaacctcatttcctcttggaaacttcatcagtattcccaaggctgtttctttctaccttccctcctttcaccttctgctctgttccctattaacttctagctgtacttaattaacagagcagtgagtattcattagtctggtttatgatatagctgaaatacttaaaaggatgttatatagaagaggaattaggctttattgtatatggcagcagaaggaagaagtagaacaaatgggtagaaatggaagaattgctcaaagtatggaacgattttcttacaggaatattcaaaattaagattagctgctttatgacctatgtaggaatgctatagtaagatagtggactaactgacctctaggattgtttataacactgagattccaggactttatgattgtatatctaccaatttatctcatatatgtatatgtatatccttctttgtctttctcaactgttatctcagaggttatagtttatgtctgatatgctgtagctctctctaatgtatcggtatggattcatttttatttaaatattctcagtctttatcactgaagattttacctttattcctctctttttctttctcaccctcctattagatatattatagagctgctcattttgtcctccttttctctgaacttctctttattatttttcatctgcttattctttctttagctgcttaactagtacattgagggtttgttgttgttgttgttgttgttttggtgggggcagacagagttgcactgtgtcgcctgggctggagcgcagtggcataatcttggctcactgcaacctccgcctcccgggttcaggctcactgcaacctccacctcccgggttcaagtgattctcatgcctcagcctcctgagtagctgggattacaggcttgcatcaccacacctggctaacttttgtatttttagtagagacagggtttcaccgtgttggctaggctggtcttgaactcctggcctcaagtgatcacctgtgtctgcctcccaaagtgctgggattacaggcatgagccattgcacctggccctaactagtacattgagttattaatatcagtgttcatggtagttttttgtttcattttgttttggggcagggtcttgctctgtcaaccaggctggagtgcagtggcatgaatattaatactgttagtaacagcaatccaaaaaactataatccaaatgtccatcaacagcagaatgaaaaatacatttggtatacaatggaatatacatgcaagttgtagctatgcacaacaattgagaaaaatctcagaaacaacgttcagcaaaatcatataaaactaaatggtatcttatttaggactatactgacattcgtgttaaagttgtaaagacaagcaaaggaataaggaacaaaatacagtttagaaatcaccttagagggaaaaggaaggagatgggttaggttggactacccaggagactttaaaggcaggtaatgttcttattttagactgaatggtgttatataaatgtttgttgtgtcattctttttaccatatacatatttcccaaatgtcttttgtacctacccaatattaataaaaaacattttaaagaccttaaagagtttaagtagaatatattttgaaagcaaatgaatccaactataaccgaagtatcagtgtgatatcttctttgaagaaataaatttactgagtttggagttgactatttcaaataattattgaattttcatttgatttgttaatagtagtttttaaaagtttgaagcagcaattttgtttttagatgctaatatgatacatactgttcttttttgtttatagcagaaaatattacataaaagtattaaatttcaaacatattttaaaaattacagttctcaaatctcatctattcccacccctatttagaagctccatgatgacagttaagccctgtgctatcttctgtattgattgacatgacagcagtctgcagagttagcttgtgattatgtacagctcagggttactgtaggttgttctttgaaaataggacttcaagcaaagcatcttgtattccttttgcagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacaggtaagactattgctgtcttaatggatgacttttaatccttattttaaagtgtttttaactctgatgaccatttcaagtttcagttgaaaatactcaaatataccagccatagtattgtctgtagacaatattttctttttgttgtaagttttcctttctgtaagaaaatgatagtagagaccaattatgtactatggtttgtttaatgttctctggaagagtttatgaataatttctttataatttgtaactttttatgtaatgcaaatatgtaaatgaaatatgtttgaaaatctttggggctaaaaggtggattttttaaaaatgtggtcagctgaaggaccaaacctttgcattgtaatttaatgtgatcttttagacatgaactttttatttttgatttatttttattttttgtagtgtattgttttgattcccttctcatttcctttttttgtatattttttattttattaattttactttttctatattatcagagatgggagtctcactatattgcccaggcaagtctcaaactcctgggctcaagcaatcctcctgcctcagcctccagagtagcaggaactacaggtgtgtgccactgcacctggctttttattttatctttaaaggaaattttatttcacaaccattattactgttttaaatatgtacctaatccacattaatataaatacattattattaaaatacaaacaagcgctgttcaaaagaaatgtcatttttaagcttaatgtctagtgacattttgtgttgttttgctgatttaatacttaagaccacatttttacatgaagtagtggtttggtaatccctaatttactccagaaagcaagtcaggctgaggaaaggcacccacatgcattctctcacaagcttcacggtccctagggaaatggcctggctcctctaggacttacagtgttcccttggatgcccaaatggattgtctacattcctggtagaaggttgcagattgtaaggaccagtgttcccacctttgttctgcatccacaagtgtctttcacaaatacaacacactccctttggctacaccttatatataataggttatgcacatgtatgtgtgttggtgggggtggatgcttcccactgatctagatcaggatccaaatcagacatacacatcaggaaaggagggaagatagccaggaagtgatagctgggcagaatgaaggtacagaatgggcaggtcttcctgatttttcagaagagcccaggaaatctgaaaatctgaagagtgtgtgtgtgtgtgtttttgtgtttttgtttttttttttttggagacagtctcactctgacgcccaggctggagtgcagtggcacgagtttggctcactgtaacctccgcctcccatgttaaagcgattctcttgtctcagcttcccgagtagctgggattataggcgtgtgtcaccacgcccagctaattttttgtatttttagtagatacagggttttgccatattgaccaggctggtcttgagctcctggcctcaagtgatatgcccgccttggcctcccaaagtgctgggattataggcatgagccaccaagcccggccggaaatctaaatctttattgtgctgtctccaaattctgaaatgttggcagctaatgcaaatttttttttaaaaatgtgggttgaacattttaaggaggagaaagaggcctgtaacagacacaactctctaaaaaaccacacaggcaggtgggggaggtagagctcaaggttttgagaaagctgctctccaggacgtaacatacacttaccctgggactccgaggcgctaaccctcctgcacctcgaggcccagagcaccaagtgcgatgtccccatctcctggccttgcccacctcattgccctccatatctcctcatcacaccttcgattccccaaaccccataggtttctctgcctcccagactttgccccttattccttggatggcctagaatgccattacctgccatcctcccaggcactgcctgttgcaagccaggctcccattctcattcctcactcctagagggttgcatacagaccttcctattgcacccttctagatgggctgcttaggtcagtgtcacccacagacaccatgcacccagtgacagtctgtgagagcatgcagcctacccccatccgtgtgtggagctcagccttcataaatgagcatcttgaaggaatgggtattaaataaagtcggaataggtgggtactttgtaaacatgataaccaatagccagtttaatatttagtgttaaatattaatgacatctctaatgcaattaggaacaaaacaaggctatctgcactatgattattaatattctgcaagttctggtaattgcactaaacgataaaataaatgcaaacttaaatattatcatcatttaataaggtgattagggaatatgtttttgtttttgtttttgttttgaaatggagtatcactctgtcacccaggctggagtgcagtggtgtgcaatctcagctcactgcaacctctgcctctcaggttcaagcagtgctcctgcctcagcctcctgagtagctgggactacaggcgtgtgccaccatgcccagctaacttttatatttttagtagagatggggttttgccatgttggccaggctggtctcgaactcctgacctcgggtgatccacccgcctcggcctcccaaagtgctgggattacaggcgtgagccactgcacttggcctttttttccccgttgagacagagtcttgttctgtttcccagactggagtgcagtggcatgatcacagctcactgcagcctcaacctctcaggctcaagcaatcctcccacctcagcttcctgagtagctgggactacagctatgcctggctaatttttaaaatctttttgtgaagatgcgatctcactctgttgcctaggctggtctcgaactcctgggctcaagcagtccacctacctcagcctcctcaagtgctgggattacaggaatgagctgccgtgcccagctggtaatagattctttatcaaaactgttacaagttaattattagatgaacatcagaatatagtagcaattaatagaattcaaaatctcaggagggtgtaccaaattttagatgtcttaacatatttaggaaatgggagatttatcatcctgtaaatagttcacgttaggaaggttcatgccaaggaagttaacataggtaagatgaggacatttctattaaaaaagagtttcaagtaaaataaaatggaagacatttaagataattaagatgagcttttaatatacgaaatgctgccatcctaccctttacataaatttccagaaacctgggaattatatacttttttcttttctcattctgtatccagcatgaagtattgctggtttcatctcctaaatgtttctcagattcatctactcatgtgcatcctcccagttgtttgaaaggcttgttccccggtgctgtaaagaaatagcacttgaacataaatttaatttatttagtaaggccatttttacttgctgcagaaggggtacactcatcagcagttttgcctcgagagtacactgaacaaaggagacagggtcatttataacctgatgtatccaccctactgctgtgtctggtttccattaactggaacgggacctcacattctgtatttgtcccgattggctagcaacttagaactttttaaaagaggcaaaggtagaggggaacaaaggaaggaggaagtaacttgtggaatgttgagaaagataaaaacacttttaaataaggaagaggaacaggctatgacctaatgcttgcttggaccagtgtaagcatgctagggcaaatacttaggctaaattgtgggagctaagaacataaggtacattgatttccttattaccgctagcagatatttaagaatgttaacacagttctttgaataaattttgcgtctaaggaataaatactatttattcctaattagatggggaggaaagtctttgaagaggaacctttactttactttttacaccgccatagctataattgagatcctcaggatcttctttccagactgcctccattcttcacctcttggaacccgtcgttttgacttgtcactagtgggctcaatctcaaaacacagagctaaccgtgcaacctctctgcttaatacctagggtggctcctagtcacccggccaagctgaacatagaacacaagatcttcattatctggcttctgcctattcctgggaccttacttcctgccattcttcaccttgcactttgagctctggtttcctgcatgtcatgctgttttatatttcagtgtctttgctcatgctatgccctatgttgaactcccttcccactttctttgtttagctaattctactctaagatacagctcggagattatctcctcctggaaaccatttctaagctccatagttaggctctgtggcctccgtgtgctcatattacaatctgtgcatttttctttcttagcaccaactgtattaaaattaagttaatctgtttttatggtgctcccttcctcctcacctctccctttgagcattagctcctcagctgtggtcactcctcagcagccatgataattagcatgttgtctggcacatattgaacttcaatggaatatgaacgtaataagatgtttatctgtcttgctaaatgttttgaatagtattgtgctttctaatatggtaagaacagtagataagtaggaatggcttgtacctctgcctgttggaagatcttagaattgtcctttttctgtgatacagtctagatcaaacatggttgcactttgctataggacttcaccaagggaaacttaaaaatctgtactgtctgtaataggactataccaaacaaatctctggctttatcagtgctctaagaccagcattctgtatattgattggattgtcgtataattgggggtaatgatttgaactctttatgttaggccataggctggtataagttattcttctgctatagtaaatccttatgaaatgttttatccatctggttcttccattgtggaggtcctcctctatccctggaggagtttctgtggcacaatgaatttgtaattttgaatggaatgtttcttggaacactaagtaacctcctaaggggacatcagaatgctttattgaaatattttgcacctatttcaaaaggtagagactgatagcaagtacaatttaagttaaaaaaaaattatatggttgatttttaaggaattattaattttttatgtgtgataatggtattgtgattgtattttttgaaaaagattaatcttttaaagatacatactaaggtatttacaaattaaatcatatgctttccggaatgtacttcagaccaatctggggttggaagagtaacgatcagagtagagatgaataaataatatattgattatatatgtgtaattattgacgttgaaagatggatacattgggtttgttacactagttcctctggttttgtgtttctttggaaaatgtcatttatacttcttactgtgaataataagcattttaatactttaatattgtaaaagttagattcttgcatgtaagttgtgaaggaatacagatatggtgttgaattctttaattttgttagctcaatgtagttgttaatgtgctttcttgagtagtttaaggtaacatggagtgatggaaagaccactggatttggagacaaagataaattttcatatctcaactttgacatcccatgaccttaagcaagtcatttaacctgtctcagcatcactttctccttctgtagcaatacctatcttagaaggttatttttattttattttatttgagatagggtctggctctgtcacccatgctggattgcagaggtgtgatcttagcttactgcaccctctgcctactgggctcaagctatcctcccacctcagcctcccgagtagctgggactactacaggtgcatgccaccacagccagctaattttttttttttttttttttggtggagatggggttttgccatgttgcccaggctggtctcgaactcctgggctcaagcgatccacccccccttagcctcccaagtgctgggattacaggtatgagccactgcacccagcctcagagggttattttgagaattaagtttgataaaggttaaaatcacttttaaaactaaattaccatacaaatttttgttttttaatcattttcttccttcttattctatattattaatcatctaaccatacaaatgtaaatcaattgagcactacttttccttttacataataaatgagaacagctagatatatgtggtaaattgaatggatgaaatttgtttattggggctagcactggtgatggaaaaggttcatgcccaattagaatacagagaaggtagagctaggatttatgaaagaagatcacacaaccacagaaatggaaagcataatagagaaaatggagagtagtcttattttgcctcttaagtcctgaattccatcatttattcttaaatagtatgtaagccctttgaagcaagagtcaaatctggacaaaattgatgttattaagtcttttagaaagatgtagcatcatggttttatgttttgcattcactgacgtcctgtgaacacgaaacaaatttaaggaggtaaagaggataatagtcaagtgcaaaatctagtgtggaagagaagttaaaaattaaaagaaaaattgaaatgacatgagtttgcacagaaaatgagaaattctagctaaaatgttcactctattagcaaaaatgaaaacacgtcagttaaggatagtagtactgtgtctatttgaagtttattagaaacatattttctttgattatacagctagataggctctcagaagcataaaggaaactttgtatgtgggatgaattttaatggaggggtatgttcttggtttttcttctacatgtgggtatgttctttgttttcaacccaactggtaaacaaaggaagtaattctattctctcatagtgacagagaggatatgaaattactttctctgttactatttaatgatcttctaaaaaatttataaaccaagctgccctattttgcaggcataaatctatatttgattcaggtgttagagatttttgccagaatattaacttattttctaataaaatacaccagagcctgaatctatctaagaattaatcataaactagagtgtttgggacattatttcaggtattagtcactggaataacttttctaagatagtctctcctgtagggcattctcactacatggacttcaaggacagccatgtagccagcaagcttccagtttgctagtattgtttcttatgacaattatgtaaaatgcctttttaaaaacgtgtaacacttacgatgccattcaatctatagctaagttttgtgggatgccacatcatttggatcaatggttccagtaaaatgttctgtaaacttaaatccagaagatcagtcatttgtggtgaagttatttatttgaagaagatacttctcagttttatatgaatattggcaaacacttttatacttccgatttttaaatgttgttcacatgaatagccagttctgccttattcctaatttcccggccagcaacccagtcatcctgaactgatggtgctgtcatgtgtgaccatttcctcacttccccctcagtgaaatgatgcgccatcattagtaatccattgtatagtggcgtgtaattttttttacccagtactctattggtggacatttaattcatttgtggtttttttgctgctgtgaatatcctttcatatgtatcttcttaaatttgtgtaagtataccttaagatcaattcttagcactgaaaatgcttgagatataatttttaacataatttagaatgcttaaattaaaaactttttgtaggaaaagaattattttacaaataaaaatatcttttccatttttttaaataatatttcttagaaattcattggtttcagtttttgacaaataaagacaaccagttcaggtacttcatctagcaaaataatcctttaataaaaatcacattttgactgggcacagtggctcacgcctgtaatcccagcactttgagaggctgaggcaggcggatctcctgaggtcaggagttggagaccagcctggccaacatgatgaaaccccatctctactaaaaatacaaaaattagctgggcacggtggtgcatgcctgtaatcccagctactcaagaggctgaggcagaagaattgcttgaacccaggaggcggaggttgcagtgagccattgcgctccagcctgggtgacagagtgagactccatctcaagaaaaaaaaaattacatttttatatatcttttgttgatttatttatctttatacatagaatatgacaataacttcataaaatcttaaacagatatactcaattttttcttttatgaaatatctcattttcagaaatacaattctaaagggcagttttcatttttggaaggcaaaaataggctttattaattgtgaagtgacatataaagaaacataaatatagctgtttaaggtttctgatttaactgcttatcttactatgtattttagatcttctctcctgtatctaattggcttgtagtctaatattgtagcaaaatgttggaggtttacctgcattattttgcatagatccataaagtgaagatggggccagccatggtggctcacacctgtaatcccagcactttgggaggccaagatgggtggattgcttgaggtcaggagattgagaccagcctggccaacatggcaaaaccctgtctctactaaaattacaaaaattagccaggcatgatggcacatgactgtaatcccagctgctcaggagactgaggcacgagaatcacttgaacccaggaggcagaggttgcagttagccaagattgtactgctgcactccagcctgagtgacagtgagagactgtgtctcaaaaaaaaagtgaagatgagcaagcagtagccattggctaagtcatttgaattcttaaaaaaaaaaaagatacctagatagaaaacttgaaaattacctattggaattggctacatatatctgcttgttctaaaccagaagtctgctttgaacctttacaattggctcagtttatctttgtccaggcttttagcttcatcaggtacattttctactttacaatcccattttaatttatggctctaaggacccttgaaattttgcagactgaaaaacagcactcacaaaaacatgttaattgatctaccactagatatacagagtataatcatatttgaatgatattagggtgggtggtggtttaattcacatttcttataaaagcactgattctcaaccctaacttgtactttagaattacctggggctttaaaaaaatacaggtggccagacatcacccagagggtggagttcagcgttgggagttttagaaagtgctccaggtgagctctgctgttgtacagccagcattaagaacaactgctctattggagtggctcaaagctcattctagtaaggagtaacttaatgctgttccaaaaattaaaacatttgatgagcttaatcagagcttctcaaagagtgatatgtatgccactggtggtacataaggtaactttactcacttttagattttaataatttcatatttgtttaatgtgtattagaacggggttcccaacccctgggccacagaccagtactgttgtagcctgttaggaggtaagctgcaggtgggcaggacgagtgagcattttcacctgagctccgcctcctgtcagatcagcagtaccattagattctcataggagtgcaaaccctattgtgaactgcacattcgagggatccagattgcacattccttatgagagtttaatgcctgatgatctgtcactgtctccagtcacacccagaggagaccatctagttgcaggaaaacaagctcagggctcccactgattgtacattatggtgaatgtatagtaacaagaggaataaagtacacaataaatgtaatgcacttgaatcatcccaaaacaatcccctgccacccgtccatggaaaaattgtcttccacaaaaccggcccctggtgccaaaaagattggagaccgttgtattagaatatacatataagtatcgtatcaaattcacagtttcatgagtactgctttggatgaagctccatttttttaaaatgataagttaaagatagtgtgccaatttaaaggaaatttgccaaattacagaaataattaaacgaataggtagttcctacatatggcagaaatcatgaagatgctgaagaaacacaatggcaactttggtgaagggcaccctctaaaatttaggatttgaatccaaagtatcagtgtttttttctcccagatatgtttacagtgacttaatccttctttttcaattcagggacagactttcaaaattagtatttctgcaaatttttgaatcattgttttctaacttagtttcttgacacctagttctcttgtgaaaatgtgtcttacagatcaagaatattttgttcctctatttttctagggtataagtggacatgtggtggtaagaagaggaaggagagtgagtgtgtgttgtgtgtgtatgagagagagagcgagggatggatggctggatggtcagaggggctgatgaacaggtgactagattacttggatacctgggtagagaacaatattaataattgtagggcctcactttcctacatactcatcttctcagactctaaggaagtccagaggtctgttacaactcagaattgtttgggaaatactgctttaggctctttcactagtaacgtggattgctctgggccaattaaaatgagctccacataaagatatttagctatcctgacctctctgagcaggctcagagaaattcgaataggcaaattacctcttgctacaaataactgcttactgttttatcaggaatgtatataaacttcagttatagaggcagctgccctgaacaagagtagccgcttaaattatattacgggaagttaaaaatactgtgatgcagctgtaatgttatgtttaaatgtctgtcctgtataattttgtagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggtaattaatttaagcttttaaatattcttccttctgaaattagctattactttaaaaaatatttctattcaattaacaaaaactaacttaatacatttaatgagttctacttcagtaacatcgcttttcaaaactaacctttaggctgaacacagtttaattgaatgaatagtagtgaattgaccctagagtttaattaaatggatgaaaactaattacattcaaatccagaaatgtaagttttaaatatttatttaaagtaggtttcaaagccaatgggtttttcttaccttaagcatgtcagtttgtcctcttggaaaactgtactctggctactttatattttaacaccatttgtattttaataccatttggttttttgttttttgttttttgtttttttcaggactattggagaccagctgggggaagcgaaagctagtggtaatctgggaaacaccttaaaagttcttgggaattttgacgaagccatagtttgttgtcagcgacacctagatatttccagagagcttaatgacaaggtaataccgcagcattagatggtaggcctaatattttcattcaaagggctttgcattttaatactatttaattattctatagtttattttaaaattaataccaaaaaagaaaacatttatagactaatagaagtaaaagaaaaaaaatttaatggagaaaaagaaggaaatagtaagaggtctttcataagtaattatttgattggttctgtatggagagccaatataaaaatttttttcccttgtccgtaatactaaggatattacaaatatatatgataaacctgacctctgttttcaaaatgtaaactttgctgatgtcttcatttaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgagtgagtaggggctgatatgggcagtcatgtaggcccatctaagccgtggatctgctgtacgttctttattcagtagtaagtttttaagtttggcaaagattttaaagttatgaactagcaaaatcatcaattcagttgcttaaatgttacagtgttatattagtagtaatctgcagctttcatttaagttgcagaccagtgccacttagtggcaaaagcaagaaatgtcaatggttggtctgttatttagagtaatttagtcttttaccaatagaatttcatagaactacttaactataggggttccaagattaactctgtgcttgaccctgggcagaaacctatctgaatagtttaataaagtgttcccagctatttcctataattgctcttcatcatagatgtcatccttaaaatgttgcacattatggctgtaagcttccctacatttttttctgataaaaagaattagatatgtaaatcacatacataaaattgttctgcaaacttattttttcatcactttttgcgatcccttagggaaaacctatcattagtgactgctttgggtgaccgagcggcacaaggacgtgcctttggaaatcttggaaacacacattacctccttggcaacttcagggatgcagttatagctcatgagcaggtacagtggaaagccttggagccagatcatttcctccatcaaagttctgaacagtgattagatcattcttcagttttattttatctacatctaattaaaattgtttgtttcagcgtctccttattgcaaaagaatttggagataaagcagctgaaagaagagcatatagcaaccttggaaatgcatatatatttcttggtgaatttgaaactgcctcggaatactacaagttagtctaatatttctgtagataaatgtaaaatgaatactcagtcccattaattcataggctttaggtttaaaatctgattgtagcagaacttttggcatctaagcctcaatttccttatctgtaacagaatatatcaatacttcattttggggaatgctgtgaggattgaatgaaataatatactaaacacagtatctggtacacagtgctcaataaatattattgtacataagatttaatagcagcagtatgacccctttataatattggtttttatctttaaaagtaattgtttttaaatgaagttttcaacctttaatatcttttaaacctgtttagcatatgtggtgtatattgtgtatatgctttatttcactcagttatgggttagaagagaggccaaaagaaagccttgtaacaaaaatatttatagtctataccagtgatcactgaatttttttctctaccttcccaccctcttattgagcagttctccctttaccctctttctgcctatatttgactgtcactgtaagctgagtcccccattcacttacctgaagcatttacaatcccagcttcttctgtggcaggatctctcttatcagtagatttgagacatagatgatagaaagtttagacagcttcaagttgcctgatctgtgctttctagattgagttttccctagttagtggggattgaagcctcttacagattttgggtagaaggcagtttgactaaaccgaagacacagtgattgatttgtattttgttaaagaagccaatatgagacagttctggataatttgtcatcttcataaaaaaggtaaaattgttttaggcctatctaaaaaaattaaatagcattccactttgctttaaacatcaactaatggttaatatttgttggttaggttagttagatatgaaatagcctcccaaataaaatatatcactgtgtactatgtgaaggagtatatattttgattttaaatataaaaatttcctatatttaaagccaagggatatagagaagtcttaattattaaatggtgtatctgtgttaaatactgaaaggttctattataaaatggatagtggctatttgactaaagaagcatgaatataaagtaatgaaacttagtttttttcctcccaataagcaggctagaactcagaactttatatatattccaagtcgttggttagaaatatttttagaactcttctttagattttttttttttttttttttttaaatacggagttttgctcttgtcgcccaggctggagtgcaatggcacaatcttggtgcactgcaacctcggcctccccggttcaagcgattctcctgcctcagcttctgagcagctgggattacaggtgtctgccaccacgcccagctaatttttgtatttttagtagagacggggtttcgccatgttggccaggctagtctgggactcctgacctcaagtgatccgcccacctcagcctcccaaagtgctgggattacaggcgtgaaccaccacacccagcctggaattgttatcagggccaaacaagaaggctaacaatgtagatccatatccttccggatacaaagcagtagtttggtaaacctatgttagtaattgaatttggttccagaaagatttctgatcatttacaaatcaactgtaccatcaaagaataatggtatgccagaaagcattatgccacaggatctgaaagcaattccaaaagtctttcaaaaatatttgaaaagacaggcaacattagaataagtaggtagcctcccaaggtgacagatttgaaggtatcatcattaaatatgtaactttagatttgtttgcttaaaaaaagctatcacgttaccgcatagtaatttgtcatatagttataagtgatatgaagtaattatactatttgacagaaataatgggagggtcatttaaattactgaatccaaaagcatctataggtttaagcactgataataacacattaacatttatacagcaactactatgcacaagatgctattctaagcactttatacatattaatttaatcctcacaaaaatccttcgagatatttcccccattttatataagaagagactggtatacagagagattgagtgactttgcccttagcttagtaattggcaaagttgggatttaaacccagtctagctccaagatctatgctcttaactgctacgctagcttctcactggcaataccacaggtagaatttgggtaatgtttggatgtagtattcagtatttttcatgagttggtgactaatgcccgatacataagaattttacctaagtggtgactaatagcctacacataagaattttacctaaatattttaaattttgacaatgcaaaggtgacggtatgattgaaaacagatgtcatgtggaaaaaagcctcttttagctattgccaatactaaagggaaagtttttttaaatgttaaagatattatgttaatctctagaacctcttgattttatgtttcaatactcctttactttgatgaattgttaggattctcaaatttattctaaaagtcttgaatcttctttctgtgtttcaaaaacgtcttttcattttgtctaaaagtaatggagaaagtacgggatatgaatattaggctctcagagatttaaagacagcagaaagcagcagagaggaaaaatgagagttttgttttgtgattcttaaagcccaaactgagaatgatcattatataagaattaatttcttcttgtaggaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgataggtatgttttacgtctttttaccataactaaggtaaaatatagatgcattattgaatccctagaatttttcctttgtttcttttcctttgttttccttaaaatcccttttaaggaattttctttcagtgatatcctctgtatatcattgtatgaagggctagtctgtgatagaggattagtctggttccatatgcccttgacccaagatcaatgactaggtcccaaactcaattacctcttcagaagtcttcctggtgaaaccccgtatctactaaaaatacaaaaattagccgggtgtggtggcgcacgcttgtaatcccagctactcaggaggctgaggcaggagaatcgcttgaacccaggaggtggaggttgcagtgagctgagatcacgccactgcgctccagcctggcgacagagcaagactgcatctcaaaaaaaaaaaaaaaaaagttttcctaactacataagtgtgggaattgtggtgaacttagagataatgtccagtgtgaagggggcaactgctacccaactccaactaattgttgccagccaggaatgaaaatccgttatgtccacatcttcctgttttttaaagagaagctggaagtgctgagttttatatgaaatctgatttttaaatgttagtggctaattcagtttttttgttttactgtattaaaaaacattattttccagcatttagtctgtgatgtttgctttagaagatcgattttgtttttacctcagtatgagagagaacttttcgatgcagatgttcaaaatgaagtatgctacctcaagaggtagtgcgttctctctccctgctgctcaaacacacactgaataattacctggtagggctgttatagaaggaaaatagggtagtggaccagaatacctatccttgagatttattactttataatgtatttcatattttaaaagcatgttttctatgttgtaatacttgactgtgagtttagtattatgtgggtattcttttttttaatctgggtattctagtatgtctataatatcatgatagtatgttatttatatgaaagaccaaatcaatccaaagcattctttatccctttagttcctgctagatagcttttattctatacataggacctcttttcaaataactgcatgttcgctttgaataacgttttagaattggtgaaggaagagcatgttggagcttaggaaatgcatacacagcactaggaaatcatgatcaagcaatgcattttgctgaaaagcacttggaaatttcaagagaggtatgaaactaaaaaaaatgctgtctgtgctattgtaatttacaaattagaggttgggggagggaaccctatttctctagattgatcatgtggctgaataataaatttgattatatatcattctcttggcataagaaccccagaaagcattttgaggtacagatcacagttatgtttgtattggctttcatgtaggaagacaggaaagtaaggccgggcatggggaagtggaaggagagtactaaaatatgcccctactctacccgcatctctacatggagaagtagcatggtattgaaggaaaagcatggttcttagaattaaggactgcttcctgttgtagttctgccacttactggctatttgagcttggaaaccttttctgagcctcagtttctctcatctgcataatgggaataataatatctaccttgcaaagtgttataacgattagagctaatgtatattaaaagtgcctagcaaaatgtctggtgctggcttaataaacattattattatactatgggaataaaatattctaagaaaattttattcatataccaagttaatgtgtccaggataatctacattattacttagtatgattccagagaacaagagcaatctaatgtttagagaactaaagaattaaaagaatacaattagctgtcctattgtgatattttagaagcttgctttttctttctgtattctttaagacaactattaatggaaaaaaattttcattcattcatagtctcataattctaatataactattttcatttctctatattttcttctagttttaggttcactacatttacaaataatcttcaccattctttctctttaaatactactctaaaatataaatgtttgtgttgtaggttggggataaaagtggtgaactaacagcacgacttaatctctcagaccttcaaatggttcttggtctgagctacagcacaaataactccataatgtctgaaaatactgaaattgatagcagtttgaatggtaagtaataggacttttaaaacccaatttttttatcctcaatatttagattaaagttatttatcacaaatttggcatattcagagagaatatataacatgggaagttcaacttattacacttttttgctgtacacagctctgtttgtaaatatatattacaattatatattttgtatataatatatatataattataatatataatttataagtgtaaaacaatattttatagtttttaccatgaacttaggaatggtgatggtattgttcttttcttttgtaaaaatacatttaaattctctatctctaagctcattcaaaaatttgtaaatgtgaaggtgccaaaattttaaaatgttattgtttatcctttttatctcatatcgttttacgtatctgttttctgtttagttctttttcccccatttcatttccaaggtgaattttcttaggacttttttaaattcagaaaatctaagatactctctttatttttctttctttttttttggtggcaaaacctatctttaggacaccttccttaggtgccgatttgtttgacatttctatagcgaggaaatttgctataatgtctctttttgagtgaaagaaaatctacttttaaagaaataaaagggataagattaggatcacatttttaaatttcatcagtatgtgattctatatgagatcattttcctaagcttgagaaattctcagtctaaaaaaaactactgacaaatattttgaattttaaagtcagtgataaatctacctttactttttccaatttttttctttaaactcaggaaaagaaattagtggctagtcatctgatttagattttcaaagaacatttagtgaaaagttctgaagtgtgaaccgtataataatttgtgactgcgtgctttgtggttgaatgatgggctaagacgtttttctgtgctgaactttcaaataggttatgccgttaagagctctcatctttaaaaagcaaaaacaaacagtcgcttgtcttcatagacccttctagctgtagacctgttcctttgttcgctcttataacaaaacctgaaaagacactaatattcattgtctttacttccttgcctccctttctctcttcaacccattcccgttgggctttgccctcaccatgtctctgagacctccattttaccaaatatatcattcagttttcacatgtcagcttacttgatttttctcagcaatatttcctatagccaatcattcccttctgagaaaactttcttcatttggcctccaggattactctgcttttctggtttgccactctcgtctttattctcttctctcctcttcttcatctttcctctacgtttgtagtgctcagggttcagttcttggacctcttcttcctaccttctttccctccctattttccatctctctctccttccttcttactgattttatcctttttccttctattctgtgctttaagtcagtgcttccaatagaacttttctgtgatgataaaaacgttttacatctgccatccaatgtaaaagccactagctacatgtggctgttgatcactagaaatgtggctactacaagagggagtgaatttttaatattacttaactttggttaattaaaatgtagagagccgcatgtggctactggctattggacagcacagctctagataatctcatccagttacttggcttttatattgtctatatactgattattttcagatttatatttccagccaaaatttctctcatgagtttgagactcatttgtttaaaattttccattgtcatgccatatctaattggcatctaaaacttagcatgtccataatgttttctcctaaacatgttcttcctgtaccccaccctatctcaggaaatagtatcaccattcactcaactaatcaggccaaaaaactaggggtcatacttgttccctttctacttttatttatttattttattttattttatttttaaagacagaatctcactctgttgcccgagctggtctcgaactcttgtcctcaagagatcttcccacctcagcttctcaagtagctggccttgttccctttctttcactcacttctacatcaaacctatcagaaacctgccttcaaaatatatccctaatctctcctacagtgtactctgcaacaatcttagtataagctaccgacagctcccagcagagtcctagcctaccaatgatttctcttacttcgattctgcatctctcacacttacttttccacacaggagccagagtgcttttttttttttttttttctaaattaaaaaaatattttggccaggcacagtggctcacgcctgtaatccccaacacttcaggaggctgaggcaggtggatcacctgaggtcaggagttcgagaccagcctggccaacatggcaaaaccccatctctactaaaaatacaaaaattagccaggcacaggggcacagacctgtagtcccagctactcaggaggctgaggcaggagaatcgcttgaacctgggaggagggttttgagatggaatctcgctctgtcgcccaggctggagtgcagtgacggaactataggcacgacctcctaggctgaagtgatcctgccacctcagcctttcaaagtgctgggattacaggcatgaaccatcatgcctggcctcagagtgctcctttagaatatacgtcgttcctctgttcaaaacccttcagttagttcccatcacacctagaacggaatcctcagtcctcaccatggttgaaaggccctatgtaatctgaacctatctcttcagcctcttttcctgccactccacctcttgctcactctggctgtatgaagacaggtgttttttggtctcttttgttcattgccatctccccagtgtgaggagaaaggatttgtaagaaaacttgtctatttctggtgttggctcaaggtagaaaaaaggagccttcgctaaaaatcttaattcatgaattcataagcctccctacatactggtttggaatttgatttataccatctgcacagtctaagaaaccctaatccattaaagcacttttgggttagaggtgttcctagagacttagcagaagtaagaccaaatagtttctgggggaaaggcatccttgattccaggtcataagcgtttcacaacaaaaaaattaccaaatatgtaaagaaacaagccaagatagtaaggaaaaaaataacaaaattaggtcatcaagttcttcagatgttagaattatcagatatagaaaataaaatgactgtggttgaacgtttacagaagtaacaaggaaatgaaaacaagagaataacaaaaatgttaggtagactgaaaaaaaaagctaacatttattgagtgcttatgatatgccaggcactgatttaagtgctttacatgttttaactcatttaattgtaacaattctagtagttaagtttctgttatccttaatttacaggtggggaaatggaggcaagagaggttaggtaaatttcccagggttacctgtgtagtaagtggtagagatgggagttaagcttagtcactctggctccagaatccgtcttatgtgatagttatgtcttaatgtgatgttaacacacctcaataattgataaaaatcagtcaggagtcagacatcagtaataaagttgagatttgaccaacacaattaataggcttcatctaatgcaatattttgcaaactatgtgtctgacccattcatgagttataaaatgagtcttatgagttgcagttagcattaaaaatacacatacaggggccgggcgccatggctcacgcctgtaattccagcactttgggaggccaaggcgagcggatcatgaggtcaggagatcgagaccatcctggctaacgtggtgaaaccccgtctccactaaaaatacaaaaaattagccaggcgtggtggcaggcgcctgtagtcgcagctactcgggaggctgaggcaggagaatggcgtgaacctgggaggcggagcttgcagtgagccgagattgctccactgcactccagcctgggcaacagagcgagactctgtctcaaaaacaaaaacaaacaaaaaaaacacaggaggccaggcgcggtggctcacacctgtaatcccagcactttgggaagccgaggcacgtggatcacgaggtcaggagatcgagaccatcttggctaacacggtgaaaccgtgtctctactaaaaaattagctgggcgtggtggcgggcacctgtagtcccagctactcgggaggctgaggcagaagaatggcgtgaacctggggggcggagcttgcagtgagccgagatcgcgccactgcactccagccgacagagagagactccgtctcaaaacacacgtgcgcgcacacacacacagccgacagccagactccatctcaaaacacaaacacacacacgccggggcagtggctcatgcctgtaatcccagctcttgggaggatcacttgagcccaggagtttagaccgacttgggcacacagggagaccgccatctctccaaaaaattttttaattatccgtgcatggtggcatgagcctgtcatcccagctactcgggaagctgaggtgggaggatcacttaagcccaggagtttagaccgacctgggcacacagggagaccgccatctctccaaaaaatttttttaattagccatgcatggtagcatgagcctgtgatcccagctactcgggaagctgaggtgggaggatcacttgagcccaggaagtcgaagctgcagtaagccatgatcatgctgttgcactccagcctgggcaatagagaaaaaccaaaaaactacacacgtatgtgtatgtatgtatataaaactgttgtgtgaagattttgttgtatgtttgtgtatgttctaggtatatatgtgtattttttaatatggggtcacaccttaaaagtgaaaaccactgctttaatggaaatatattgacctaactggtcaatttccattatttttaagtattcatgaaacatttacagaaaactgacaataaagcaaatctcaacaaatttaaaaggatttgtatcacatctgtatcacacatgctctgagcacggtgcatttaatttagaaattaataagataatatataaaacattaatctgaaaacataacatttctcagtaacttacaggttgagaaagaaatcttaaagttagaaagtaacttaggactgaattataaaaatattgtttcaattttgtggcatgtgacttacattggtacttagagcaaaatttatgttgtatttaaaaaggaaaaagctggccaggcgcggtggctcacgcctgtaatcctagcactttgggaggcccaggcgagtggatcacaaggtcaagagatcaagaccatcctggccaacatggtgaaaccctgtctctactaaaaatacaaaaattagctgggcgtggtggcatgcacctgtagtcccagttactcaggagactgacacgggagaattgcttaaacccaggaggcggaggctgcagtgagccgagatcacaccactgcactccagcctggcgacagagcaagacgccatctccaaaaaaaaaaaaaaaaaaaaaaaaaggaaaaaggctgaaagcttaataccatctagcttaaaaagtaaaacaaacaaacaaaaaaaaacactgaaagaaggcaaaaattaaaaagcagaatttaataaaattaaaacagtgttttctttaagtcaaaatttggttccaaattgtttagtttaattttgactaagtctacagaaagagggcataataaatatgcagagattaaaaagagattctgaataacgttatgacaaaatatttgaaaatctaggagaaatgggcaatttctggaaaaacaagttaccaaaactgttccaatggtaaaatgtaatgtgaatggcatgctaatggctaaaattataaagaaattcgagcagtaatttaaaatcttcccactaggaaaatacctggcctagatgattgtacaagtgaggtaaaccagccacttaagaaaactaattataataccttacacaaaaattttataggcaactgaataagtggacatacttttatcaatctttctgagaaccataaccttgatatccaaactagacaagaacaatacaagaaaagtaaattaccggccagccttacttgtgaacataagatataaaaatctttacaaaatattagcaaagcaaatccagtaatgtattttaaaacaaacggggagccgggcgcagtggctcacccctgtaatcccagcactttgggaggctgaggcgggcggatcatgaggtcaggagttcgagaccagcctgaccaacgtggtgaaaccccgtctctaccaaaaatacaaaaattagccaggggtggtggtgtgtgcctggaatcccagctactcaggaggctgaggcaggagaatcacttgaacctaggaggcagaggttgcagtgagccgagatagcaccactgcactccagcctgggcgacagagagagactccgtctcaaaaaaaaaaaaaattcaagtggattcaacattagaaaatcaattaatgtaattcactaatgaacatagtaaagagaaaatcacccaaatatccaaatctattaaatctatttcatatagaactaatgaaatagttctatttcattagaactattaaatgaaaatattccatttataagacacagtagcagattggagaaagaataaaatccaactacacactacttgcaagagaaatatctaatataaggatataataaacctgaaagtaaaagaatagaagattcatcatgcaaaaactaaccaaaagacagtcagtatagctatgttaatagataaaatgtactttaaggcaaagggtcttactagaaatgaagaaggtcggctgagtgtggtaggtcacgcctgtaatcccagcactttgggatgccgaggctggtggatcacttgagatcagaagttcaagatcagcctggccaacatggtgagaccccgtctctactaaaaatacagacattagctgggggtggtgcagggccctgtaatcccatctactcaggaggctgaggtggaagaatgtcttgaacccaggaggtggaggttgcagtgagccgagatcacgccactgcactctagcctgggcaacacagcgaaactccatctcagaaaaacaaaaacacaagcaaacaaacaaaaaccaaagtaaatgaagaaggtcactttacggtggtacttaccagtgattaacagttcaattcaccaggaagatgaatgcattaaatgtgtctgggcttaataggtgtttataacaaggcctcaacgtacataaagcaaaattgaccaaagaaataggaaaatctacaatcataacgggaaattttaatacatatctcttagtaattgatgggtgataaaccatactcaagtgggaagacaattttttttttttttttttttttttaaagacaggctcttactctgtcaccaggcggaactgcagtggagtcatctcagcttactgcagcctctacctcccaggctcaagcaatctgcccacctcagcctcctgagtagctgggactataaggcacatgccaccatgtctggctgatttttatatttttttgcagatatggggttttgccatgttgcccaggctagtctcgaacttatgagttcaagggatctgcccacctcagtctcccaaagtgctgggattacaggcatgcaccaccgtgcccggctgacaaaattttataaaagatttcagttcttctcaaattgataaaaattaagtgcactgccaaacacatcacaattattttgtggaacttcatgaagttattcataagtttatatgaaacaaaaaagttctgagaaataccaaaacattcctaagaatatgaaaagtgctttctttacagatataagtaataagacagtgtgctgttggcataaagacaaatagaccagtggaatcgagtagagagcctatattcctcacatatatggaaaataatctcacataaaaatgaattattgatggattaaggatttcaatgtgaaagacagatttagagcagtaatagtgatgatgcaggagaggtgcagtggctcacacctgtaatcccagcactttgggaggttgaggcaggaggatcgcttgcatccagcagtcaagaccagcctgggcaacataggacccctgtctgtataaaaaaaaaaaaaaaaaatggacatggtgttgcatgcctatagccccagctacttggtaggctgaggtgggaggatcgctttgagcccaagaggtcacctaagctgcagtgagctgtgattgcgccactgcactccagcctgggcaacagagcaagacctcttctcaaaaaaagagatcgggggccggccaggcatggtggctcacacaagtaatcccaacactttgggagttgaggtgggcagatcacttgaggtcaggagttcgagaccagcctggccaacatggtgaaaccctgtctctactttaaaaaaaaaaaagggtgggggggacacggggcggggggcaaaagtgatgaacagtacacaaatagcccataaatatatgagaagatatttaacttcatctcatcagcaaacatcacagtggagtactggtagaaacttatgaggtaaacaaaaattactaccagtattcaaatgatgcagggtaatggaaactcttgtgtggtattgatgggatagaaattggtataccctgaagtacaatccagcaacattctggtgaagttaaagatgcgccaactggatgatccagctgtttcactcctgttgtgctcccagttatatactgctgatacccaccaaactagaagaaatgcttgttcatgtacactgagagacgtttccaagaatatctgtagtgtgcttatcatagcaaaaaaattggaagcaacccaaatatctgtcactaataaaatggatgatttcctagtccactctacagtctgttatttttgagactgtgtggatagtataaaccagttattataaaaaagcctttgccaaaaacagcaatgaaaatgaattaaggtatacatggcaacttggatgaatctcacaaacataaggtttctcaaagatggttgcagaatacatacagtatgataccatttataaatgtttcaaaaccaatatagctctaaaaccaatatagtttcaaaagcaatatagcacatgctgtattgctaagaaatacatacatttgtaatgaaaatgcataaaagcgcagggaagacaagggaaattatgaggggagttatacaaggggagtttaatgtgtttgtaatgtttctttttttaagctgggtattaggtatttcttatgccttttaaaatattgcctaatattttaaaacattgaatggatatggaaattctctgtatttaataactttattgaaaaaagtttaaggactcgtttacttgttttctgactggcagtaagtctgtcatctaatgagatcttaaaatagaaaggggtaacctagaaaagagtaacagcatagtagtggggatgctattttgattcttttcacgcaattgaaggcctacagccttttccttctgttataaggaataaactgctctacagattgttatttttgaaactgtgtggatagtataaaaccagttgttataaaatgcctttttcaaattaaggggtaatgtagtaaccagtgttagtttccaaccaaaatgtaacttccttacatcaaagcattttagaggggaatgtatattctatttttgtgtagctggtatagaaaattattattcttggaagaatacatatttgtacaggttttctcgtttcatatgggtttgtgtatcagattttagaactgaataatgtaatgatgctgaacttgtactcttaagggctccctggtttatttgaattaattttttttaaacaaaggtgtacgccccaagttgggacgccggcatagtatggaaaatatggaacttatgaagttaacaccagaaaaggtgggtggcaggttttatgttttaaatttcatgaactattataaaatgttttagtaatttttaatttaatgaaataatttaaataaggcttgccctatataggtatcactttaaaatttgcctgtaaaaaaaaagtcagaaaaagtatagtgcaaaaagaatgagtaccgtatgctgccatctgtttaagaaaaatacatgcatatatttcctttgtagattcctaaaacattctggaataagatataagaaacgggctaacaatgatttcttctgggaagaggactgagtgtctgggttaggctagaaatactttatataccagtttgaactgtttgaatcatttactatgcaaatgtattacttttaattaatagaagatcaggaagatcaaaaggacaagcttttttccccaactacatagcaacattattgccaagataaatgaaatttatgatcaagaggagagttgtttttctggctgcattcttgaaaagcatttttttttaacaagtactttgtattgaagatacatcttccctaggctttttcttgcaggagaggggtgcacagtaaaagggaagggacttcataattagaaacaggttattgaagaaaacatcaaggctacttttttccgtttcctttgaactgaataattacattgtcaaaataggctctcggccgggcacggtggctcgcgcctgtaatcccagcactttgggaggccgaggtgggtggatcacgaggtcaggagatcgagaccatcctggccaacatggtgaaaccctgtctttactaaaaatacaaaaattagctgggtgtggtggtgtccgcctatagtcccagctactcgggaggctgaggcaggagaatcgcttgaacctgggaggcggaggttgcagtgagctgagatcgcgccactgtactccagcctggcaacagagcgagacttgtctcaaaaaaaaaaaaaaaaaaataggttctcattcttttatgtatatttttatttcttttttttcttttttgttttttttgagacggagtctcgctctttggccaggctggagtgcagtggcgcgatctcagctcactgcaccctccacctcccaggttcatgcgattctcctgcctcagcctcccgggtagctgggactgcaggcgggcaccaccacacccagctaatgtttgtatttttagtaaagacagggtttcaccgtgttggccacgatggtctcgatctcctgacctcgtgttccgcccacctctgcctcccaaagtgctgggattacaggcgtgagccactgctcctggcctttctttattttacttattttatttagccactgtggtatatttttaaaaatgcttttataaaataccttcattacagcaactttagaaaatctgaacacagaaatcaagataatcagtaattctgcctcctgatggtaactgcagttattttggcatctattcatctggcattttcatatggatattatagacactattttctaatatgtggtgatctatcaagaacatctttccagctggacgcagtggctcatgcctgtaatcccagcactttgggaggctgaggcaggcagatcacttgaaccccagagtttgagaccagcctgggcaacatggcaaaaacctgtctatacaaaaaaaaaaaaaaaagatagaaaaattagctgggcctggtgtcacatgccatgcctgtagtcccagctacctgggaggctgaggcaggagtatcgtttgagcctgggatgcagaggttgcaataagccatgattgtggcactgcactctagcctgggtgacagagtgagaccctgtctctgaaaaaaaaaaaagaaaaaggaacatctttccatgtcattaaatattcttctgccctatcattataacaataacatatgatttttcaatagtgatagtttatgtgtgaatagtcttcaaaaaaccaaaatctaattgtgtgagaatcatatccaaaatatttttattccagccattcacagagttatttggaaactctagtaatttttaaaggactttgtgattttcccaaatgtccagctcttctctgtgagtggttctcaaatataaatttgttaaatccacaaattatttttaaaagcttttaaaaaggccatttttgtctactttcttcttttaggaacatactaataagtagcaaaattaatttgctttcttctgcctacctatgtagtggtactaacagtgttatgtaagaagctgaccagattcaaccttgtaattctccaagagccaagtgataaaattctatccttaatgtaaaatatgtttaagtgtaattagttctttgtattggtttcttttcctcataataaagctgtcaaagaattcattatttcattattctcaacatagtaaagaagcatacataaggaaaaagggagacttctaggttaagaggcttcctgggagagtgtgcagtgggagggaacttttgagacttggatgcctgaacttggatatgtgaaaatgtctttactaacctcacatttgataattttgctgactttagaattcttggttagaaataatttttcttcacagtttttaagacattgcttcgccctgtattcttgttttcagtattgttgagaagttcaaataaatatataaggaacatttttaatttttcttcttgggttttgggtgcagttttatgttctcacatcaaggaccattttccttttctctaaacaatagaccacgaaatccactgtagtaaataatttccccttataacctgtatgtgaaaaggaatcgatggcttggttcacttactagctacatgttttaaaaacagcaacaaggccgggcgcagtggctcacgcctgtaatctcagcactttgggaggccgaggcgggtggatcacgaggtcaagagatcgagaccatcctggccaacatggtgaaaccccgtctctactaaaaatacaaaaaattagccgggcatggtggtgggcacctgtagtctcagctactcaggaggctgaggcaggagaatcatttgaacctgggaggcggaggttgcagtgagccgagatcgtgccactgcactccagcctggcaacagagtgagactccgtctcaaaaaaatttaaaaaaagcaacaaatgtatacacacacacacacacatatatatatatatatatatatatatatatatatatatatatatatatatatataaatgagttctcactatgttgtccaggctcaagcaatcctcaaattcctgggctcaagcaatccttgtgcctcagcctcctgagtagctgggattacaagtgtgagccaccatccctagctacatgtctcactcccctgtacatttatttcaatttgtgtctcatggggcacttttctggattggtggaaatgttctttgtattgattggagtagggtttatatggcttccaatcatagacttaaaatctgtgcatttgactgtaattttacctacgaaaaaatgtgtgtcactaaaattattacatagcatgaacctttagacttacttgtaaacatttaagactgaatgttaaagctgcaaatgtcagagctattgtatgtagtgcatatttttccactgtactcaataaatgttattttgttatttgtaggctgtcatgtatttaaaccagatctagacctttataaattggtttcgcctattgagaatttagtatggtattagtaaaaacagtaccgttttattttttaaaattactatgttttatatattaatttttatgtttaaaaattctacatacatccaaaaattccagttgtaacagatttttaagtaactcacgtctagagtaaaactttggctccttctctgaccattcatattttatttttacagagttttggtaaaccttgctttcttattcgtaggttcttaaaaaccagcattttaatgttttgataatgagaatccacagtatgcatttggtacaagtcttgaaaatagtgcaatatactaaaaaggatatttttaaagagatctaaaattcttcctctctcccccaatagtaaataagtgagtacgtcaggttaatattatgggaaaccagaagagagctggggatttgggggtgtttattcacctgccttccatttataattttgtaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagagggtacgtttaaactaagtttttgagtattgtgttttgagtaccgacatttgggttttcttgtattcatgctgaatttttagtaatttaaattagacatttaatataaaatatctttgtattcatatttccctatcttttctatcttcttcaaaattagaaatggtaattactgtcttagtagataagttgcttccttgtattggacagtaattatttctttttcttttttttttctcgagatggaatcttgctctgtcacccaggctggagttcagtggcgcaatctcagctcactgtgacctctgcctcccgggttcaagcgattctcctgcctcagcctcccgagtagctgcgattacaggtgcacaccaccatgcccggctaatttttgtattttcagtagagacggggtttcaccacgttggccaggctggtgtcaaactcctgaactcaaatgatttgcctgccttggcctcccaaagtgctgggattacaggtgtgaggcactgcgcctggccaataattatttatttgagtcactattgtttgcaaaaatactaccagttatttcactgcattgtctcccagtaaaaccaccctctactcagctcagaaggcagaacaaattaaattcagatgctcaaggatttctaaatattaatttagaatgaaaagtgtctgttagcatctacttgtattaatcacattattgaaactacaatgatagaattacaaacttttgatgaaaaatgagcctgggcaacatggtgaaactctgtctctaccaaaaaataaaaagttagccaggtatggtggtatatgcctatggtcccagagcctaggaggtggaggttgcagtgagctgagatcatgccactacactccagcctgggcaacagagcaagaccctgtctcaaaaaaaagagaaaaatgatcataacaatcagtttatttaatttatttagaaataaaaataccgtgggtttactgataatcagtatcagggaaatctcgaatccagctaccccataatctggtaaaaggatcaaagtacattacaaagaaggtacttcatattatcaaatccatttatctgccgggtgcagtggctcatgcctgtaatcccagcactttgggaggcaaaggtgggtagatctcctgaatttaggagtttgaaatcagcctagccaatgtggtaaaaccctgtctctaccaaaaatacaaaaaataacctgggtgtggtggcacacacctgtggtcccagctactcaggagactggggtgggaggactgcttgagcctgggaggcagaggttgcagtgagctgagattgcgccactgcactccaacctgggtgacagagtgagaccccatctcaaaaaaaataaaataaaattggctgggcgcagtggctcatacctgtaatcccagcacttcgggaggccaaggcaggcggatcacttgaagtcaggagttcaagaccaacctggccaacatagcgaaaccccgtatctactaaaaatacaaaaattagctgggcgtgttggcacatgcctgtaattccagctactcgggaggctgaggcaggagaattgcttcaacctgggaggtggaggttgcagcgagccgagatcgcgccactgtactccagcctgggtgacagagtgagactctgtcttaaaaagagtaaaataaataaaatccatttttccagcaatgagagcctttgcaaaaaaaaagccttttttttttaaattagagatttcttttgtcagcatttcatttatacctacacctttgtgtagtatcttttgtctcgatttctttccccccagtctgtggtattgttatagaatgcctcgatttttatcagtggtttcttacatagcttttctggggtagctatgactaataaaaggaaaaattatggggtatatagaaattcagggatatttttgtaggtctagagcaggactggaattcaaggaagccatgcctttgttcaaggtttggggtcttaactaagctcacttagctcaactgaaaatgcccatactttaggagccatatgtgttttcacattcagagttttgaattctaggcttttttgcccctaggaaaaagtcttttgttggtaattaacacatttgactgtagcttatgtatgtatcattcccaaatctcaaattcaacacgttaaaaacgtctctcagtcactcctgttttccttatcccagttaaagggataccatttactctgtccctaagccaggaaccccggtgtcatgcaagataccctctttcactaaccacatcaaatccactgtgtccctcagatctgctctcaccctcacccctttccaaaaatatctgctaccccagcacattgggaggccaaagcagacaggtcacctgaggtcaggagtttgagaccagcttggccaacacggcgaaaccctgactgtataaaaaatacaaaaattagccaggtgtggtggcacgcacctgtagtcccagctactcaggaggctgaggcaggagaattgcttgaacctgggaggcagaggttgcagtgagtcaagatcataccactgcacttcagcctggatgacagagcgagactcctcaaaaaaaaaaaaaaatctgctaccatgtcttagcctagtacttactctcttacctaggcttcaataggtacctgaactgatgtccctgccttcatttattatctctaaacaaaactgcttaaaattgactattgccagtgctcatcttatttcacataggataaagtctacatttgttagtattgaatacaaaggcctcttccctcctctatagctacccctgcccttcagttcataatcagttgaatactaaaaactttttggattgcatattaaccagtatgaaacatctctcacctccaaatgcttattcattcttaaggagccaacacaaatacatgctatgaaattttccctatttctcctaaaaattagttcctctctcctcctcaggcccgtaacatttttgtatatgtgcctctattataatatatcattatgaaaaaattaaaataattacttgtattaaacattatattcatcatttcagttttgaagccttccaaatgaagtataaatatagttcttgctctcctcacaaatatttttttgaagtttgtattttttcaggatcttcaaatctaagtataaaaaaaagaccttagaaatcactatggtaggaaaatacacttgttttctttcttagctcttacaaagagataagtgtacctaaattccactgcagaatgtttagaactgaatgtagagcctgaagtacaggcctgtatcaccagtgtttgcataattcagtatctgtagtggttctgttaagtctgtttctttagccttagaaatacaggaattaaaaaatgaagtgctttttgttggattaaaataacattttattaccaatatttgccatcttgtattctttttcaaaatgtcaatttttaatcctcatcctttaccttttgcatttgaatgcatcatgatgttcattgatgatctaaagataatactggaatattcaaataaactagacttcctctcaatattttagaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaagtaagtcatctctgtttctcccccgattttaatagttctctttgatattcttgtggcttatttctgagaattgaattcccatcataagagatataataaatgagcctgaattcaggtatatctgaaatgctgttatttatacagttcaaacaaggttttttcagttcccttacgtatatctgtgtttttagtccaatgtgctttctactaactatattatactacctccctagttttctttgaaaaatctgttgtggaaaatgtgactgtgagccaggtgtggtggtgcatgcctgtaatctcagctacttgggaggctgaagtgggaggatcgcttgaggtcaggagtttgagactatagtgtgcaatgatcgcgtttgtgaatagccactgcactccagcatgggcaacatagttagaccctatgtctaaaaaatatataaaaataaaatctgattttattaatttatttgagacgagatcttgctgttagccaagctggagtgccaggccatgatcgtagtcagtgcagccttgtcctctactcttgggctcaagtgatcctcctacctcagcctcccaagtaactgggactacaggcacacaccaccatgcctggctaattatttttattttttgtggagatgaggtcttgctgtgttgtccaggctggtcttgagctcctggcctcaagtgatcctcctgccttagcctcccaaagtgctggtattccaggcatgagctactgtgcccagcctaaatataacttttaaaaataaaaatgaggaagaaaggtcgttatacataccttatgattatatataaaacgtcaatgcttcatatctggattaaaaaagaaaaacgaagacagactgaagagaaacatatggctaaggctgaggctaaggcctggctgagttagaaaggactaaaataggttacttatatttttctatttcagctaccaaaagacttcttgtaccatagaccaagacttgccagcagcacttaactgttagtttactaaatgatttgtatccagggcttggaataaaaaacactgtcctacacaacctggtctgagaaattatgtaagaaaaacagtttgttcaatttctgaaatctagtcacatatcttatagttacattttgagtgagcattaaatagagaaatatagtcaaatctgaataacgtccaagtgggtcatctgaagtactctggggctcattcttccctccagccaataaaaaccacacccatctagccaaagcccatcagtgtcagcgctatagcaggagggcagggcgggtcttgggactggcaaggccgaaaagatctaggtatataataaatgtgcctaggtttttttgttttttgttttttgtttttttttaatctttggctttcttcttctgttcttagcatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaagtatgtctgtatatttttttcgttctgcatacagctcagataccactgaaaacattggtagtgttataattctcattcaggaagggcttattttgtattagagagttattattgtccatcattcagtaaaaaattattgaacaccgattatgtttcagctgctattctaggcatcgaggacacacttgatttttaaaggatcttacattttaggagagacgtgtgtgtgtgtgtatatatatagagagagagtatatgtgtgttgtattaggtaattatgcttgctatgaagaactttaaaggaggataaaggggtagtgggtaagcaaaggtgttggtggtagggggagtgtctgttttaggtagggtggttagagaagacctttctggattgtcatttgaacagagacctgaatgcagtgaagcagtcagccatgtgagtatctagagaaagagtattccatgcagagacagcaagtcccctcttggatataaaagcttagccagttcaaggagtggcagatgtgactggcatgggatgagtaggggaagggaagagttgtacaaaatgaggatggagaagtaatcagggcctagatcatctaggcttttggaggccatgataaagtcgtgttttagatgtattaggaaggtactgggagtgtcctcaaagaggatcctggctactgatggaagaacgtagagtggcaagggtgttagtatgaaaaccagctagaaagattgtatggtgatgcaggcaaaaaatattggtgatatggactagagtggtaacagtgagaagtagttagcatagggctacattattagctattatatcagttatatattatggttagttggcaggacctcttaataaattgagtagagggtttcagggaaagagaatcaaggatgacttataccttgaataactgggaaatgaatggttctattcactgaaatggagatgactagaagaaaagcaagtttggagagaaaaagcaagagttctgttttagacatgttaaatttggtaaactgttagccagttcaaggaatggcaagtgtgactggtatagacaatgaagtagaggtgttaaataggcaatttgatgtaaaatctggagcccaagggagaagtaaatttgggagacatcagcttatagctggtattaaagccctgggaagaaagtacctaaagaataggacaggaagactaagccctgagcatttcaaaatctactggttagatggaggaagatgagctggcaaagaagcaacagccagagagttggaaggataccccaagggtgggctggggaggggtggggtgtggtgtggtggaaatcaagtaaagagtgtatcttaagcagtgctcaactgtggcaaatgttgctaagaacctgagtcagatgatgacggaactactagatttgataacatggagattatgaataattttgaaagatactgttccagtggcatggtggggacaaaggattgagtggggtgagaaaatgggaagtgtgaaaggggagatagtaaatatagaaactttaatgggttaaatggaccattagctagaaaataaatacaaggcaaatgtggggtttttttttttctttttgggggtgaaaacgtagtttatctacagatggaaatggtcaagtagagaagagtcagtgatgtaggtaagtctggggtaactgaagaacacagtttttgtgtaggtgagagagggaaagcagagtacggatttggagatgggagcaagtaggaattctctcgggctgcttttattttctcaccaaagaaagaagtagtcatcagttaagattggagttggggagcactataaatttgaagagaaaggaagtgggaaatagttgacttagagaaactgaaactagggggaaagtattaagaacactgtgctgtgctaagaacccacctgaggttcagtcactggaagtaaaactagtgagtgcaattgtgtattttatccagtcatggccagctgcttgaggcacagagataaatcaagactgctatttttccaggagaatgggattcaggggagagaatggtagttgaagacatgtgccaggaagtgattttaataatggacttaagaatctaggctgtaagaaggaaaataaagaaatgaacacttcataactcattctgtgaggccagtattgccaataccaaagccagacagacactacaagaaaagtactgaccaatatccttcatgaatccagatgcaaaatcaacaaaagcctacaatccaaatttagcagcgcccctgctgtaaaggattttacaccatgaccaagtgggacttattcccaggacgcaaggactgattgttcaacatgtgaaaatcaatcagtgtaacacataatataaacagaataaagggaaaaaacacatacaggaaaaaaatgacaattcaaaactctttcatgataaaaacttaaaaattagcaacagtaggaaactaccagaacataataaaagccatatatgaaacatgtaccgctgacatcatactcaatggtgacagactgaaagctctcctccaagatcaggaacgagatcagaatgcaggtttttgccacttctattcaatgtagtactagaaattctagctggagcaattaggcaaaaaaagaaaaaaaggcattcacattggaaaggacaaagtatcaataaaattgacagaggtaatcaacaagttcaacaaagtagcatgatacaaaatcaacacaaaaatcagttgtgtgtttatacactaacaatgaacaattggaaaagaaatttaaaattccatttaaaatagcatcaaaaagaataaaatacttagaaattaatcactgaggcaaagacttgtataatgaaaaccacaaaacattgctgaaagagatgaaagaaaacaaatggaacaatatcccatgttcatggattagaagacttaataatgttaacatttcgatactatccaaagtgacctacaaattcagtgcaatccctgtaaaaatccaaatgactttttcctcctacagaaatagaaaatatagcctaaaattcatatagaacctcaagggatccccaaatatccgaaatagtcttgagaataaagctttagggctcacatttttttatttcaggttattacaaagctacattaatcaaagcagtgcagtactggcataaaagacagacatatagaccaatggaatagaatacagatcccagaaataaacccttgcatgtgtggtcaaataatatgcaacaggggtgccaagaccattcagtgggggaaaagacagttttatcaacaaatggttctgggtaaactagagagccacatacaaaaagaatgaagttggacccttacctaataccatatgcaaaactcaaagtgggccaaagacctaagcatcagaactaaaactataaaactcaagaggagcatgtggtggcttatacctgtaatcccagcactttgggaggccaaggtgggaggattgcttgagcccaggagttcaagactagactgggcagcatagtgagaccccatctctataaaaaaatttttttaaattaatggcacacacctgtagtcccagctacacaggaggctgaggtgggaggatcacttgagcctaggagttcaaggctgcagtgagccatgatcacgtcactgtgctccagcttaggccacagagtgagaccctgtctctaaagggaaaaaaaaggaaagcctcatggcattgggtttggcagtgatttcttggttataaaaccaaaagagtgagcagggaacaacaacaacaacgtagacaaattggacttcataattaaaaacttgtgcatcaaaggacattatcaacagtaaaaaggcaacccaacataaaatacttggaaatcacatatctgataaaggattaatacccagaatatatagaaaactcctaaaactcaacaaaaaccaacctgattcaaaaatgggcaaagaactggaagaggcatttctatagagataacaagaggctagaatatgaccatgggagccaaatggctaaggccgaagtgaaggatgaggacattcaatcagaggaagtctaggaactaagtgaggaagtctaggaactaagtgcccaagtgttgggttaattggaggacattgaaattatcaatttatgacaggagaaatgaatgagccaggtatgtgtggaggtggcactcacttaggagggcagtaaataactgcaccctctgagggttgtgggcttaaatgttcagggatctatgtcttatcacagtccctaacaatgtagtgcatattcaaatatcagctatcacacttctattcttactcttgagctacaatgccagaaactatggtgtatacttgtaagtgcatgtattttttgacaagtagcatgtctaatataagaatcataatactcaaacttgaaagaaaaattcagagaccaggctcatgcctgtaatcccagcattttgggaggccaaggcgggtggatcacttgaggtcaagagttcgagaccagcctggccaacatggtgaaacccccatctctactaaaaatacaaaaattagccaggtgtggtgacgcatgcctatagtctcagctactgggaggctgaggctgaagaatcacttgaacctgaaagatggaggttgcagtgagccaggatcacaccactgcagtcctgcctggatgacagagcgagaatccgtctcaaaaaaaaaaaaaaaaaaattcattctgggctatttcttaacagatttaacagcctaagacagaggcaggcaaactttttctgtaaaaggccagatagaaaatattttaggctttgccgcccatatggtatctattgcaactgcccaactctgccatttagtagggaagcagccatatagatagtatataaacatatgtattgatgggaaaatgaaaatgacttcatttacagaagccggcactgggttacagtttgctgtcccctagcctaagacgtgatttttttaaggtagttcctcatggggtttgtacatatttctaaagatttgttaagttacacagttgatgcctgttagattataaccttgaactgtcatacttagatacagttgaccttgtcttttatccttgtgaccaattataattaaaacagtatgacttaacataatgcacgtactaaaccaatgaagcagctatacctatataagccattttaaaggaaaaattttatgcagtttcaggtttaaagattatttctttcagaaatcaggctgggaactaaagagaacaatataaaaacaaagattaatttctgagaagccccaaataaaagtttacaactgcgttttcttgttgtgactgagagatttaacatagcttggtgctttctttcccacagtatgtcttttaatctctctcataaacttctagggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttact

SEQ ID NO: 36728 - DNA, 1976 bp, Homo sapiens
gcagagcgcagggagctggaggtcggcgcttcctctcgtgcttggtccactgacgcgcggccccgccgcgaggtgcggacgccggggctgggaggggaggaggtagccctgaggactcgctggactccggggtagtttcccagctccggctactgcgcggggctggcggggcacaccccagggcgcgctggaggccggagcgaggctggggcgcccgtgggaggctcccagcaggcaccggtgttctcgcggccaagcacagttataacgcgctcgcgcggcgcttcgagtggtcctggaacctttctggccacgagggcgctggccttgctggggagggcacaaacccagaaccgcccgggcgggggtgcagtgagtcctcgggagggtgccctcagcaggagggggcagtgaccgggagtcctgagacctccacctagcaaaccttctgcgggggcccgtgggaaaggctcaaaggtcaccaacgcaaaggcagggcgtcggctgtgagcccggaggagctgctgggaagcctggatgtgaggagggtggggttttgtggcgggtggaagtgtcgtgcgtctctgccaggagaggttaaacacagccggcgggcagagtctgagctccgggggtaggtcgtgcaggttttctgctgggagtgtggaggaaggccgcggttggttgaagtggctggaggtaacaggaaagtgttggaggaatcggttgctctcggggattgcaagccagagagttacccacctccttttaagaaatgggtttattgcaaatagataacgtggttagttcaggcaaggcatgcacttggaatgctttccgtcagcaagaggttcaccttgctgaggtgcaggtgcagggcagggtgcggtgacaggctggtgatcccaggtagaggacaggagtgacaggtgtggttgcccaggtgtggatgtttggtggaggtggagttctgagctcaggtgagcagctgcaaatgcctgttaagcctgaacgtgggctgggtccttcagatgggtggctggtctcaagtcgcaggggcagcccaggcactgtcctgggccttcccttctggctcctgacgcctgtgcttgtttccaggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgcaggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 36729 - DNA, 1815 bp, Homo sapiens
cgcgggcgggccggccgggctgtgcacctgcgcctcggcgggccgcctggggcaccgtccccggcccgcccggccccgccatggcccggccgcagaggactccggcgcgcagtcccgatagcatcgtcgaggtgaagagcaaagtaagggctcctccggcctcggccctaggcgctcccaattccctctttctccccttcccagctccttggtccccgccacctcttccctctatcctccaagtcccattctgcttttctgctcgccttcccccatccgtcttccttcctccactgctggtctccagctctctgtggcctgagtacctggagggcggtaagaagaccttggacagcgtccctggtactggagctgaggtctgggcttaaggctgccgcaaaagcggcagccgcatctttcccattcctgccagcctgcggtgagaaaggggcgcaggctgtcctgactcctcctctcccccaaccccgacttccagtttgacgccgagttccgacgcttcgcgctgcctcgcgcttcggtgagcggcttccaggagttctcgcggttgctgcgggcggtgcaccagatcccgggcctggacgtgctacttggctatacggatgctcatggcgacctgctgcccctcaccaacgacgacagcctgcaccgggccctggccagcgggcccccgccactgcgcctactggtgcagaagcggggtgaggaggggtacagtgggcagcctctgtggggtaaggtgtctgtggggcaggtctacaagggttagtccatgcccagggtacccaagcgtcaccctctgcagtccctgcccttggcttgacctctaagtggtaggaaatagctacagtgccccctgtaaacagcccaagtcggggagcaggtctctgatctcaacatcccccctcttctgcagcagaagctgactccagcggcctggcttttgcctccaactctctgcagcggcgcaagaaagggctcttgctgcggccagtggcacccctgcgcacccggccacccttgctaatcagcctgccccaagatttccgccaggtttcctcagtcatagacgtggacctactgcctgagacccaccgacgggtgcggctgcacaagcatggttcagaccgccccctgggcttctacatccgagatggcatgagcgtgcgtgtggctccccagggcctggagcgggttccaggaatcttcatctcccgcctggtacgtgggggtctggctgagagtacagggctgctggcggtcagtgatgagatcctcgaggtcaatggcattgaagtagccgggaagaccttggaccaagtgacggacatgatggttgccaacagccataacctcattgtcactgtcaagcccgccaaccagcgcaataacgtggtgcgaggggcatctgggcgtttgacaggtcctccctctgcagggcctgggcctgctgagcctgatagtgacgatgacagcagtgacctggtcattgagaaccgccagcctcccagttccaatgggctgtctcaggggcccccgtgctgggacctgcaccctggctgccgacatcctggtacccgcagctctctgccctccctggatgaccaggagcaggccagttctggctgggggagtcgcattcgaggagatggtagtggcttcagcctctgacagtcaggatgaagccccatgccactccacactgctgggacatggcagggacttcacagtgggggtttttagctggctcacagggctccctcagcctggggaacattaaaggttttctacaaatac

SEQ ID NO: 36730 - DNA, 4371 bp, Homo sapiens
taactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggaggtaagccgcgtgtcttcgcaggcccggacctgcgcggcccggaggtggtggatggggtgcagtgggtgtgcgggaatcgcaggagaggattggggctccaggtggacggtgctgactgcactggctttgaagactggaagtgggtgcaggaggaacctgcgacagctgagaccagggcgcgcgggcagatgcgccaggtcgccagcaaaccggcgtgcgtgcgccccggcgcgcccagccccgggcgagcgcagggatgggggtggaagaggcgtccccccgggtttcgaggcttgcgtaggccctctggccggcagcacttcgacctcccctctcccggggcaggggcaaagtgacggtaaagttcggggctctcggggagagctgcgcgcctggagagccgagcggcggagaagcgccaggggaaagcgtcggtagctccctcctgggcagagccgaccccgggaaaatctcggagcgctcccttcttgcggcctggaggcgcgcccccacctgcccgccgcccgcgaagttgagggggttagtaaggcgggggctccggccggcggaggcagcgagtgggtggtggaggagggcgcgcaacggcgggaagcagcccccggactgccgagggaggcccgcgggggcaccggcgacgccggtttccttggcgatgctgtggaaagtcgtctctcgcggcccccgcgccttcctcgaggccgggccactggccttgggctgaggcggggacgcgcggctgtcgggaaaggcggagaagattgggagggcacggaaacctacggactccttcctctacatcccccattcgctccagcagccctcggctgaagcgcagcgggagagggagggagaaaaaggcacaaggcgccggggatggggagcagccgggaaatcacccacccccttctcgggctctcctctcggtttggcaccatcacggcactgactgggataggtcgattcttgggtggtgtttgtcttggtgcctcagccgtggaacccccaggcaaaaaagagggagaaaagctccgggcggatgaggctttttaaaatattgttgttgctattattgggtgttttttattggggactagagccacagatggctgggggtggaggggagttgggaaaagctcattctgcttttttggaggtagttcttgagttccatactgtcaatgggttgccacagttgggctggcctcttcttacagtctgtgggcctcaatttccccaccttttggactttgccacagctctacagtgctgagactctcggccttggaaatggacctatgtgagcgggggtgagaagggagtcctggctgtattttcattgttccacctccattctgcctttcccctccccagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccgtcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttcaacaat

SEQ ID NO: 36731 - DNA, 182988 bp, Homo sapiens
agctcagtgtcacagacctttgtggaagcaacaacagctcccatccttccaacctttctggagaagccgtggcctgatggtgagccgaatgggctggggggggagaagaaggcggctggggcggtggggagatctggggcccggatcggtgcccctcctccccatgccactgccacctcctcctcctccttcatgccggggacctgggggagggaggatctccatcttctctctgtcccctgcccctcatacaagaagctccccctcctcattttcccctcccaccgcagggcccccttgctcagtgctacaggggacaggggcttctcagtcttgccacagtgctctccctatcccagccacccccccaacacaggctcaacctgcaatgacacctgcctctgcatctccctcctggggatcccactccaccccacccctggccccggcaacccccactccctcacagcagtgcccccaggactctcctgggctgcgggtaggccctttgatccctgaacaggattatgagcggctggaggactgtgaccctgaggggtcccaagactcacccatccacggggaggagcagcaacccctgcttcatgtccctgaagggctccgaggtatgtgtgtgggtgtgggtgggagagggttagtggtgcctgggagctccagtacttatcccaggctgggcctctggcagcgggttgagaacgtggagaattgatcacatgccaggggctgacactctcccctctgtgcccaggctcctggcatcacatccagaacctggacagtttcttcaccaagatatcctttgcgctaggcctgcagaggtggcatgggaaggtcctcttggagctggcactgttcttggcagggagactccgtgagggcgtcatgggtgggagacttgttggggctgaggggaggtgtcctcaggagaggccccccgtgcctcaggcttgttccttgacacgcagccacatctacagctaccaccagcggaatggctttgcctgcatcttgctggaggatgtcttccagctggggtgagacgcttagcccgggcccggaactcggtcccctgggcccatggcttccttctgtcattttgcttccttaattgtgccagctgcttccatcccatgctttcccgagcagcccaagggctcagcaggggcagggtcagggaggataaccatgggctgctctgggggctggggcaggagcccacctggctgtccctgatcactgcagcatcccggcacccccccttcctcccggcagacaatttattttcattgtcaccttcacaaccttcctccttcgatgcgtggattacaatgttctctttgccaaccaaccaagtaaccataccagacctgggccgttccacagcaaagtgaccctgtcagatgccatcctaccctcagcccagtgtgctgagaggttagtgacaacctggtggggccctgggggtgaagcatgggcagtgggtagaggagtagacgggagccccactttgtcccgtcatctagatcagcagttctcaaagcttttggtcttaggaccaaaaatacacttaatatactttaagttgtacttaagtgtattaagttgtacttaaagtgtattaagtatatctttttttttttttaagacagagtttcactcttgttgctcaggctggagtgcaatggtgaggtcttggctcactgcaacctccacctcccaggttcaagcaattctcctgcctcagcctccccagtagctgggattataggcgtgcaccaccacgtgtatttttagtagagacagggtttcaccatgttggccaggctggtctggaactcctggcctcaggtgatccacccactttggcctcccaaagtgctgggattacaggtgtgagccactgtgcccggccttttaagtgtatcttaattacagtgcattaagtgtatcttaatacacttaaaattggttgagaatcctgaaaagcttttgtttatgggagtcgtatctatccacattttaccttataaaaaattaaaattaggccgggcatagtggttcacacctgtaatcccagcactttgggaggctgaggcaggaggattgcttgaagccagaagtttgagatcagcctgagcaacaaagtgagaccacatctctataaaaaataaaaattagctgggcttggtggtgcgtacctgcagtcctagctaagcctagtcaggaggctaagacagtgactgtctctgatcactgcagcatccctacaccctcctccctcccagcagacgattcattttcattgttgccttcacaaccttcctccctgaagcatggattgcaatgttctctttgccaaccaaccaaataactgttccagacctgggccgttatttggcagggagataggagctatgtttctactgctgcactacagcctgggtaacagagagagaccttgtttcaataaaaaggaaaaaaaaaaaagaaggaaattgtagctgagaacaactttaaaatgtaagagtgcggctgggcgtggtggctcacacctgtaatctcagcactttgggaggccgaggcgggcggatcacaaggtcaggagatcaaaaccattctggccaacatggtgaaaccctgtctctactaaaatatacaaaaattagccaggtgtggtggcgggcgcctgtagtcccagctaccctggaggctgagacaggagaatcatttgaacccgggaggtggaggttgcagtgagccaagattgcgccactgcactccagcctgggcgacacagcaagactccatctcaaaaaaaaaaaaaaagagtgtacaagcacacatttcatcagctgtcagtgtgatgtgacatgttcacgtgtcttgtagcctctggaaaactccactgtactctcagagtacaagaatgaaaacatcagaaagcattagtattatttggaaaaagtttgactttgcacatttgtgaaggccacttcagcacccaccccctgccccgggctctaccttgagagctgctggtctagctagatccccctcctcatgatggtttttcctcactcccgaagtctggtctgcctctttctcaggcgcccacctttctcccccactgcccgcccaaccccatacaggatccgctccagcccgctgctggtcctcctcctggtcctggctgccggcttctggctggtccaactgcttcgctcagtctgcaacctcttcagctactgggacatccaggtgttttacagggaggccctgcacatccccccggtgagctgggtggctgtgtctgtgcagagggtgccgtgagagggtgggcagaggagaggggaagaagtgggactgtacaggtggaagggccaactggaaagagggcagaaagagcgaggtcttattgacacctgccctaggcccagaataatgtcaggagggggctaccaccacctagagagcatggcccttaccctaagggagtttagtttatttagatggctcatataagatgacatatagttacatgtttgtgctaaaaacattgattagagaaaagagaaagggcagttatctggcttttcagagctggaggaatttgggttgggcttcggaagggcaggacaggaggggaggggagcacattctaagccccagtgcaggaaggtggggaaaagccatgagcttttggaagctgcagtgaggagatggacccatcagcctaaaacagagccttcaaagccatcccccgcattgcaggaagccactgcattggcctgtcactgtccactgcttatgctctgccctttgtttcctcaccatcttgagtctgctcctccctcctctgtatctaagttctttctttgaggcacagcttgaaagtagccttctgcagcttgcttcccttgctcccctgggaggtccggagccctctgcacagcctttatgtgcagcaaggggagaggtcttagaaggcccctgagcagaggagagggaggaggccggggaagcagaggtggtgagagcggaagctggacctcggattggctctggcgggagactgctcacccgtctcgttctcctcctcccttctttcccctcctcccctgttccttccaggggaagggaagggaagacactgggatgtactggagaggccagcctgggggacttgactaacctggactgggaaagctgagtgaaactgggctgaagtgaggtttgcagccttcaaatgagatctgacagtgccccactgccagatgtggacatagcccaggtcctgggaaggcttctggtgacagagccgaagatggcctggagtcgggtggggctgggagtgtaaagcatgcccaggcagaaggtggggaggattctgttccagagttggtgggtgcactagaaatgggaaggagagattctcccacgaactgccagacattctggttttttgtttttttgtttgttttgtttcttttgagacagggtctgggtctttcacccaggctggagtgcagtgctgtgatattggctcactgcagcctctgctccccagtagctgcaaccacaggtgcacaccaccacgccctgctattttttgtatttttagtagagacagtgtctcaccatgttgcccaggctggtctcgagctcctaagctcagacgatctgcctgcctcagcctcccaaagtgctgggattacaggtgtgagccaccgcccctggccagccagtctgttttgtgtgtacaactgagggggcctcaggcccttaaggagctgagaagccaggtccagcacctggaggcgtccccaggaagtgcatgactactggccacatgaatggcagggatgatgaacagggcagtttagaagaggatgaaggaagtagggcgcgcccttgttagtgacagggttaagggagggcagaaagagaaaggtgggagagggggacgatgtagcttggtcatggcgagtttgtgatcgcaaactcagtttgcgggttttcaggccgcacacttaggggtgtggagcttgagcatcactgtggagaggaatggggggtcgctggctctcatcagtgcccctttcaggaggagctgagctcggttccctgggcagaggtgcagtcccgcctcttggcactgcagcggagcgggggcctgtgcgtgcagccgcggcccctgacggagctggacatccaccaccgcatcctgcgctacaccaactaccaggtggcgctggccaacaaaggcctgctgccggcccgctgcccgctgccctggggaggcagtgcggctttcctcagccgcggcctggcgctcaatgtcgacctgctgctcttccgcggtcccttctcgctcttccgcgggggctgggagctgccgcacgcctacaagcgcagcgaccagcggggcgccctagcagcgcgctgggggcgcacagtgctgctgctggccgccctgaacctggcgctgagcccgctggtgctggcctggcaggttctgcacgtcttctatagccacgtggagctgctgcggcgcgagcctggcgcgctgggggcgcgcggctggtcccgcctggcgcgcttgcagctgcgccacttcaacgagctgccgcacgagctgcgcgcgcgcctggcccgcgcctaccgccccgccgccgccttcctgcgcaccgctgcgccccccgcgcccctgcgcacgctgctggcccgccagctcgttttcttcgcgggtgcactcttcgccgcgctgcttgtgctcaccgtctacgacgaggacgtgctagccgtggagcacgtgctcaccgccatgaccgcgctcggggtcaccgccaccgtcgccaggtgcgacggcagatgcccggggtggtggtgtgtgttggtttctctgatctggggccatgtgaggttccccccgaatccttacctctcccaccactggggccctctagccctacatcccaccgcgcgtcctcctaatcgcaggccccttccccccacggatcccgcctttcaggtctttcattccggaagagcagtgccagggtcgtgcgccgcagctcctgctgcagacagccctggcccacatgcactacctcccggaggagcccggccccggcggcagggaccgcgcctaccggcagatggcgcagctgctgcagtaccgagcggtgagggtgggcgcgacggcgggctgaggaggaagttgtggggtctgtctgcgcggagggtctgtctgcgcggagggtctgtctgggagagggcatgagacaaacggactataccaggagtctagggagtgactgggtggggaggcttcttgccctggcgagggtcgctggggactgcttggtcctgataacgcgcgtgggcccctcagcgacccctgctcagcctcaccgctgcttccccaggtctccctcctggaggagctcctgtccccgctcctcaccccgctgtttctgcttttctggttccgccctcgtgccctggagattatcgacttttttcatcacttcactgtggatgtggctggggttggggacatctgttcctttgcccttatggatgtgaagcgccacggacaccctcaggtcagagccgttccctggccctgggggtttgggctgggtgggagttcgcttgcctctcgggagcagacctgagttccagccctggctccattgcttgctacctgtgccgttgagcgggtcacttcccttcctgtgctctcgtgccctcgtctgtcagatggcaacaatggcaatgtgctctccagagcacagccaaggccaggcttgtgaacacacagattatgtctgtatagcctatgatggagttgctggcacatagtaacgtcagtaaatgggagcaaagaccacctgggggtgaggaatgggcttggccggtgggtggggctgagtaaggactggtgcctggaccaaggctgtcaggatcaccctgggcaaagcactgaggctcagccctatccccgagctggcaatcagtccaggggtgacgaatagatgacaggcccaggttctgcactgctgctgtatttttgggtgatggtgaacaagtccccattgtggtctgtttccttcacgtggaagatggggcagtgtttcctgtcccacctgttcccataaggctcagtgttcttagcacctgaaagactgtccttgctcacagtggctctcggcgggacagactgaggcctcgctgtctcagcgtgcggaggacggcaagactgagctttctttgatgcggttctccctggcgcatccactctggcgccccccagggcacagctctaagtttcttgggcacctctggggccgagtacaacaagatgcagctgcctggggtgccacctcggctcgcggcccctccaccccgggggtgctcagcaactgcacctcgcccctggtgagtcccaagcctggcctccccttctgccttcacccccacaactcctctccaaacccttcccctctaggctcaccttaggtagtaacctgcctcaccagcccccgcccccagcctgctctcctgccttctttaggcctctgcttcctccctactccgtttctgtcctctcttctgactccctctttggctttccctctcctcttgcacccagcctgagccttcctggccaacctcttcgtgcaccctctcctgcctccgagagatctgagcccgacagccccctgtccagctgcggccacagccagcctccttgcctccatttcccgaattgcccaggaccccaggtgaggagtggaggctgagatgcaggggcatgtggaggggggtgggctgatcctgtaggagtggggagctggggcgctgaggggggattcagaaggggagtcctctggggtgtggcgggaggagggcatgacttttgacctgcttcatgttatgttccagctctgtgtccccaggaggcactgggggccagaagctggcccagctcccagaacttgcttctgccgagatgagtctccatgtcatctacctgcaccaggtgagtagaggggtgcccaaaggagaaatgtggagagaaggcaggtgaacaacatggagactgaggtggggtggagtctacggaagggtctagcagagtggcaggaggaggctgaaaagccctctgcctctagcccaggtgcttggccctgccctccttggggtgcagccctcattcctcctcctttccatgcagcttcaccagcagcagcagcagcaggagccgtggggtgaggctgcagcctccatcctgtccaggccctgctccagcccctcacagccaccctcgcctgatgaggagaagccatcctggtcaagtgacggtgaggagggtggggcctgcaggggacagagcctggtggacactgggcatcatggaactgcccagctgatggcctttttcaccaggctccagtcctgcctctagccccagacaacagtggggaacccagaaggcccggaatctgttccccggagggtttcaggtgaccacagacacccagaaggagcctgaccgggcctcttgcactgactgagacgactcctcagggtcagtattgcctcctgtgaggggagggagaaaggacggcataggtagttggtttggagtccgacttgaagcgatgggagcagtggtgggaatttggggtgatgggaggtggtcatctctggaatctagacccctggactgcttgccaagagccgtctcctcccacaggtaccctggcttcggcagccacaggagattggagggtggagtagaaaaacacaaggagtcattgttagaggccccatagatgacaggcccaggtgctttagttgggcaggacctgggagtcagtgaggaactcgccccgagaacagagaaaaggtaggcaaggagaggagatgctgatggcatctggaaacaagtcttagagatggtctgcacccagagggaataaggggagacatccccaactggaatgtgtcctggagcagctgcctgggaagaagtcctcgagtttcctcaaggtgggggacagaggtcaaggatgaggccgagctaaatggaagggcgacagtgaggcaggtgggctttaaggctgtggattcgtcatgctggcggctgccagcagcactttcaggttccttggggcttgtaggggatggggacttgtcagtggaaagacgggagggatgatgtttttggacttcagtacgggtgtgatgtcccaggaagtgggtgtggctccccatcctgtatgaaataagcagtaaagcttgctcatggctgttgcacatctctgtgactcttgtttctggcaggccccactcctggcagctgagtgctgcacctgccttctcgatcacgagcctgagaactgcacgggggagcagcccagactggctggaaaccatgttttcagagtgcagggtcaagtggcgtgtaggactctgtcaaaagaatgacccctttccccaccacatacccacaactgcacaggttaaaacagaaatcttgtcattttataattgtaatccacgccgggtgcagtagctcacacctgtaatcccagcactttgggaggctgaggcggttggatcacgaggtcaggagttcaagaccagcctggccaagatggtgaaaccccgtctttactaaaaatacaaaacctagccgggcgcggtggcaggcacctgtaatcccaactacttgggaggctgaggcaggagaatcacttgaacttgtggggtggaggttgcagtgagctgagatcacgccactgcactccagcccgggcggcagagggagactccgtttcaaaaaaaaaaaaacaaaaaaaaaaaactgtaatccacatgagctggggtaggcactttagtagttctcctaacatctggcacagtcccttatggtaaatcttcaataataaatacttgatttagagattagactttacaggtaagatactcctgagagaggcaagaggaatctaacattcgactaagaaacaggaagcgggtggcagtaggccctggggtaccgctgctgggaggggccttccagattaaggcggacccaggcccgaggcaacaggcctagagagggaaaagaggcgttttgctccttcctggaggaataatgctgaatccttgcagcctctggacagatgtgagaaggcaccacctcaagaggggaggagcggggctgatcctggtcgggcggacctgagtcgggcagccgctctcccggaactggaagggaaagccaggcggctctcaggggctgttggtgtctgagccgggagggtcgaacgcccagggcactgcgccccgcaactgacgctcctgcaaggaaaagctctgggtgcgtatgcggcttgtcacctcctgggtgcgcagcgtgagcccgaaaatgtcttcgtggtagcgttgctgatcctgtcggaaaagagcacagtggatcagaacccgactcggagaccttagcaggaaccccgcacgctcaggcccggcccgcccctccgcacccgcagcacgccgatgacgtcgccggcctcgtccagctccatgtcgccctccgtcgccaggatgcgctgcacggtctgcaggacgttggttgccatggtaacatcgccgcagacaaacatgtggccccgctcgaggcacagcacgcggtgcacctccgcagccagctccgtcctcaggatgtcctgcacgtaggtctgcggggcggcggggttagggcgggccctggtgggggtgggcgcgggggcgcagcccggggctgctggctggccctggacgtgaaagtctccggagcgggcctggtggggcctgcgtgccctggggcggtgtcaacaggggcagagccaaaggggcggggcaggggcgggaggaggcgggcctagaggggccggggcacaagggtgggccagagtgtgcaggggtggctgagtggtcgtgggaggccacgggagggccgtggttggtgtgccccgctggagagcgcgagtcctcccctctctccctatcttcaggttaccattgcgccctcagggtctcacaccttggggttgtcaggttcccgggagaaggcggtgaggactcggccaaacaccccgcgctgctgggcgttctgcacctcgtcgcggtagagatggtcaagttgggagcatcggcagccgaacaccaaagtcatgggagtgggctgcagccctgcaagcaaccccgcgcttgggaaggctcttctccggggcacagtgctagtggggcctccccacaggccaccgtcgcccagcctggcagcccagcgttttgggctgaaaccaccattactttggctgtttcatctctaagagagtgtagaatgctttcacagagaccctgcacagccctgatttacagagggaagggaagcgcgggtgaggtggtggcccctggtggagctgcgctagaatgcgcggcttcggactcagaattccatgccctttgcattgtgtgacatcgcagtccccttccccgctcccacttcatattctcccatacttataactctcctcccagtcacagccctcttcttttgattgacagaccaccctgggcaccccatgctcaatatgaacaccttgtagcatccttaggtcttggacagacctcggtcagctctggcacagtcaagaatccaccttgggcagttcttctttgagtcttagccctaatccctttgaaaattctattttcctttgtcctcaatccagtcaacacctactatgtaccaggcaccaggaagccagaagctcagggcccagcccttgcctttggtacctgccctccccttggtctcatgagcgtcttttcagctttgtggactttgtttcctgccctctctttcctatttcctgccttccagccccacccctctgtccctagattgtgtgactcccttcaggcagtcctttagtccccagcctcacctttgctctcaatgtcatgcagccgctcctgccagaatccccggaagggggcaatgccagtgcctggacccaccaggatgcagggcaagctgggatcgggtggcagccggaaggagggagccctggcaggagagacactccatcaggtcccctttgcctttcctgctccaccattctcaccatgcagggtgggtggagcaaggaggacccaagttcttcccatctcaaaaaaaaattaaaaaaaaaacaaaaaacaaaaaacaactctacttgctgaaactccttggatctgtggtttctggagattgcaccaaaggaaatatagttcattttggattgaagaatacttagatgactcaggggatttagaaaacgtgggaagggtgaaagacactttcagttcataatgggttcactaagtgtgtttattttaagtatccttaatagtggtatttagtttatgttcagtagatgggtacggtttatttgtagtttagccacctgggtggatttgaatcaccaggcccagctgatggcagcctaggaactgttctcagtcctaccaggacttttggttcctggctgcgagagcgggcaagacttctggacacagcatgaaggaagggtctcttaaaatccttcaccctcggtccgggcgcggtggctcacacctgtaatcccaagactttgggaggcggaggtgggaggatcgtgaggtcaggagctcgagaccagcctggccaacatagtgaaacaccgtctctactaaaaatacaaaaattagctgggcgtggtggtgggtgcctgtaatcccagctactcaggaggctgagacaggagaatatttttttttttttttttgagacagagtctggctctgtcgcccaggctggagtgcagtggcacaatcttggctcactgcaagctccacctcccaggttcacgccataggagaatctcttgaacccgggaggcggaggttgcagtaagccgagatcgtaccactgcactccagcctgggcgacagagcaagactccatctctgggggaaaaaaaaaccaaaaccttcaccttctttgagtccttggtgacaccaaggccaagggtggtcttaaccctaactagtagttctccctggattgagtgaggatttagtgactgtagttcccaggtgccatgctgcccaacatcagacagcccagggacatagagaggaacacagaagctttcagaaagccacagggccagccggtttgatcccagctctggctctgggagctatagtttcagggcagaactctgagtctaaatgaatgagagagccaaagcttagccagagttctgaagtgacctaatgacaccacacccttgacatgttacagagctccttcctgtttccagtgacacccctcaccagtgacactcctcaccaaagctgccaccctgaccctgggcagctccccaccaagtcttccatctcacttacccccggatgaagcagggcacagggtctccgggcttgagctggcttagccacgtggagcagactccatagtgcagggggcccagcccatctgggggtgggaaggagaggccggtgaggggccagagaggggccggtcccaaccctgctgtggccaggcctgctcctgcttgttgcctcaccctgagtcctgtatgccagcacagctacagtgaggtggatctctcctgggtgggtgctgggtgccgagctgactgagtagtaccggggctggagcagaggcagctgggtgaggagcagtggggcaggcagcgccaccgacgggaactgctccagcacctccagcagcgtggggcagcggaaccacttccactcctcgtagcgtcggggatcctggcggggcaggatgcagtgggttggaggccccatagcccttcctagtaacctcccttcttgacccctcccccactgagcctctttagggtttctccctgctcagttcaggccaatagagttttctctaagacctggagaatccagccatgaattcctccctgaggagctgggtcttaaagcaccagtgcatgtcggccaggagaagaaagtccaggggggactttgcatgggggtttcctgccactggggtccccccagctcatcccgtctctctagcccctgtgcctcattggggtggcccccaacctggctgagggcctccagctcctgctgttccctgggctcttctgccaaggtgctgagcagccgcaagagctgagggctgggtggggaggtgatgtccaggaagaaggtgagagcctggcgcagcgtgcacgggggcagccgggggtcccgcacccagccggggggagggccacctggggatagtgcacagggagctctgaggacagggcccagcaggactgcagtacctgggctgatgtttgtgttttggtgactgttagagagcctgcccttgagcagcggggtcggcctgtctaggtagcctcagtgtattgttcgggggcccctggccggactgggttggtctgggctcctctgcctctgactccacccccttattttaaataaagcccaggcattgatgtggcagcaaatagccccagtgccagctccagagcaagctagattgctaggggagcctcggagaggagcccagagggaggggacagccttttggtgggggtgcatttgagggtgtggggatggtccagcaacaaggccagcccggcagtgggcagcacagccagctctgagcctgcctgctgagctgtggaggaggtggccaccccctgggtcgggtcctgagctcctggaggcctggggccgggggtggggctgggcatggggctggtgtgccctgttgcttcccaggctgcccctcaccagggctgcccttctccagctgctctactgccacgggctcagtgggcgccggcgggtcctccacgcggctcagcagcgcctccacaaggccgggccggttgggcgggcagacacctatgtggtcccccggctggtactgcagcccctcctggcctccggtgtccaggcgcaccaggatggtggccctcctgggggtggggagaggggcacttatggggagtcagagaggggtgggggcgggagaatgtgggaggaggagggtccagggtcagggtgttcaggacaggggtgggggggcggtaaagccgtcgtcctcacgtggacttgctgctttgcaggttttccactgagcggattgtagcctggaacatcttccgcctgtgcacgtggatcagacctgggggcggggaggggcaaatgaggcagcctgagctagggagcagggcctggccccagagtgctttagtcccggggtgtgggggcctcagagaaccagccgggttagggtgagggcagggcccacctggcagcaactgcaggccctcggcctgggcgctcagccggtacctctggcgcttccagctccgtttggggctgaagatgtctcgggcggcggccttggcatcctctcccacacagaaggtctcacaggcggcctgcgggacaggccggtgagggctgaggacctcccgccaccaggggtcgccctagtgaggcgcctgggcggcttcactgcgtcttgctcctggggggttggcagccccagtggctgaggccggcgccaaggacagcaccttttccgccagcccatttcatggattggccgctgggcccagggacccggctggctctttctctgcacgtcctgattggtgcatcgttccttatctggtgcgtgttaatcccgtgatccgagaagcatagtgcttggcacacggtagctctgtgaaggcgtctgtgtgttcagacctgcattcaaattccgaatcccgtacttacagtgacatgcctcagtttccccatctttacacctcattgtgttctggtgaagattaaatgagatactttatgtaaagcccttagctttccacaaagtgcgtgcagatagtaagtgctcctgggaagggacgcacaattcgggcggcagaggggaccccacggggcagatccctgggagggtgtggatcccgtctactcctggtcaggcacacagctggaaaactgctgggccagtcccaggcttgaaatgcagggctcacccgtgattggctgagcctcatatcaccaagtcccgttaatctttcttttgtggtgcgtgtgaagtcttatatctcttccttccttcctcggcccctccctcccttccttcctatctccactgctgctgctctgcttagctcagccttcctgcttctggttcggtgatgctgtaatggatcctacgcctctaaagtcctattcccaaaacctgatgatgtggtctcatcccgctgcaatggctctttttgtttaaattctttaagtcttattttccgttcccttcttcccaatcagggcctatgtgtttctgcagcctgacctccccgtccctgaggtagcccccactccctctcctcctaggatgccctcctcctccaatcaaggcaaatctgctgagctccagcctgggccccgggacagcagcactgccctgaacagtgtggcactggggagaccgagcccttgtcaactgcagacatgatccccagacaggcagcactgcccctgaggaagcccaggcttaaaaagccacagcccccagggatccacctctccctgtgcttgcttgcccggcccgggaccagttctgcggtgcaggcaccgccccaggctgtctggcctctggcttcctgtggcttctgtgctggcctcagcttcagcccttgcctctgtctgaccttctctctgtcccttccttctccctccatcctgcccatcctgggtggggtcccctgccctgccctgcaccccctccctttgtgcgcccacttgtgaggcccagcctgtgcctggctgaagctccctcctgccagggccctgcctgctctctttcggctgcacttctgcctgggctaggcacccctgtggtcggcagggccatgtcatcctctgcccctgacccagaagagctggctatgccatggagagatgagggtggattttggaaggaacaggaagggaccaaagaaccaaacagaatcagggcagagtgaggcaggaggaggcatcccagggggcaggagtcagagcaggggctgggctgggctcacctggaaggcagcctgggcccagcctcggaaggcctcctcctggccgcacagctcgtcgccctggcccagctgcagcagccgctccccgcccagttcctccagccgtgtgtccacggcacgagcaaaggcgcagaagtgggggtatgcccgggagccgagcccgaacacacagaacctggggtgcaggggtcgtcagtggagctccctttgcaggccacgtttgcccaggcagcttgcccacccgttgcacccctcttggtgaggccctgacctgagggtgcccagggcccctgcactgtctgtgttactggactccttcctcttccgccgccaagaggacaccagtgggtctgagcaggagatgctgttgaagcggatcttataactcctggcaagagaggacaaagacaaggttgtcacagggccctggggatacaggctaggcccagccccagccccagggacggcttcagggtctctgcctctgggacaggaaaggccctgcccttgggaggggctgagggccagcatccctggggttccgagcctggggccctgacacaccacacccccatctctgaagacctcaggactgtcccggctctcagaagcaggcaggtctggactgccattgcagcctggaatggagggcatcctggagccctggcttttggtgggaaaacgacttgaggcacagagggagagcttttcagaccccctttctgtttgtgtctccaaatgcatcagctcccccagctcccccaaactctcacccaactcacttgtgctgttccggccgaggggagctgttgtaggggccggacatctccatcagggcagctgcaaagctctggcgaggggagtgtttgcatcagggttagttttgtttcatttcaaactacatagaagtttaaaactgtaccagctgatcctcattattattgatttgtaacttaatttttatttgttttgaaaatttcaaaagcgatctgatgtttttgaaaaatgacattacagaaatgtgtaaagtgataagacaaagaccaccccatcttccctccgggcatatgcgccattgacaggtgttaaccttccagccctttttccttgaacttacgtgcatgtgcatatttatagtttttttttaagtaaaagtggtaccatactgtacttccttggttttaatcaataatttattgcagacatccctccaggtcaatacaacaatattgacgtaagtagtagtattgtttttagatatgggtcttgctctgtcgcccaggttggggtgcagtggctccatcatcattcactgtaacctcagactcctgggcttaagggatttttctgccttcctagtagctagatctataggtgcgtgccaccactcttggttaatttttaaattttctgaagagatggagtctcgctgtgttgttcagtctggccttgaactcctgggctcaagcgatcctccggcctggactttccaaaacatgacctcagtctttttagtggctacattgtacttcactgagactgaagggcagctcggtggtctgggaacaggtgctctctcaaacgcccttgtacgtgtgccttgctcccacttttaaatgcttcagctgggtaatccttagaagtggagttgctgaatccccacttgttggggcaggcagatcgtcctcgcagctgcaggggagggcacagctctttcctcactcctggctaacaacggctagagcaaaatctttcctgttttagtggatttcatgggtggacaaactctcagttccttcagcagtgtcctggtcactagcagacattgtgcaggttgccctcctcagaagaccatggccttgtttgtgctgccatgaagaagtggcatcaagcggacctcccagggggaaggaagctggaaggaactgcatctggtgctcaactgcagatgcctctgggtgctggttcccaagtgcgccagagttagcaagaacgatttgaatttcatttttgaatgttttgtcaacgtgcaacacaagtccagaggtgcacacatgttgtaaatgtacaactctgtaagttttcacaaactgaacacacctgtgcaaccagcatcccatcgagaaacattacccgtggctgggcgtggtggctcacgcctgtaatcccagcactttgggaggctgaggtcagggattcaagaccagcctggccaacatggtgaaaccgcgtctctactaaaaacacaaaaattagctggccatggtggcgggcacctgtaatcccagctactcgggaggctgaggcaggagaatcgcttgaaccggggaggcggaggttgcagtgagccgagatcacgccattgcactccagcctgggcaacagagtgagactccagctcaaaaacaaaaacaaacaaacaaacaaacaaacaaacattacccgcatcctagaagccaacttcgtgccttcttcctgtcactgccacccccatcccagtgactaactcctctcctaatttctaactccgtggattagttctgcctgtttctgaactttatataaagtgaaccctgtagtacagtatgtattctttggtctggctttttcttctcttcacattttttgagattcacctgcactgttgtgtgtggttgtgtttcgttcacacttagtgcgatatggcacttgaatataccacaatttatcagtatttgtcgatggtcatttgaattgtttccagtgtggggtattacaaacaaatttgctataaatattccttatttttagtgaatataccccattttctgtgagctgtattcctagatttgttaaaaatttgggataaaattaacatacattgaactgcacagatgttaaagggcagtttaatttgctttgctgtttgacagttttattttatttatttgtattttattttaagtagaattcttgctctgtcacccaggctggagtgcagtggcgtgatctcggctcactgcaacctccacctcccaggttcaagcaattctcccgcctagcctcctgagtagctaggactataggcgtgcgccaccatgcccagctaatttttgtatttttagtagagacagggttttgccatgttggccaggctggtcttgagcttctgacctcaagtgatccacccacctgggcctcccaaagtgctgggatcacaggcgtgagccaccgcgcctggcctggcagttttattttttaaaaaagtgaaagattaaacatgcatctaccctatgacctaccaattctactcctaggtatttacccaagagaaataaaaacataagcccacaaaagccgggtacaagaatgttcataacaggtttattcataatagccccgacctggaaacagcccaagtgtcaccaacaagagaatgggtaaacaaactggggatattcacacaatgaacggcactcagcagcagaatgagtgaaatactgagtcacgcagcaacacgagtgcgcctcaaaaacagcctcagcaggagacgccgcaacactgcgtgcttccatctaggtgccgttctagagcaggcgaaactattctgtggtgacagacacttctggcagggagacagactgggaagggattcacgtgaggaactgatgagggaactttccagggtggtgaaaatgtgctatgccttgtgaaggctgtaggttatatgggtgtctatacacctttatgctaaaaaaaagtcaattgctggtgctatttttcttgaaaaggtaggtcagaatgagggctgaaacggacactaaggcagcaaaaagggtttcacgagattccaacttgcttaagatactgagggccaggtgcagtggctcacgtctataatcgcagcactttgggaggccgaggcaggtggattgcttgaacccaggagttagagaccagcctgggcaacatggcgaaaccccatctctataaaaaatacaaaaattagctaggcatcatggcatgcgcctgtagtcccaactacttgggaggttgaagtgggaggattgcttgagtctaggaggttgaggctgcagtgagccgtgattgtactactgcactccagcctgggccacaaagtgagaccctgtctcaaaggaaaaaagaaaaaagagtactgaggaagtacttagtgctaataaggcctttaacacctagaagctggagcaggtaagactcagaaatgagcctagcctggggcacctcagagatacctaagcttgcaagagaaggaattcaatgatggtactctagctttgtgtttctttttaaaaagtgaagttatttaatctatgttggcatctaaacagcgctcaatttcttcttttgaaaaaggagcctgcggcaggaggatctcttgaggctaggagttcaaggccagcctgggcaacgtaaataggttctcaaaataaataaaacaaataaaataaaatgctggaatagtgttgcacatgttgtaaatgtacagctctgtggatttttacaaactgaacacacctgtgtaaccagtatcccattaagaaacattacccgcatcctagaagccgccctcagtgacgtatccctgtttttcttgtcagtgcccgagcacagtctaacctcttggtcagccaggatgtgccttccttgtattaaaaacttgcactgataatggaaatgacttggggacgcgcagttaagcaaatgtgcttgcagggaggcagccacatgggtgggctgggagcgtagcttgtgtggggtttcaggctccaggggtctcttagcatctccctttccatcctggcgtgtgtgtgtgtgtgtgtgtgtgtgtgtgtgtgtgtgtgtgtgtgtgtgtgtgtgtgtgtgtgtgtgtgttgggcagaggttcctgcccagtcactccaattctgagtctctcctcattcccagcagcccctttcctggaagttctcacctctccattctccgggggatccccattcccaaatgtgctggttaccaccagcaccagcgtctcgtgttcgagggacaccacgtcatactcatccatacacaggacctgtgggtgggaagacagatgtcctgggtgctgtggcccccggaggccctgccctcctcactctggcctccctggcagtgcaagattcaggccccaacttgatctctgaacacctgtggttccgggttcctcatgagtcctgacttgtaacacttcctgtcctccagggcacccctgaagatgctgatagagccccctctttctagctccctgctcccctgggctcagccctacccggggatcaaaagccttccggaagagtctccccagctgctgtgcgtagctctgggcccggccggtctcggagccatacaggattgtcgccttcactcgcttcgccatcaccgtgcccatgagcgaggcggagatcttcacggcgctgcgggagaggaaggtgtgagggtgtcctgggtgcacagaggcagggcctccccaggcaagggtccaaccccctcacaacagggttttgggatactgagtggtaggcccagaacactgctggggcagggtcccccagggtgtgtgggggagagtggggcccccagggtgtgtgtgggagagcggggctcccaggggacccacttggccacttctttaaaggtcttcttcctggtgatgccggtgcccttggcggcactccccttccaggggtctggctgcagagagatgatggggttgggaggggaggtaaagaaaaggaaaggttagaggtccccaggggctgcttagaattagagctgggcccaggctggcagagccagttagggtgggcacctggtagcggaaggccggggacaggaaatagttgaccatctcctgatggaaaacaggagtgaggctgcccgagatggggggcacgatccaggcccagtctgcagggcagccccccctggccttctgctcattctccaggtgcttcatgaaagaggccgtggcggcgtggtggtccacgatggtgactttggctagctggaagggagagagagggggagaggctcaaaccagacccacagacctcgcccattcttcctccaccactccggtcaccccaaaccacatgtgccctcgattaccccatatctaacacaccctgtgtcccctcaaaccacaatgtcaccctcaccccaaaccacatcatgcatggtcatgctgcaggttcaacatgcaacaagcagctctaatctccagcatctgcatgcctggtccccaaaccaaatagcccacagaaattctcagcaggccccggcttcctcaaactacgactcctggtgtgcccttgatcctggtatttgtttccaggatccagcgggtcccacaaactgcaatacccaatatgccctgagaatcagcatgactgggcatgcagtaaacagcaaggtccctggcacacagtaagccaccagatgacagcgcctggaatagtacctgccctgtccccgaaccgcaggccagtgtgcgccatggcactgggactacggaacttcttctgcctgtccaaatcctgccctagtttctaaatggctgcctctcctccatcccccgcccctgctgcccccgtatgcaaaccctttgccttcctggccagtctgggcctctgcacctggtaactgtgcagcacggccacgttgatttccactgctgccttgtctttccacagggacgaggtggtccgggtatccaggtccatgcagacagccacatcctggggcagaagggtgtgtggcatcggtagggacagaggtgatcacgggggtggggtggggagactatctctgtttcccgtacatggctggaaggagtgaggtgagtggtgtccattgggaggcctggctgcctagggggctggttcaggtttttgcctgcgaaggcacctcagagcagagagggactttgggccagtcgctcctcagctccaggctttaatttctcatctctaaaatgggtcttaacctttgccgagtcaaggtcccctttgagaatctgatgaaagctctagagctatgggtcctatgcctgaaagaacaactacatgttcacacccatccccatgcccccctcacccacccactcacacccacacccacccacaaacccacacactcacacccacccacccccacaaacccacaatttcacactcaccgcctacacacatccacactcacacccacatacctacactctcacactcgcccctacacaccccacaaacccacactcgcctacccctacaagcccacacacaccccctacacaccccacaaacccacactcacctacccctacaaactcacacacactcacccctacacaccccacaaacccacactcgcctacccctacaaactcacacacactcacccctacacaccccacaaacccacactcgcctacccctacaaacccacacacactcacccctacacaccccacaaacccacagtcacctacccccacaaacccacagtctcacagtcactgcctatacacacccacaaacccacacccacctacccccacacacccacactcacccacccctacaaacccacagtctcacacccactacacaccccacaagcccacactctcacccactgcacaccccagaaacccacactctcacactcacccactcacacccccacacacacccctgccaccccctacccctttgcttcagtggttctagagcttgtcctcagttcccatttaggaggcaaccctggacctgctctgattgtccccgtggctggcattttggggatggagtgagagccagactcctgccttggacaggtgcattcggtgcccgagccccatcccgcacctcacctccaggatgttgtagcggtgagggtcacacaggttcctcgtgccgatctcagtgctcatgtaccagccactgaagggggctgcggggaactccaggcccccaatttccagcagcatgttggacactgccgggagggcgtaccagcgcaggcccagggctgcaaaccactccagcctgggggtgttggggtgtgggatcagcacccccttgcaggcccttcttgagaggctcagggatggccccctccatcccacccagtcaatccctttggtgctcacgtggggtgctccaggggcacctcaaggaccagctcggggggcagaaggaagagttctgggggatcatctggggcctgcagcagcaggggcagcacgtcgaagcgaccgtttcctggggtccagccgtgctgaatgcagagctgtggggagtgggccagagggggttctggggctgagcctcatgccctcctcagggacccctccatccactgtctcctgccttcatctccagggtccctcattggctgggtctccgtgaccacccaggcacccctcctttggtgtttttcatcctttatctcaccgaggctcccctcttcctgcctggatcccccgagccttctcccactggtttcctcattctccaccttggggacaccctcatgggtggccctcggtgcccacctcggtgatctccacgttggctgggtccccccgcacagagccatcctgctgccggtagcccgcgtagcgcaccagctggctgttccagattcggaagtctcctcggccagggcagcgctgcgggaacactgtgatggccgagctggcacgcatggggaaagagctggtcagagccccgccttccctgccttggggaagaaggctggggcctggcatggtggggggcactcaccgaaggttgccccggttggtggcatacttgatgtggttgcagatgtaggtgaacatttcctgtgcagacctgcagtcccgggcatcgaacacctgagccagccgaggcagcgggagaggagggtgaggagagagacggggggtcttgagtatcagctccagaggagctgctggtgaggaggcaggggccatggttcactccatggcgccctcctgaccattggcagccacactgatcccttcctgccctgctctctgacatatgtagcaccatccgggctgcttctcatctcctccctgggccaggtgtctccccatccctatggaagctgacttggtatccagtacagaggagggactcggcctctgccaaactgatgcttgggttaggcaccaacggatgtctaagaggccgcctaggagtgtgggcagcaaatcccccatgatccatggcattcaagaaaggacgggtgattctctttgagcacatggatggtgggaagggaaggctgcaccagaggcctcctaggaccctgctcatcctgacattctgagtggaggccccaggaggaggctgggaggtcccactcctgcctgagggaggaggaaacatgtgtcagtgacaggggcaggggagtggcagggaccaacctggggtcaagggagggacgcagctctgagtggggtccactatggcagctcagatggatcgaagttgagctaaagctttgaatgacttagagggtcaggcaagtgtcagataggattgtttttattttagttgaggttcctttgggattcactgggcacgtggctttatttcaaactctttggcggccagtgatggtgaaggaggccaaggccatgggaccaagtcccccatggggcagcttgcttctcttagtgctgtggtcacaggcgttccagtaactaaggccagccccgagtctgtgggctggggtgtgagggagggtgcgggccgaagcaggggaactggggtagcagtgggtgtgggtgaggggctgcactggactggcctggcgggagaagccttctctcttgggggagaagcagcagccagggcttttccaggaggctgctcctgctactgacagcaccgcccagggaagctccgctcagctgtcctcacccccgcagcaggtctagacttcctcacccccgcagcaggtctagacttcctcacccctgcagcaggtctagacttcctcacccctgcagcaggtctagacttcctcacccctgcagcaggtctagacttctttcccctcctccagccaaggcactaccatagggcctgataaccaggtcttcactactgggctgaggttcccctgggtgctgagggtggggcagtccccctacctttccagtctctaagggaaaaggcaaggatctcccccacagtttgggacctcccagcccccgggaagccttaggaactgccccgccaccccgctccccttttggtagcgcccgggtctctcagtcgctggccagccgcacctgcagcttcccccactggatccggcccacgcagcggggagcgttgcgccaggcctgcttagccccgaacaccagctcgctctccctaagctggtaggtgcctgtggctgccacctcggcttccacctcttgaagccgctgttcgtgggcctgggagccgctcctggggaggagaggggtgggaaggggacaagcaggaagttgtgtgggacagggaggccctcctccaggctttgtgcaagtgctgggggagggcgggaggggcccacgtggtgttaggatctgggaagggagggggtcatgggaaggtcgtcacggggtttctggggcctcagtgggacaagggaggctgtggcgtccgggaagctgtcacctcttaatggagctgtagtactggttgatgaagtcccgggcctgactcagcagctgctcaggggccggggggccgggggagggccggccctgtagtttccgtggaaataccagggagcccaggcagcgtcttggggtgcagggcccatcctgggtcgagggagtgcaaaggtcaggacaggccagggtgcaggggtgggatgggagttgggggcagggaggaggggtgcaggggtggaacagggggagagggaggaggggtgcagtggtgggatgggggagagggaagaagggtgcaggggtgggatgggtgagagggaggagaagtgcaggggtgggacggggagaaggaggaagggtacaggggtgggagaggggagagggaggaggggtgcagaggtgggatggggagaaggaggaggggtgcaggggtggggtaggggcagagggaggaggggtgcaggggtgggatggggagaaggaggaggggtgcagaggtggggtaggggcagagggaggaggggtgcaggggtgggatgggagcagagggaggaggggtgcagggatgggacggggagagggaggaagggtgcagggatgggacggggagagggaggaagggtgcagggatgggacaggggagagggaggaggggtttaggggtgggatgggggagagggaggaggggtgtaggggtgggacggggcagagggaggagggatgcaggggtgggacgggggagagggaggaggggtgcaggggtgggtcggggcagagggaggagggggtgcaggggtggaatggggcagagggaggaggggtgtaggggtgggacgctggagagggcgggagtgcagggtgggacggggagagggaggaggggtgcaggggtgggagagggaagaggggtgcaggggtgagatggggagagggaggaggaatgcaggcaggggacggggggagagggaggaagggtgcaggggtgggaggggggaaaggggtgcaggggtgggatgggggagagtttgagccagggttgggggtaaggctggaggctgagggtcacccaagtcccgtgcatgtccctcaactcctctggttcttcccagtcctctcctctttttggaaacaagggaccaattcaaagaagggttgagcttccctctccggccccatctgaggccaggccttacccaccctttccctggagacgatggggacagggcatgccggccttacctgctgcgcctgggcgctgagggtgtcataggtgatgctccccacctcccagttcttcacacgagggaacttgggcccctctgggggctgggttagcggggagctcggggggctgttgggagccagggatagggtcatcaggaagggtttgtttcctttcagccttcccagatgtcacccggaggcccctgttacagcactggcgatctcacagcccacctgccgcatgccttctggcgttccccatgccttaggagctagaggcgagctgtgcctccgtttatagaccagggtcctgggctgcaggggctgctggtgctgagctcctgagcccctgacccgaggctaagttcgcatcccacctgcagcgcccacctcacctcttctggagatggggtgtccaccccccgcaaagctgctataagccctaccctgagggggacagagcctggtgcttgagtggagggaagccctgcagggattcctcagctctgatttccctccgcactcacaacccctcctgacagcagccccatgtgtgaagggaagcctcgcaggccttatcacttcctcccagagccaccagcggcagggaggaagggagggactcaggccaagggtgcgcctgagcagcagggccccggccctcagccttccctgcatagctgcctgcagccccagcctgcccccggcctggcaccccaccaggcctccgggtctttcctccctcctgggacctctacccccgggaggactcttgtgggaactgcatggtccagttttcgggtgacagccacgaggagagggggctggagcaggggaaaaaagcctggtggctctgtcttctcagcctgcttaccccaagggcccgagtttcctgcccaactctctccctcttctgggagaccccactttctcactcctgtaaccactgctgtcagctcctttcttctccagctaaataatcatcgctgctgttgaaggcttgctgtgagctagaaacttacttccccatggagtaagtattgccatatctcgttttatataaatggaggttcagagagattaagtaacttgctcaaagtcaaacagctcctggcggcagagcagcattcaaaccctggccagattctatagctggcacccttactcccagctttcacctgccgactctgatcctggtctcctttctgagcctcccagactgtcctgttctatgcacattaatagcccttttgcatttgtgacctggccctcccgactcagctacaagttccagaccttcccagccccaggcttcaggccttgacaccacccttgttgcccacctgctcctagctgcctggcccttacctgtgttctggcgctggtgggagtagggatgctggggcccggctgggctcaggggccggggtggctgggccctgcttgccgcacagcccaaggcccagccccagccccaggccgcagggtggcccaggctcctgggccacgctcttcaagttgcccatgttactgtgcgtccactctgctgcctgctccagcagagccctggccttttccttaggaagagggaggggaccgagaggagggggcagtgggagggggctctccagtgctggccctcgccccgcccctatcccatacacaatgggacaggaacaagcccggctgggaggctctaaagcctcagctccacgcccgctggcctgaagggtggggggccggacgcctgggttccgctgtgaggactgaggctgataagtgggagcccaggtgtccagcagagccctggggctgcagcatgggggctggggcattggggagtggcagggtagagccaccagggggtcataaaggtccttctgtgatgtggcaccagacggaagggccttcggcctcacccctgtgtgcctttccctggagggttgggcagaaggtgagcaccgtttctgtagcaggggatggcagcccacactctcagtgaccacagggacctctagggtcatgcaggttctctccttcacctccccccatacatacaagaactcctggatccccacccttgagtccttttgggttcttggggatagaggcccagcaaggatgtagtgactttttgtccttgagtctgacattagggtatcccttcccctcccagccccaatttcctggaacccccacacccccatgactcaagtgggggacacaaaagagcaggaagctgccttccagtgcctccacccccaccctgtcattcagtgacgcacgcttcccggggccgcaggtcagcagagagactagggctgaggcagggtcagccggccagggaagagcttgatgccctggtgggagcatgggggactagggaaactacagttcccagaatgcaggtggggtacaccagcactctccaggcacttcaggccagagtgcatgctggggtttgtagttctgtgccatctgaggggctggagaaaggccactagctgggcatctggtccacaggggtcgaagcctcgtgatttcgagacctcagagactgagagaaagtttaagaaagaaacggaagctgagagactgggagaggcagagactaggagcagcagacagacagacaaacaaacaagaggatttgtgttggccagactcctctgaaaagcagtggaggataaggttggggtgggcctgggtggggggccggcaggcggaaggaacgggctgtgctcagagctctggggtcacaccaagaaggtggggtctgccagttttggaggatggagggtgaaggggcctcataagctgctcctggacactagtgtgccctgctgcccctgtctcaggaggagggagatggaagggcggcattcagcctgggctttgtcccatgaccccaagcctgaggccccaccacaccccaccacctcgccttcccagtgaggcaggggatgggatccagcccctacttttcaggcatcttctaccatgctggaggagacaacagatcccaagtctggcttccatattaagccaccatttgaaatgtgcatgaccaaggatgactcattttcctaggtcccagttaatggagctgtgactggcatcctcagggtcaaggtgacaggcagcatcagatgctgacatccttctgtcttttttttttttttagacagagtcttgctctgtcacccaggctggagtgcagtggtgtgatcttggttcattgcaacctctgcctcccggagtgattctcatgcctcagcctcccgaggacgacaggcacccaccaccacgcctggctaatttttttttttttttgagacagagtctcgcttttgttgtccaggctggaatgcaatggtgctatctcagctcactgtaacctccgcctcctgggttcaagcgattctcctgacccagcctcctgagtagctgagattacaggtacccaccaccacgcccggctaatttttataattttattagagacagggtttcaccatgttgaccaggctggtctcgaactcctgacctcaggtgatccacctgcctcgacctcccaatgggctgggattccaggtgtgagccaccatggatggccattgtcttcttgcctgcaccactggctgtggcccgtccctgtggccacctgacccctcccaggccttccagtcccatctgggctccacactctgctagattcttctggaaagcagggcttaccttacgctttggcactacccaaaaccctcagccaagaacaaagccactccagcacattggcctggccctcattttccttggtgcactgcttgaatcctctgttctagacaaatgggctttctcgtgtctccctaatggtcctgtgcttccctgcccctgggccgctgctgtgctgttccctccacctctcccttccgcctctgacaaatgaaaatctttttcttccttgaggcccagcctgggcagctctggaggtgcaccacccaggcctccctcttagagagcaggtacctgctgcagaaggtgctggtggctgacagcttccagatgccagccttcagtccaaggccatgtgcttccctggagtcttgtgtaggatataataaattcctcttctaaggttttagcctgtaaattaagtacaatgagttctgagatcctctccaaagatccaatgcatcagtatgttcagctttgttcttcatcttaaagtttaactttcatgttctcttcgtctccttgcccctagtttcagtaaacaaccccctcctagcttctatcacctgctccgaactgagtcaccactggtcacctgctctgacctgagtcatcctgagtcacctgttctgtgaccgtccttcctgccaaactacttaccctgccaatccggctcttacccctgctctctttaaaatagccagtaacaattagctcagacggtgtggtccaaccctagccaataggggaacaacacagctgtaggggctacctgccttagggataaaaaccccttcccttcccttgttcaggtgtgctcttgccattgctccatctgtgagatgcacccttctatagaagtaaaattgccttgctgggaacatttatatctgagtgctatttcttttgtggcaccgaaaatttatttctaacacttagacagtaactgagccccggggcgtctgtgggcgtaacatcccccgctgggctgatgtgaggcccttcttcttcttccctcctctgcaggtgtgagcctggcattgtgggcctgatccttcccctgcccaactcactcctgctcccggtccctgttatctttctcaggcattgcccgcagtattcctcttatgcttccaactcctgggactctgcttcctgaaggacccaaccaacacagtcgcaggatgactcctctgtgaggtcttccttacgtccccttctccatgatctctgggtggctgtcaccctgtccccaaggccccggggacagctctttctctgggccctcctggtcgtggtttttgggcagcttgctctgtaagtgtgggttctcacttaaatgaacctgtgtgctctgaacctgtgtgctctggaagacacaggtcagttcctctctgtggggatcctctgctgggttgagctcctgcactgagtgggattgcttcatacattggcttgttttgttgcaaatgtgtgcagccgcctggggactggaagctgtgctctggaggcaatggagagggtccactgagaagggaattggctgaggctagatgggtctgtgtgggcagaaagaagtcagtctaggtgaaggggaggagtgcaagaaggagcactctgtggccacagggaggatgggttacagttcagtacagccagcactgaaggctgagggtcacagggaggatggggtccagttcagtacagtcagcgctgaaagctgagggtcagagtaggcctggattgggtttgaattggggcagaggatgccatggcagggtcttaagaaaaggaggaaaaaaaaaagttaaacagacagaaaaagtcagagatgaatgctctctggacaggggattccctgcttcccctttcttgggccgtggccagtgttgtccggagtgtcctgccttccatcagggtgctctgatgagaacagttgattcccccgcctgtcggaggaggcctgccgtccccagggctctgcctggtgctggcctgctctatgcctgcagccctgccaagaatgatgcccatgcatcttagtggctgactgctcatattggtaaccatgttttaaagaggactttccgaaaaaacagttttcaaggttggagatttggtgttcggctgaaagaatttccatcttcaatcatgagatctgaagctgaatgggctttggagatgatctggttgggaactgagcccccttgtccctgacagtggctgtgtttccgcctcggggagggctggcccagaccccaggggtaaggtgacagccttctgtgggtgagtagggatccctccctggggagggctgtgccctgtgccccctgccccctccataatgccaaagaggcggcaaatcttgcccctgccttccctctcagaccagagtgctctgcagggctgggcgggggacgccttgaccttggagggctgtgctgggaagggaaggccttgggcctggggtgtgtgcatgggggcctgggtggtgagggcaggggtgactgagcggaagtccctgactctttatagcccagcccggggctgttcagtgtgagctggaagtaccccacccttgcactatgagcagcttccttcctgcctgctggcaaggacgggtggggagcggggaaaggagggaagggaggcgggagcagcgggagaggggcggggagcagctgccgccaggcctccccctcccgaggatgtaactcatgctgagtgctggggggcggagagatttgctcagcttccagattgcagaattggtgctgagcctttggtgagggcgttggggcggcttctgggatgctgagggttccgggctgtggacgcggttgccggtctgaaggggctcctgtgttgatcctgggcgccccctggtagccccagcccttcttgagacagccacatgagggcagcagagagccgaggaggagcgatttcagcacaatcgtgggatcagacaccacgaagggagggggagacccaggggataggaaaggagccaacggcatcgggtggtaggtctacaccagccatctggggtcccaaggtggctcatttgggcccacccccagaggagcagattgggacaaatctgcgcctccctgcttcctgcacagaccacatggggtgtgtcaaaccgaaggctcaggaggtatcttcacatacacacgtacacgcacacacatacatccatgcatgcatgcacactttcttacacatatatccatgcatgcatgcacacacatacacatatatacatgcatgcatgcacagtcacacacacatacatccatgcatactctcttacacacacaaatgtttcggggaacgtttgatttccccacaaattcataagttgagatcctagcccccaaggtgatggtgttaggaggcggggtgtttgggaggtgttgagatcgtgagggaggaaccttcctgaataggatgcgtgcccttaagaaaaaaaccccagagagatccctcacctttccatcatgtgaggacacagtgagaaggcgctgtctatgaacatgggtcctcaccagacctttccatcatgtgaggacacagtgagaaggcactgtctatgaaccgtgggtcctcaccagacatggaatctgccagcaccttgatcttagactgcggcatccagaactgtgagaaataaatttatgttgtctttaggccacccggtccttggtgttttcttacagcagcctgaacaaacggacacacacacatacatccatgcatacgtgcactctctctctctctctcacacacacacacacacacacacacacactcagggcagtggtgttgaaggaagaatctaaacctgaaggttgatcaaggcctggagattcttgcatttcccttgggaaggtggaagttggtccagactcccaagagcccccagaggctggcagacccctgccactgccagggtaaggtcttgggtttccaggtcactgggtctgtcagccaggaggcagaagcgtctctggaagaggttcaccaggctctgccccagggagcccacctgagggcggggcagcatctccctgtgccccctccctgctccccagctggggagctccccccctcacagttttgcagttgtccatgggttgtgcatcctgggctccctcactgaccagcctcctcatctgggccctgcccctccaaagctaatttgggccaagagcatctgtgtggatatgaaggctttcccatccgtgggaacttgaaatttcctccttttttttttttttttttttgagatggagtctcgctctgttgcccaggctggagtgcagtggcgtgatctcagctcgctgcaagctccgcctcccgggttcacgtcattctcctgcctcagcctcccgagtagctgggactacaggctcccgccatcaagcccagctaatttttttgtatttgtagtagagatggggtttcaccgtgttagccaggatggtctcgatttcctgacctcatgatccgcccgcctcggcctcccaaagtgctgggattacaggcgtaagccacagcgcctggccgaaattgtcctttattccggggatccagagtgagaacgagggggtttcaggggcaggctgaggcctcctgaatgctcaccataggtgccctgtcttgggctctgaaggccctacatacaaagtcatcctatctgctgaggcaaagatataaggttacctcggacttgagacggatggttgtcagggatccatctgacaggccctgcccccttcctgcctcctcctgtctccctctcctgccaccctcagcctggcccagtttcctggcatggttgctgtggcgcctcttgggaatcggagctttgggcctcaagtgtgcccagcatggaaattccacagcaactgtcactgggatcgtctggacagaaccctctcaggtgcccccaggaggggctgggccctctctccagaccagggtgggaggagcagcctttagagccccctgctgatctgtgagatgtggaaatcctgacttcaagccctggagaaccttcagtcattggtgacttgtcttttttcctgctctccccaaatggattacatgcccgactcccagtgacctcccagaggcgtccctgacatatttgctgttgatgatgacctgaggcttccgaggggctcccaggaaatggggttcccagtctgtcgtctggtttcctaagcaccagccccgtctgcgctgggcactgctgagccgggcactgctgagccgggcactgctgagccgggcactgctgagcccacttcctagaggagatgttgttctgctgcgcggatccagaagggggagctctcagggcctgttcttcttcagccgggaaagatcgaatgcgctcttcctggacatttagcgccccagcattgcaataggcctctgccgtcaccttcacaccctcactggctctgtctggccctgcactggactgctggtcccccagagggacagagatgaggtcctgaccacaattctcagctcagccaaattctccctaagccttcctcccttgcgaagccttcctcccttgtgaagccttcccttatccttctggccttaaaacgattccttcagaccctgaagtcaaagcattcatggtctgtccgggcgccgtggctcacacctgtaatcccagcaccttgggaggcccaggtgggaggatcgcgtgagcccaggagtttgagaccagcttgggcaacatggggagatcctgtctctattttacaaaaatgaataacatttttagaaaaagaaaaagcattcatggtctgcaccacttcttagacttgggatctaggactgtgtaacttctcttgtcagctgccattatttgtatttggctcctgtaatattgtctaatcatgggtgaaaatattgtcttctcaacgaattgcaaattttgtaaggccagggactgtattgtatatcatatatttccttaggaacacttctcagtggggggcacatagaaagctctggataattgtttgtgggtatatcagggagaagatggagtgggagacctgtttgtttattgtttttgtttttgttttttgagacaaggtctcactctgttacccaggctggagtgcagtggtgctatcacggctcactgcacctgggcatggtggctcatgccggtaatcccagtactttaggaggctgaggagggtggatcacttgagcccaggaggtcaaaaccagactgggcaacatagtgagaccctgtctctgaaaaaaaatgcaaaaattagctaggcatgatggcgcacacctgtagtcccagctgcttgggaggctgaagtgggaggatcacttgagcccgggaggtcaaggctgcagtgggccatgattgtgtcactgcaccccagcctgggagacagggtgagaccccatctcagaaaaagaaaagttaacaggtagctgcagccttgacttacctggctcaagcgatcctcttgcttcatcttgctaaatagctgggactacaggtgtgtgccatcacacccaactaattttttctttttgtagagatgaggtctcgctatgttgcctaggctggtcttgaacacctgggctcaagccatcctcccgcctcagcctcccaaagtgctgggattacaggtgtaagccaccgttcctgaccatgcaagacctatttgaacctgagttctcttctcaggtccttggtgttggctgactcagcagctgatgatccttgggatgggctaggatatgaagctagtgttgggttagcatttttattccaagctggggtaggctcttaattctgcccgatatcagcagaatgaacagcaaaagttctggagagctgacagagcaacctctgtatctggagttctctggtctctctctctctctcacacacatatctcaaatttctttagctcttgttatatgtggtatgtaatctcccacctggcctggtgtggtggaaaaatcacttaactaagaaccaggagacactattttatgtccagctccatttctaacttgtggcacaaccttgaggcggagtccttgtcactgtgaatatctgttttattgtctaatatatgaaagtgtttgcttctggctctaatatttcataaagcaacagaaactcccaaaggaaatcccaagagttgcaagtgtaaagttcaggggtttattcatatcttttcctgatggctgtcagaggagtgagggaggaaggcacactctgaaagcacatgagacatggttttctcagcattgactggcaaacccagctcttgcttcaccccgtgctgcctccaggagctactgtccagctccagaggcattttcaggatttggggtgaccatctaatgcactgtgtcctgaagagtgcctcagtcttgtcacctgggctgccctccctggttttctgctgagcctgccgtaaagtattttcagcaccttggacagagacaaagctccaacctggctggaggcattgagtagccaagtgagcttgggatctcctccagggccagctttcctggcaaggttgcccaaagcatgtcttggttcttcatattttttaatcctttgaaggcactcaaaaataaaccccctaatatatgtcaaaacagtgcactagttctgcaaactctcagggcattttttaaaacaaaaccaacctattttctagaatagtgttaggtacacattaggtgcttagtaaatacatttaaaaaggaatacatgcaaattcaaccttcagacaaatgtcccagcctccttataataggattctttctccccatcagtccctcctatatagtaattctggagcttctagtacttgctaagttttgcagcctcacttgaagccccttcttgtgtctaaaaatcccagtctttaaatcaaaggaacagatgactattaagttttcaggcagaggaaactgaaactggccccttctctttctcatctgggggtaagtatagattggtggggaaacccacacctgactcctcttgggatcttgctttatgaagatgttcaccaccttcctttgtacctgagaaagcccttaccatgcagaaggaccaaaatcgcccaggaaattttccgagctgacccagcccactcagagccctccttcttctgaacacccctccacgtatcctcaacatcaccagattgttcttctgacatttcatatccaagttttttcatgcctattggttcttttcccggttagataatgaattccctgtgtttgtggtttccagttagatgctactgtgatgcaaacacagcagataaaatgggagattgatcagtcttgggggcttctatcttgtcctaaggggtctcctgcaccacttatttttagtctgacataaatatgcaggatggatcatggtgctatttgtggagtaaccattggctccaagtgcacccaggatgagagagcagaggcaagaggtggaggtgaagatggctattgaggagaaacagaggaaccactcatgggtgggtgtgttgctgtgtggaattaaggaatcactcactgctagagctggacgggatctcagagatcagcttgtttggtctcctcattttacaggtaaggaaagtgagatttagtggtactcctaaagttacacaacaaatgggcccttttccatcacctctgacctggttcaagtgttgggcatctctcccttggactattgtattgctctatgtggcagatgatattttcccaaggtggtcgtgccaatacatatgcttttcttccagtgtgacagcaacacccctccactgagaggtgggggtctgtgtttgttctccttgcatctgatgggtcacgattacagcagaagttgttttatgtgattttttaaggctaagttattcaaggagatacagctgctgactggtcttctcttgggacactggcccttggaacacagccaccatgctgtgagggagccaagtggccacacagaagggcgttgtgtagctgtctggccccagtcctagctgaggtcccagccaacagccagcaccaaccaccaaacgtaagtagatgaaccttccagtctctagtttggagtaaagcagagaaaagtggtcctggtggaaactaccccagttgcaaatccatgagcaaaatatatccaactaaaccactggatcttgggatggctgttatgcagcaataggtaatggaaaaacctcatatccacctcattttctccaaactattatacacgtttcattcaatcaacaaacctttcttggatacctactctttgccagggtctgtacaaagacagaatatttacattcatggattctgcattcagctgccactactgtttccttactgtttcctgccactactgtgtcccccttgcagagataataaaattcatagtcctcatccctctgcaaatggtgccagcctgctgctccactgccaccacatcaaattattttgtcctcagacccaatctccattctcctttctttatatatccttatgttgtctcttctatctgcaatgcttctgccctgccccacctccaacgttcaaggacctgcactgaaatctccttccctggcaaggccctccaagactcctccggttgaaattaaccaacacctcctcgtaatcccacagcactgactgcagactgcagtttctgtctgcccaccgtctccctcaaaactcactagactgtgaatccctggaggagggatcctggcttatccctcttgtcccccagcagtgtctggcacagggcccagtacttagaaagcccccagtaaacacttgtcgatgcaactagtagcagaaccagaattagaagtcagatctcccgaatcctagtctccagggccttacttgcttcttttgacaccacaaaggcagggaaaatgtcccaccaaaggtggggatcaggttgtccagagaagaccttggaatggaccaggggttggcaggattgctacatgtggagctgcagagggcgatgagtgaagagtgtcctggctcttggctaggggtttcaggcgggttccttccatcctttcttccttctttctttccttcctacttcccttctttctatcaataagccctgatcatccacttctggaggggaaacatgctgtttctttgattcttttcttctccaactccagttcacatctgaaaaaaatctctattctggggacccagttgcacagaaaaacaaaaaaaacccaccgtgttcaagcatcaagggacctgctcactctgttcttccttccccagggtttcccaggaaccattgctctgtaacctgtctctcctgtgcccagccgactggaactgcttcccaatcccctgtgggtaaccccaggctctcctgggcctgactttggtggtgtcttgcctggcccgctccttgggggacctctggcagagtgggcttccatttctctttctccttccaggatgtcctggctccatgccttcggactgagcaggagcagagagcagggtgggtaggatgctttctgcagacttttctccctaaattgtttctttttgggagctgggaggagcctggatatctcactgtagcctctctgttccctcagtcacaggcagggtgcgggagagctcttcccaggaatggtctctgaaatggctcttggagctgagatgggggtggggcagattctagaggcttaacagcccagctcttggtattagggttgggcacttttctctttgtcccagatctgggggtagcagaggtgggaagttgaaggcagtgggggcttctccatcagctcatctgaggcccagaaatgttgctttggggagagcttgccccctctcaccgtttctcttcctcagctcaattcttgagtgtgggggcggctaagtgggtctgccttcaggctctaccctgagcctccaaggaagtcagaaatctacattcagctttgacttctgagtatgtggagtgggctggggggagagagggagagatctgtctctcctcagcttgagggaacagctctcttcttgcctctgtgcacagaaggagggctaccccgtgcctgggctcctctctgtttgggaggatgaagggctcctctgactcctgtcttccctttgggataagagcagaggcctgtcccagcaacacgggtacaggagtggaggacagctggccagctcagatgagtggctccttcccttcagggcctggctctccctctcccttggtctggagagagggggaggctacagatgtccctttcccttcttgccctcccatgcccattctcagctgctggcctttgctcactttctctccatcccctggcctggacaggaggacacttcactcacacatgaatcatcctggattcatggtaggcaacccagcagccaggggtggccttggggcgtggcgggggctgggccagtcgtggactaggttctacccggaacccagatgtgttgatgcacctgatgccaaatgctacaccaaggaggagcttgtgctgtggaaggccctgggcccccgggggggtgagtgaggaaactgctggcagtggagagggcctgaggaataactgcacaggcaagagcctctggacttttttagcatcagctgtggagccacctccttctctcccactggctgcctccctgagtcactgcccacccaccagcaaataaaaaagagtgtcatctgctggccagtggccccatttggccccagtgtttgcatctttgtgctcctgggtggaaggtgagagtccgggtagggtggtctcacgacgacagttttctgcgccttcctccttcgggactccgattccttccctgccctttgttcttcccctccccccatgatggttctcgctggtgacaagacccagcccctgctccaaggacagaggcagctgcaagccctcaggagcccccacatggccccatccatctagacaggtctctgatccggctgcagggaggggaccctcggctgttcagctgcgactcctccctccccgcccgcccactcagctgtcaacactcgcctccccgccctggccttcccggggccctgcctgactgctaagtccgaggacaccgcgcccggagaccctcactcagacgcaagcaggcgatgagcaggcggcggggcagacaccccgcctgcccttgagcatccctaggcctccttgcctaaataagggagccgcagctggagcgagccagctggccggggggaggggcctgcggctaggccagggctttccgaggggctgggccgtggccgccgccgcagggccccgagcccgccgattgggcgtgcaaggctggccccgggctgccgggggagggcgggccgctcgcacccggggatcccctggttggaacctcgcgctcagggacctctctttgatcctgcagctaggaggccgcaactgctgtcagaatgtccctctctgtgcagctcctatgcagagccccacagagggctctctctctctccgtgtgtgtgtgtgtatgtgtgtgtgtgtgtgtgtgtgtgtgtgtgtgtgtatgtgtgtgtgtgtgtgtgtgtgtgtgtgtgtgtgtgtgttggggcagggggcgtgccccttctaagtttaaccctcccttatttcagagctctgctgctctggggccttcagattgtcttgcttttcctatttccagggtctcccttgactccgggctcgtcttcgagggtccaggcgttgccccggtcacccacagtaggcactgagcgcgtgctgtgtataccaagccagtgctcggcgtggtggggaaccagggcataaggacccgccgtttcccttcaaatcaggtttcttagtcgctaatctggggtgggggtggaatcccttcccccatcccggccgcctacaagccggccatggcacctgtcctcacggtttcccctgcctaagggtcccttccccctcttctgggcgcgcgagtcccaggggctccttggcagagcgaggggctggcgttgggggagcactcggcgcggctcagccaatgggaaggtcgggcgcgcgcggtggggcgggatgggggggggagagggcggtgctgcgggcgcgcggcaggcgggagggggccgggaggcgggggccggagccggaggggcgcgcgccgcattaacccttccgcggccgggccgagccgcaggcgctgcccgagccgcgggcgctggagcggctgtcggcgcggtggcaggcgggagccaggagtccggggctcgggcgggcggagcgcagcgcggggacgcggcggagcgggccccgcggctcggcgggggccggcagacaggtgtgccggcggcgggcggctcgcgctcaggcggctccaggccgggcccggggtccggagcggggagccgggagccgagcgaggacccggcgcccgcagtccagtcttggccgcgcccgtgctcggcttggccgcggggtgcggggaccacggcccggccgggccacccgaagcctagtgctgggccgggccgggccggggtgggtgggggcccgcccggcccgcccatgggctcaggatgccggtgcggaggggccacgtcgcgccgcagaacaccttcctggacaccatcatccgcaagtttgagggccagagtgagtgggggagggggctgagcggggagggggctctgggggcgggccgagctcttccgagtgtggatgggggggcgtgcccgggccgtgtgcgtcggcaagtgcgagtcaatggggcctggtgggccccaggctttggcgaggggacggcgggggcaaggcttggtgcaccggggccgtgggcaccgggccaaagggtttggggttggggcttggggcgggaaactcagctcaggcttttgggatcggagtgtgtgtgacacgctgagtgtgcagggaagggatgtgggatggagtgtgcaggtgtccccaactctgggtgcgtggacgtggatggggctgtgtgcaagggcataagagtgtgtacgacccaaaccctgggatcccgagagtccagcgcgcacactggtcttgccagatcttgactgtgttgtgccggagggactgaaaagccgtggatgcagggtcagctcataatctcttcttgtgtgtgccgtgtgtatataaccctgagcccatgtgtcacccgtgagttagaccctgtatgggcggtggggaggtgtctttgacaaggctgcgagcttgtgggctctgtggagacagggtgtcctggggctagagctgggctttgagggtaagcagctccctgtggtacccccaagttgtgggttttcttgccctggagactgtcacctaattcccttatggggaccgggagtacagcacccctaatgcctgcctggtagggaggcttctagaagggtcccagattaggcaaatgtcctgggggtgggcagcattcatgtgcctgtccctaaggctgcatgagccacagtgggtgtgactgccaagggccctgggagttgggagaggatgacattccttgtccatgaccctgtgagcacaggacaacgcgtgcttgtaacggtggttgggggaaggaggggtcagtccgatggtcagtattgtgtgaagcggaggaacaagatgatcctgagggggtggagacaatgacactggttgagggcctccctgagaggtgggggtgggcccagggggaggctgtgggcgggcctacgaggaggctgggatggatgtgggggggggtgctggattctagccctacctttgccactgactgccatgtgaccttgagtgactcttccctctttgggtctcaggttccaggtctgtggaggaggggcaggctttctgtcccatccctgtattccaggatctcagtgaagggtgtgtggtggggtggggcatgccttcgaagaaacttgctcttctttccccagcctgggagagaggacaaggggtggtttttcttctatgaagctggggtgtgtggctgggcctctggactgccttggactgtggcagagctggaggccgagttagggggtcttttcaggtgacaggaaaccctgactcctggaattgatggctgcctgggaggtctggggggccttgggaactggccaaaagatgaaccagttccaaaaggcaactttctgggggccaggggaagggagaatcgagaaaggtgggaggaggccaagtcctgatggcctgggcctatctcagggtgccctgctgcagcccagctttgcacgtaggattgcctagggctgcaacctgagggctatgcttgctggggaggggaggggaagggagggggagaattccaactgctactgaaagccccagcattacaggccaaagtggccggaaacttctgtttataaaaagctcttatcccaggagcatcttgcctggcacaagtgaggctgctgcctgcctgctgctcactcgccagcctggctctccgggcaggcctggagtcagggagccaagtctggcagaaatggaaccatgggggtgctcatccaggatgaggccaaactgaggaaggcctcacatccctgggcaggtcccctttcttgggtctgttttcctacaagtggggccaaagtctcaggccccgcccaggctccaggtgtgtccagggtttggagctgcaggtccctctctttgcttcctatgaccttgggcttctgcctgtgaccctcagcttattcttctgcctctgccagaccaaggttcaaaagctggctctatcatttacaagctgcaagacttgggcatggtgccgaacttctctggagccttggtttcttcatctataaaaggaggataataacacctaccttatggggttgtcagaggacctaatgagatgcagcgtccttaggtgttcaacgtgtaacttccctcatcctctctggcacacccacccctcagctcctgactgcccttggggcgggggtggtgtgcagaagttctagggggtactgacctggtaggatcctcagataatcggggagtgatttcctagggagcctcaggataaggagtggctcagggagcgccccccagtctggagagcagggaaattaaaagcagaatccagagagccgatgcaaagggaatcctggccgccatctctggcctttcccaggctccctttctaggcccagtgtttatccctccgccgcggctgctgacacgcgttgctgacacccgccaggctggcctcagcctcgggcatggaggaggcggcgggctgctggcggcctgcccgggggaagccacgcagcccgcccgcgggccaggcggaggagggggcgcgccgcgcggcccggccggccaggcacctgtatcggggcacacgcacagctgcgttcgccccctgctgggaccccagtcccagccatgcttcctgtggcggggagtccccgggcggctgtgtgagtggagaatgtggggaagggctgggagtcccggaggctggggtccccgctcacgcgcactctcctccccgcccccctaggccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatggtaggagcgggccggggcggggccacgaccaggggcggggtcaagaggggcgggaccacggcgaggggcagggtgcgtgggggtgtgggggtgtgggggcggctggagaacgccccgagcccgggcagggttctgtgggggtgtgacgcgggcgggggccctgcggtgtgcctgtgggaggcgcggttccggggcctgcgcctcactctgctgagatggttttcaggagggcaaaggagttgctaggctgtgggtctggctcctctggtcctttttttccctgggcaggtgtgggcacgtagagcaagttggactagagttagaccgagctgggatggcaggtacgtgcgtggatggaggttaaaggtcagattggcagttgtgcgctgacatccgggcacaggcccctatctaccttagggcagttgctgccaggtgacaggtctgggagatgtcatggagggacaggagggctgcaggactctggctgtctctgctgcccccctcctgccctgcgcttcagcagcacctgggggaggtgcgtgcctctccccgcaacctcagttccctttgtctcagctgtcgagcgccccgccctgccaccctctcctgcgccaggtgtctttactcagccaccgcctcccagcacagctgctctgggcttccggagagcggataaacagagcccggggtggggctgctcccacaccgtgaatgccctgttggggtgggctctggtcagggcgggcagagcaggaggactggggtcctgtgggcagaatccggctgcagaggcggctctggaacgcgtgcaaaccttgctgcttcctagcgtgtgtcccataagcattgactcaacccttgtgagcctggcaggcactaggctcttggagatgggcaggacagatgaggctcctgccctcagggagcttgtctgctgtagacagtgagcacgctctgctttctgtttgggaccaggccagccagccccatgtgccagccctgtgtgctcagggttggctggggtggccctgcaaagctttgcatcctccaggctgtgcttttgcaggcgtgcacagtctgtggcatcactggacggcactagagggggcatggtccctgcaccctgtggaagaaggttcgctcacagcaaatcagggttctaactggcaggaggcaggggctgtgagactagactcaaaccctgaaggcagtggatggtttctaggggctagacactgggccaaatgctttacttctcttatctcaggcactcttcacaacccagggaggtagacactactgttgtcttcattttgggggatgaagaaactgaagttcacacagtcacacagctagaaaatagcagttgggaacggagcccacatctgtctgaccggagccctgtgcgctctgttctgtctgtcatatattgaaaatgacaccaggtagttgcaggtctatctgtatgctgtacattatctcatgtgaaattttattgtaaaagtttgccaaccacaggtgtactgaaaagaatatgaacccataagtcctgggtttgtgtctaagacaatgctggaaattatacactactggacaagttggttgacttccctgggcctgtttctacttctgggataacgtgccttgctttggaccttcacaagggtgctgagctttcatagagagtgcctgcaacgggccgtgctctgtaaacacggtgccagtcccactacgatgtagctgtgctggggatttggcctcttggcagcagcggctgagggctctttcctttggctgtggtatgtgtggagtgctcttaggtggagctggccctccctcccagtctaggctggccccttctggagaggatggctatgggcccccttctgcagaggagttattgtgggatcacctaatccaacccattcgacttgcaggtggaaggacggagaagcagaggtctgatgaccagtgaatcagtggaaggagtgggattagaacccagatccccagcccaagttcaaacttgtcccctctccaggttacaactccaaaaaatggggctgtgacccagaaaactctgtgccagcaatctctgtctgtccccttcttcactctcacctagtttccacggggctcaggtgtctcctgttggccaacaggctggcctggcactcagccacctaggaccccatgtatcctggcattctaggcctggggtgatgcagacagatttcctcagcctccgcttcttctgccttgaaacactcagtccctcctgtgatccccgggacctggcttgggctgcgtgtgtgcgtgcctgtgtgtgtactcacacatgggcctggtagggaggcggaggtgaggaatgcctgcgccaccccttgtttctgtccaggcctttctcagggtctctgcctgggccagcctcgggtagggggagctgggcaggaggtggagccttctgctggcaggcgccgccgtggacagctgtgctgtgttggtgcctctagccttgctctgcgcagtgtcagggcctggagccagacagccccattatttagttgctgggactgctgggaggtggggaggctagactgggggagtgtgggctgaagggagagacatgaggtgcctggggctcactggccctgtgccccttgaagtcaggcccgggattcaggtggaattgggggcagagtccagtggtgtgaggctggctggcggtaacatccccgcaaggccctggggaggcaccccgggcagcaggtgctggctgggtccacacctgtgctcccacatcgccatgggggctgtggctcctcctctgccagtcctcacagagtcccttctctctgtccccctgcatcctctctgctctttgttcctgcctctgctccctgcttccctgccaccgtgctcagccagcctgactgtgcccaccttctcggctcctctctcactccccacatctccttgcctttgtcttctgcctgcctggcttactctctgtcccttggtctttatctcctctctggtgcctcctcctgtcttcttccctcgcctcagcaccccggaaccttgctccttgcctctctccctctctcccattgtcccccacccctcggagcctctatctggaaggctctgtctggctgctcatacctctgactggcctggcctggctccatgtccctgtgtccccgggagcttgtgcgtgggtggggacggtggtgtctctggagaggagtctattagcttctccactccagctgcaggccagttgccatggtaacagggtcagagggccccccactgcaacagctgatgctgcggctgttgggagggggtggggacctgctgtccaggcctgctccccagtgcactgtgcccagggcctcagaggtggccccacgcccagtgggcttcggtctgtccccggccttggaacccagcctccccagtgctcctgcaggcctcagacctcagactgccttgaaatccttagtacctcctgtgatcagccccactcctctgggcctcctgcccttctccgtcccccaaggccgtctgtcctgtcttcttccttgccttcttcatttcttcctgtgcccattcctttaaatcagacgccctgctcttgtcaccaccacgcctcaccttctccctcatggctgacccctccccagctcagacacccactttctgcttcttttcagccccctgggtctgagctgaggatgaaagaagcttttccttgaaggggagccttgaggctgggaaggcaggtgggacagggattggtgtataagtgggttttcttgtcttgagataggaggcagaccagagcgatcccagaggatggggcttagacacaggagaacttttcctgtggcactgaagctatcaggggagcgcccttcatcatggggacagcggtgttcctatccttctggtcaaggcctggtgcagcctggagacagggctgagtgggagaatctgcagggctgccaggtgcgggcgggggtccatgggggccctgcttccgagccagttgcctcttgccctgcagcaccttccctccacctttcccttctctagctggatcagaggcctgttggaggggctccacgggggtcattcctgagctgcggctgtctgtcctggtctgccggggctgcagtcttcctatcccagtcctgctccaggggtgaggcaggcatgacgcaactgaagggtgctatctactccttgacccaccctggggtctggagagcgtcgggagagcggcttctccgtgttgcgtcttctgcagcccccggagaggagctatgtaaatatttgcgaagagctgtctgagatgggagcagagtttgatggtggccttgggctctggggaggggggccatggggcagcagaagggccagcttgggggtgtgtgaggggggagactgggcctcttttctccccagaggtggcttcctgggtggggtgattttggaggttccaagaaagcccttcacatgttggtatttccctgaagcgttcctgaaactcctcccttagagaacttctgcgtttagagtgctcctttttccttaaaaacacgttctctctcattgccccctcccagtatagagacagaaagtatttagccctttagtgtgagggagtttaacagaacttccctcccgacgtgggcaggagggccatgggagtcagggtcagtagaagagggaggggtgctgggacaggtgatgaatgtggggtgctcccctaaagtcccctccatgtccttagtcttgcccataaagatctctatgctgtggcctgtggttggcctcagataaacccctctcctttttgggtgcttatccaggatgagaaacaccttgggagccaggcagccttggtcctccgcctcctgcagtactggaggaggttccctgtccctctccccgccaccaggccttgagctccaggtgggtggagagcagcccatctgctttgttctctgttgtatctgcgtgctcagtgcacagcgagagctcggcactgtttgctgaatgaatgaatgaatggggtgggcagtgtgctgcgttgcaggagccttccctgggagtcaggtgacttggcaggagtttccagcttggttacagacttgctgtgtctgggagtcctctagccttgctttgcgtggacattgtggggcacaggagcatctgggggctcccagcttcaccctcagaggtggaccgaggaggatggggtggggggacagagtcttagagctgccacagagagcacagctgaggtgggggtgatgccacctgaccagcagcacaaggcacttctattgttgtgactgcactttgtagtttgcaaactggggaaccatgctttaccgcaggtggtcctcatggccctgtgaaaggcaggattcctctccgtcactttatgggagggaagctcttgcttagaaaggctgaggcacttgcccaagtttacccagctggcgggtggcctgagtgggaacccgagcctagctgtcccctccctgcccagcgtggaatgccactgcaccagctctcttgcccccagagagcccttctggggcatgatgggctcagggcctcaggaaacttggattttagctggggtctgcaaacctccattcctcgtttgctaagtgggatcatagcgcctgtccctgatgcactttggggtgtgagggtgttcctggaatgagatgacagacacccacaaagcagcgtgcggtgccagagctcattctcctcgccatgaagcagggcgtcacctaagtggctgcagctcctagcccgtgctgttgcaatcgtgggaaatgagcctgatccggggcctcagcacccctgctcctatggtgcaccccgccccatcctgcatgctgcctgcctctccccttccctccctgcaggctgctgctggccccgggtcctgcctctcccccaaataattgaaaccacagcatttgtgttattgctttttcctttctctttcatttttttccttttcccttttatctcactctccagtctcattaccctccccataggcaaccgttcaaatgtacttactgtgaatgtgttgcttgcatatgttcttgcaaatgtgtattttgtctggatatatgcatatagatttaatttatgtaaatgatattgtgctatatgttgtattttggtgttcgcttttcttacttgggaatgtgctttaagtccagctgggttgctgttcgacatctagtctgtaggtgcgtattcagtggcatgcggccgccacgcttcacccacccactctcccggggagggaccccacaatgtctccaactcccagccactgtaaatgaggctgtagtgaatatccttggacatggtcccttctggacttgggtgaggatgtctgtgggatacacgcccgggagtggaattgctggatcgcgggacatgtggacacttaactaagtactgccatgcctgtcatcaccctccttctcagagctcgagattcccatacccgcatatcttggccactctcgacattatctacctttctaaattttgccaatctaataggtgacagtgatttcttgttgctttaatttgcattcctttgatttctgttgagtctgagcatctcttaggcctggtagcctcttgggcttactttcccgtgaattgcctgctcatgtcctttgctcattttaattttgacgtcgccgtcttttgtccttgttgatttgcaggagttgcttgtgtactctagagataccaatgcatactgttaaacattcagtgtattccagattttaattccttgttgaactggaaacagatattgcaaatatcttctcccattcagtctctcttcaatttatccaacaaagatacttaattttgatgcaaacaaattcattgatttttagctttgtttgtacttttgaagtgtctcaggctgcagagggtctccattttcttctgttctcttaattgttttgctgttctcagttaggtctataatctatcctgagactaccccgtatgtggtgtcaagtagggatcgagttttattttttccatgtaatgtgccaactttcccaacgcatcttgtaaacagtctgttcttttccgctgaattgtggggcagcctttatcaggttaatctcccacatagccatgagtctgtccctgtgctctctgttctgttccaaatatttatttactggctcttgcattgatatagcttaacaaaaacctatagccttccgtatgtcttagcgtctgctgaggcaaatcctctctcttcattctgttttttaaaggctgacatagctatttgtggatctcccttgttcttcataaactttatttattaattaattaattttttcagatggagtcttactctgttgcccaggctggagtgcagtggcatgatctcggctcactgcagcctctgcctcttgggttcaagcgattctcctgtctcagcctcccgagtagctgggattacaggtgtgcaccaccacatccggctaatttttgtatttttagtagagacggggtttctccatgttggccaggatggtctcgaactcctgacctcaggtgatccgcccgccttggcctcccaaagtgctggattacagacatgagccaccgcgcctggcctccctttttcttcataaactttagagaaagtttattgaattcttggaaagaaaacacccactagattcttgattggaattagtttggttctatagattaatttggggagaactgacatctttatatttgtcccactcaagagcctggattgtctctccatttaccagatgagttctgtatttcttgctagtttaaggttttgttcccttttgccccgactccaacagggttcttgtgccttcttggtcaattcctggacacttaagagtttttgttgctattgtaaaagacgtattgtttttgactatgtttcctaattgcttgtgtagaaaaatgctttatatttttgcgggctgatcttgtatcttgcaaccttgctgaactctctgatctaattagttctaattgtttatctgttgatttcttgggggtctctaggcaagtgaccccgtcatctgcaaataatgccagttttcgctgtttatgtttggatcaccgtcacatgttttgatgctcgaatgttccacctgactttctgggggcttttcattagcactcgtatttgtttgttggtgcttcacagtgtcctgtgtgtgtgtgtgtgtgggggggggggagggggcaaatcaatgaggaattataactcttggtttaagctgtgactcatggcagagctggaattgggacagggctttatcaaagcttaccaggctgtctggggtatgctaggagccaagacagagcacagacctagaagcctacaggccactcactagaggagaccccagagtgtcccctggtggacagtggcagctgtgtgcaccttcactgccctgtggcaagctgtgtgtggggtcacagtgaaggggggctgaaggggactgaggctcagaagtctcacacctggtgcagttcctgcttttgccgccttcccttgggttcctgggtgctcagcctctgtgttccatgaaaactgatgaccaggttgaattttgcttcatcaaaaggcaccttaattcccatggttgctccatctgctgtccagacttgggctggagggcaccacgggcttgaaatgggcaaattctgctgtgaaagggtgggctgtgcccctggatctggaagggagctgagagggtggggacatggcctgtccccacctgttatgactgcagatcaccacccctgagtccaccctcagttcttctgcaactgccagtcctgccctggcctcagggctctgactcggatggacggggaagcccggccagtgtacagtggccttctagacgatgggcattgtttggacaagttctccaagagcagcgtccatgtgggtcagacggagcagtcaaggaaacctttctagagggggtcctagaaggctggggaggagttggagggaagaggggtgggggccatggggagcaggagggaagggctgaagctggggcgcaactgcccgggactcacgcgcctgtgcagggagctgtggagagctgcttcctggcatcagcgtgcccttgtttcaccttcccaggcttctcagcaggagggcagcgggtgggacttccagttcgtgcaccacccgagaggcagagccgggccccagagctttagagaagctagaggacagagatcttctgaggcattgctgtggtccggggcagagatggctcaggcatgccacatgcagtggatttgggtgggtctagatgactacagcggcccccaagaccctataaatgatcccatggattgctggctgggtctcaggctggaaggggtggtggaggagtctgtctggagatgctgcttctgtggggtcagggtctgagcttggggcccctcaacctgctgcatttcccagatcctggaggcaggagcttaggactggtctctctctcattcagcacacacacacacacgcgcgcacacacacactctctccctgtctctgtctctctccctccttctctctcattcactggttggcctcttgggctccctaactctgtcccctgggcctgcaatgtccctggcctttcctaggcccctggctgcccatgagagctgtgttagtgacacggtggccccctgccaggagcggctcctgctgcatcttcctgtcgccgccaccaggctaaatataacctgacactgcacagccctgggctgctgctccggagacagcctctctgcctgggggcggacaggccgactggagccccagcctcctgccctcagcgtgactttgggcctgtcctgggcacagctcctcctgctccgagcgaggcagggaggcgactagggcgaggatggctgcctccctgaggtcaccttccctgcagggacccagcaccccgccttgttagaattctggatgcttccacaaagccatctgtcatctcatctggcacccagtgcaggaatcacttgtccccacagtacccgcagggagcctgaagcccagggaggtgggtgacctgcccatagccacagaaaatagagggaacgcaggagccaccatggctggggtagagtggctcggctccctggggctcctccacctgtctggcttgttccctctccttccctcttgcccatgcatcaaactggggtcctgttggatgggtggttcactgggggcaggtgccaggcgtgtcttgttggtcacggtggctcaacacttcgcaggcacggatgtgcttagtgatttgcagaggactgggaggagctgcctgggaagaagctgtgatagcacctcatttacggaggagcgcacggagactctgaccccagaaggtgcctaaggtcactcagggccatctgcagcctcttcctccccacctggtgctgacatgggagataaggcctgcccctgccacagccaaatgtggctcctgcctggggcctggcctaggctagcggtgcccagaggtggggaattgggtggagcccctgacctcggatgggttgggatgctgggcaggaacagtgccccccaccccaggtagactgctgggtgtggattggcaccaaatgaaagcaagccggcgttgtgttctgagaagtgatggacaccttctgtggtagcaggatggcgctgtacctgccactctgggaatgtgtccaggcctggctctcccgctctgctctgagctgcatggcctctggaggcctgctaggtggccagcctgcctgcctcacccaggccattgggcccaaaggcacgggggttctaaggagccatggagcctgtgcagggatggttgcgtccatgggtgcctcccctttcagagggcccaggaagcagaactgggccaggcagggagaaccttctcacccaaagtaaggtgtcttcagccagcgctggggctgaggctggggtgggagtggggtcggggctggggctggggtgggaatggggccagggcagagtgttctggcattagccacatgagccaggctggccctggggcctctcattgctaagctccctccacccttgtctgcctctcttctgtctcaagcttatggtgacctcaagccaggctctgagcttcacatatcttaggccatttcacccctacggccctagggggtgggcaggatcaccctgtgttgcagatgagcgccccggggctctgggccggtaagtgaccggcccaaagtcattctaatgcaatgtgcagaggccacctgactccacagcccatgccccctccctttgagactgggaaccctctcccctgttgcaccccctccgccctccttgtctgtcctggctgccccctgagtgcgcccagtgctggctgcctcgggagtgtgggctgtgcctgccacggagtggctctcagcggaactgcagcctgcagcagctgggtccttcgtctctgccctggggagctggggccactggcaggagccagggcgagtcggtgggagaagggagcagagcgagggcctgggggtctggagtaggtggcactggggcaagtgaagggactcccatccccccataacccagccagtggtgggatggagtctggctgggaggcctggctgaagagctgggagcaggtgatgtggcagttcaccgaagccccagccgacgcggcagggtggttgcaggcagtgcctctgagagcccaggcctatctggggcccctactttccttccttccacatccccttgatgatcgctagatctcccccgccccagcccctgccatcaggcagggctccagttcacattttttgaataaccaggcctttgacagggttattttgaaaggaaaaatttcttgaatctcgacaaaggaagagggccagcagtcactcctctctctctctctctctctctctctgtctctcgtgtgtgtgtgtaagtgtgagttacaggcttgtgctgtgaggtggcgtatacctagagtttctgcgaccctggcaggggattttgagatgtggggtcctggactgggtgggcttcagaatgccattctgggctgtcttgctgagcagcttgagctgaagaggggacgggctgctgaggtctcaaggttggaatttctggggccctgtgttggggacagtctccagcccattctgaagtttgagtccatcttggctccagactctagacttctctgaggcaagctccctggtggaggacttaggttcgagggcctggctggctgtggtccctggggtgggtgctggggtctcttgggctaaggcttcctggtctccagcctctcctcagtcctggtgaggcgcatccctgttcaggccgctgccggccatcaccatattagggcataaactccaggcaggctgtctgggtgccaaatggtctccagctgggcccagccccctgcagcttccaacaccactgctgtgtgtcagaggccagaggtcaggggacaagagtggctgctgcagggagacccagacagagccccagagctcagggccctcgggcggggctgtgagggtctgggatgtggtgagtggaagagctgtggggtggggcggagagttcctggccagccccttcacctagtgccatcctgtttaagctggtttcagaagacctcgttcccctagatgaatccccagcgggttagaatccccgagcctggccagcatctgccatgcatcaggcccttcccacctggcctgctccctgcctccccagcacgcagccccttgacctcactgtcaggcttcaagcaccagctccaagtcccaggggtggcgtcgcctccaggttgccggtgtctgttgccggcttctaccttgactcacagcaccaccactgtcgcccctgctgtgggtttgagatcaggagtaggggtgagccagggaggctctaggaggtagaaaggtgaggagaggctgggtgcggtggctcacacctgtaatccttgcactttgggaggccgaggcaggcagatcacttgaggccaggagtttgagaccagcctggccaacacagtgaaaaccctgtctctatcaaaatatacaaaagttagctgggtgtggtagcatgcagctgtagtcccagctacttgggaggctgaggcaggagaatcacttggacctgggaggcagaggttgcagtgagccaagatcatgccgctgcactccaccctgggtgacagagtgaaaccctgtctcagaaaaaaaaaaaaaaaaaaagtgaggctgggttgctaagatggagtgggactgcatggtttgtcacccttgcctctcccccatgcctgcagcctccctgtcagcatggcctgtcactgacaccaccagccagtgctggccccagggcgtatgactctaggtgctaggcactaacgtggggacgggagacactgggaggcagagaagacagctgagcagagggggagctgagaggaaggaagaggctccctagggagagtgggagatgaggagcctgcctggtgggtccctggggggccatagaggagctggagcgggctgttaactgccttctggtttcattaaggacttcctgtgggcaggaggttctgagctgggccttaggtggaactgagtgcttggcctaaaaggggctccttcagaaatcagcacgggttggggggcggggggcggtggggcagcagggggcccatgtgctcaacagggagctgagggagaccaggggtgcttggcttaggggactgacctcatctggtacagggcctttggtggacagagagagactggaaaagaaaaagtcaaggatcgaggggaacgcgaggcgaggtgaagatgaaagatctagaagcagtgcttcttagactctttggtgaaggatcagtgttttttaatgctaatatgttataggctggtacatctgtgaaatacaagagcacatgcgtggattttgtggtgatgccaaattgctgtaaagtttttgaaattcttgctctcaacgtctgtccttatcttgtgtgctgacacaacggctggtgctaatctagagagaacagagagacagatagtaacagctaaccgtctgtagtgtgcggcatacgccaggcattgcctaagcgctcagcatgtgctgacttggttaatctttataactcatgagaaaagaattatatacattatgtgtatcacaacatcactgtgtaccccataaatatgtacaattattgtgtcaattaaaaagttaaaaaattttaaaaagaaaaaattattattcttcccattttatagatggaaaaaatgaggcacaaggatgttaaataatttaggaaaaaagcataagtgattaagcagcagatccgggctatgaacccagagatcgtaggcctaaagtctgtgggcttaagcactgtgctacagcgcctcgcttgagggaaaggcagaggtgctgggaggatatgaggaaatgagatagggaggaaatgagatcaaagatggcagaagaaaggatcatagccagcgtgagaaaaagtgcagccgggaaagagctagataaatcatataggcagagagaggggtaggggagcctggcagcaacaagctggggtagacagattgaggggagccataagggcggcaggcacatggccgggtgggggatcaggacgggagatcccggagaggaagggccatacggggaggcagaagtggacgggcccacttgggttccagggtccatcctgcgtggctttctgctctgcccactgagtgggtgccaagggggctatgtcctcccactctgcagggagctgcttcctatgtctggtggatgtggtgcccgtgaagaacgaggatggggctgtcatcatgttcatcctcaatttcgaggtggtgatggagaaggacatggtggggtccccggctcatgacaccaaccaccggggcccccccaccagctggctggccccaggtaagtgtacttgctttagggcaggctcaggggttcgtggtctcatttctttggggctgtgagctgtccaaggtcaacgctctgcaggaagggaggatgtaatggttgggtggggggtcccccctttggaggtgggaagtgaaccctgtaccctgaggatgtggcttggttcccctggcccaggatggacacataggggtggaatgacagggcccagaatcacaggtccttggcgtgggctagcaccgtttccctagcttcatctgttgggcttcccatcccagcatcccctgggagcggtcctctctccagcctggcttgagcagcccagggtggggaacatgaccacctgggagcagctcctcccctcagtaggaagctgtgtcctatggactcagctgtgtgtagtttctttcatctgctccttgttcatggactggccaagtttcctgggggtctgggctagctgaggagaggctttgagggaatgcccacctgggctggaccatccccttgacaacaaaggctcggagccccttcctctgtcaggatgccctctttggcttaattttaatctttccctcagcatcatgacaaaagtgctcacctcttggtttcttacactctaaaatgacagtgtcagtaaaactggccctacctgctcatcggatgccacccctgacggcagggcccctggcattgtgtcgcccacttaggcgcaggccccacgcactggctgtgtgacctccagagagtgacatgacgcctttgtgtccacacttcctcatgtctaaaatggggacgctggcacccagcggccggtgtgagagacagggatgatttatggaatccgccctgaagtgtcacttcagatatggcggtttatgatgactggattctagaatgatttttgagactcgaggtcaaaatattgtgaatggaagtggggatggggggttgcccgttcccctccttcccttacccagcggctgggggtccatttcccaggccttgcccgctccggggctgctcgcgatccccacgaccacgtgcctctcctctcccgcaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggtgagggcgccgcgggacccgttccgccccagcccacgcttcttctgctgccaggcttgctgcattctgggccctcggcttctgaccttttcactacgtcctgggtgcctgggagatggaaatcccattaagcacttatttaattccattaagtggcttgttgcgctattaaatgtccattcatcccattacattcttccactcccagagccctggtgggcccctggagctggctgtcccgggacggcctggagcagggatgccctgggcaggagacgtgcccagcctccgaacaccacctggccccctgcctgccagcgtcctggagcagaccgtttcctcttcctcttcctggtctcagggctgtctcctggctgcttccttagagtgggacaggggtctgacctctcttgtttcttgtgactcccctggtctcttgagctgaccccatggactcctgactgtgcagggcctggtctccactctcgatctatgggtggcctgcctggcctggggccctgggctgctggcctgaccacgctgcctctccacctaggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtaggcgcccagcggccgggctctcctctcaccttggaggagcttggagagggggtgggagtgggctgtgatccagagccgggtggagggggctagccagtgagggcctcttggagggaggcagacctgagggttggggttggcaatctattccagagctgcgatggggggagaggggacagtctgagaagtcctggagaggggactggagaggtctggtaaagggctgggaatggcagagcggaggtcgggtggatggggtgcgtgccttcggggcacagggtgaggacagggcagttgaggctggggacatgacagggccagtagcaaggggggaaggcggcctgagggacatgaaaggtctggctgcagggtgtgtgaaggaagtactaggggccaagccaactgggaggcttcaaatgagaaggggtcacagaggtcaaggacaggagggtcctaattcttccaggccaaggtgatgtgccaggcagagggtgggcctcagtcctgtggggatggccaggatggcctcgaggggcccaactatgtccctaaagcatgggagaagcaagttttcttctcatagggaggtggtgggtacaaagatatggaagggtcaggtccctgaatcctgggccagagaagacccctcagccttgggggcattagccagcctggtcttctgtcccctcctgggtttggggtcctcctggcagcaagaggacctgcgacccctccatggcttcatccacccgacaccttatcctagcctttgggggctgggggtgggtgggtcaggagtgcagatctctgcagtgagtgagaagcctgggataatgtggaggactcctgtcccaagctgttccctcctgccccttccacagcagctgcctgggttggctcatgtaagggagctgccctgctacctcggcgggctcctggccctgctcccaccgcctggctttctgggtccctgccaggtctccagcccactggccttgactccagagcattccccctcaccccaggcccttatctggccacctacccctctcttcctcctcccttgcttctctcttggttcccacctgagcccctggcatctgccctgctcctgtgcccgctgcatgtgcccgtgagttgcggtgggtctgtgcatgtgcgcctgtatgtgtcggcaggcgtgtgtgttcctgccagtcactagcagtctctccatctctgggtgtctctgtctgactctggctggctcagcactggaccggctgggcgggggtgtcagggagaccattaatctgcggtgacaggcccggctgctggcggagggggaggggctcaggctgcgggagcgccgctgcaggagcctgggcgggctgcgggggagggggccgctggctgggcaccggcggggcgggggagcctagtgtggcggggtgggggtggggacctggtagaaggaggggccggctggaggagctgaggttccgagtgcggccgctgctgggctggcgggcgggcagagcacggcaccctggcagcagggcccacgccacggggccatgggcagctcgagccaggcaggctgctgcccacgcttactgccagggtgaccccagccctggggcccagccacaaccaccctggcttcatgccaggggctgctctggttgccagtcggccagcctcgggggtgcagcctgggctgggactgctgctggggtgcaggtgaggcagtggccgggccctcaggccccagggcaggcaggctgcagggagccaagtcctccatggcggccccagccgggaaggcgagcaggacaggggctctgcggcccagggcccagaaaggccgggtgaggcgggccgtgcgcatctccagcctcgtggcccaggaggtaggtgacacccggtccttcctcttctttctggggccggcacactgaggcaggtggctggcccaagggctctgactccaggctggggagagggctgctgggaagtaggaagctttgggagccgtggggcctggccctgctcacccgcgcctggctcctgttctcattccctcccaggctgggcttacagagtttccgttgctgggacttccccgctcctgtgcctgccatggcccacagtcctggagctcaaaatgcaaagtggggagatgacaggaatgagatgggtgcccagagagatggtggggaggcggagtgggacaaaggagcccatgggcaggaccaggagaagccggcaggcgacagctgggcctggcatggaggcgccggggctcctttgctctgtgtgctggggttggaccctgtgggcaaaggaggcttgtgctgttttggggggtcgaggaggctggaatgtgcggaagccactgtgtgggtggtgagggcgcgctgggctgaggcacctggctcatctcttcatgggcagccgaggtgtggtggctgggccatgcactactctgtgacctcctgggagccatccagccgctcttctgtcagcctggggcaggcttgggccgacagtggaggaggagtgggaggtggctcagggctaagtctgggaatcccatccctgcccccaccaccccacatctgcacattctgccttggctcatacactctttccagctgggggacaggtacaggtaggtcttcccacccacagctgaggagtcagggtttggcttaagcaagccagcttcagtattctataggacaacaggctggggggacagacctggcccaaggccataggtgagctggtggctgcagagctgggactggcccctgtcaggtgtgccccatgcacgtgtgagtttgtaccctggggcagtgttgctcatgctgtgtgcagactcaggggtagggtcactgctgttaggggtggtcctgacacctccgcccagaggcttgacctctcaggcacagagaagagccctgtccaggggcagctaccttcttctgcccccttatcagcaggggcctggccagtgttttcttttttttttttcagtccccacttgatcactgaagggccacccacccatgggcatttgctctctgccttaaggagctgggcacttagacagcagacagagcagaaatggagcctgtgagcctgtccatgtgttccctccctgccctaggcctcagctgctcccgcagcccatctggtaccgctggaggccctgtgtccaccccagggtggtcaaatctttgactatgacccgtcttgacttctagttatttcctctaaggagatgttctcccagcagcgccatctgtgaaggtgtcttgggcaagcccagcttgagtatgaaggggagtctttgggactcatcaactatggcctccccaacccaaaagcctgagggtgtgggggcctgggagtcagtgcttctgggagcagggccagcacctctggaattcatgggggctgggcaaggccttgggttcagctggctgcccagggatggcagggagagcttggggagggggcttttgggttgagctgcatgcctgagagaggattctagggagacccagaagcttctgggacagtgtggagaagctggccggagctcttcttagtttgccttgggagcaagagggacgtgcctgctgtcaccgggtccggatggccagcctgcctctgtctgatgactgtggaggaggcagagtgtgagtgtgagctggtacaggggctgtgtgtgtcactgctgagcagtccctgtgtgcacgtccctctgtataagttgggtgccatctcctcccagctgggctatgtcttctttgtccctttgtaagagggtgggaggatgaggactgtgggctgtcccggacctgtgtggagagggggctgagggagcgaggtgtgcgagtggagggtgggagtgtcttggtctttctccatcctggttgcctggtgtcctcgggcctgtggcatgaagaggggctggtaagaactgcagtgactaccagtcagtggattggggctatggctcctggggccactgcccaggttgggagctgttgtccttggaaccctttccggtctgagactatggcgtgtgtggttgggtgtgtgggccagcgtctcagggcagtcacagtggcaggtctgcatctgcattgccggcggggagcagcactgggtgttcctgccgagtggcctgaatccacgtctgccgggaaatgttggaactgtttggagccagtcctgtgctgtgtggcattttgggaaccatgatgcccaaacctgggggtggccatttgctgtggtcgcttggctgaggggtgggcattctgatggaagctttttttggcctcctcctcattctgcttggccccggcagagatgtcatcgctcctgcccccgaggtcccatggcctgcctcacccacacctccgccttccccgggtgcaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggaggtggggtcagcaaggaggcaggtggtgtagggagaggagaggccaggaatgtggtgggaggtagtggggtggagggggtggcgaggaggacagagaaaaagagagagagagagaaagagagaaagacagtgggagagagacatggtggcaaggcagctgcagaggcaaggtgggtaccccagcaaacctatgctccttctctccacacaagctcctcgcaggttgcagagggccacacaggacacctttttttctaattcgtccatcccaaggggccattattttgtagcgtcaccaaagtgccctagaagctggtgggagtgggcaggcaccctagggtgatcactgcacctgtcagtgcccctgtttcctcatccacactatgggggctgcctctgtcccaaagctagcactaagattaatgagacacctgtgctgggcccagtgtgggcttcacctcttaggaggagggtctaggaagtctttggggatctgacctctgatgctcgctctgagggccgcagcacctcccctcctcccttgccccccttgccccatcaacggaatgtgccccttccctgtcccccagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctgtgagtgtgcccaggggcgggcggcggggagagcccacggtggaggaacccaagttggaggaaactgaggctgctagccgggccagagtgaggccctggaacttagagactccaggggccaccatcgtgacatggtttgggggctgggtcaccagggcggggactactgaagggtggggtgtgctggagcgcagatgtacaagggcgtctcgtgggcatgtcgacgctgagactgagacactgacctggtgcggggcctgagcagggtccctgtgggtgggtggggtccctgcagaggctgacggccccacgtgcccacgcccccagccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgaggccaccagagcgtggccagtgggtggcaggctgggaagagtggggtggcagaggggaacctcttggcacagcaaacaagtctcaggcggtcacagtcagtagtaaggaccctggaggcacgttgcccctttttgcccatgaggaaatggaagcccttggaaccccttccctggagagctccccttttggggtgggaggtatatgtcacataggcgatggggttaaatccttgtgacagcccagggcgggaatggtctctatgccttacaaataagaacatggaggtctagagcccaagggtgctcggccaggcatggtgaagctggagtggggtcccaggtccttcccaagacactgggccccctgatgcttccgagatctcccaggcctggaggttgagatttctctgacatggaggggtgggatggtggagtagagtgtgggttggggggtcccaagggagggtgtgctgagctgcccccaccctgcccccaggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctgggtatggggtggggggcgggcactggactggaaatgccctctgcagcctcaagaggtgcgagccttctgaatatgcagtcactggggctgtggacctgggactgcctgcagggtcactgggctcctttaattcacctaaactcaggccctccaagcggggccatggagaggagccccacgtggggtgaggctgctgaactctggggttcccacattctccttcccttcaggatccgccacaaacagacactttttgcttccttaaagtaggatcaaatctagatcctctagcctgggcagtagaggaagaaatgctagcctggaagctcggcatttggtttcactaagggccatgtggttccctgcagcctcatgcctggccccttgacacatccaaagcaaagggagtcctgccccctccccccacttcctttctaccctgcctgtgcacagtgggtgggttggtgtgtctggacactgaggacttcctccccctttgcctgtccttccctcggccctgtgtgcctcagggcagatatagcaagctctttcgaccatagttgatggtaggacattttagactttgtttctcagctctgtacaaacacaaatacacacccccacaaaactaaaatcaaagtttcactacataacactgggccttactgcatgtggttcattctagcatttctgttctgtgctgtgctaagctatactactgtatgttctttcagtaaaaaaaaaaaaaaaaaaaaaaaaatgctggttttgattcactactgtgttctgatctttggtttgaagaacattgcttataagggtgcagtgattggctaagagggtgtttgggacctggggtttggggtagtcctgctggctgggtctcatttgctgggagaccctgggctcctggcccctctggcactgtcgtgcctgctgggagctgagggagggtgggctggcagattgcttccccggttgtgtgggttgggggccggctggcaggcgacccagctgaggggacatgctctgcccggggtggggatgccgggagaaggtgcctgctgcctggatgccgccccccggggctgagctccctgtcctctccatggcctccagggaagaatgacatctttggggagcctctgaacctgtatgcaaggcctggcaagtcgaacggggatgtgcgggccctcacctactgtgacctacacaagatccatcgggacgacctgctggaggtgctggacatgtaccctgagttctccgaccacttctggtccagcctggagatcaccttcaacctgcgagatgtgagttggctgccctgagctggaccccatcctcctgcttccagctgtgtggctgcccctttgctgtgtgacattgaatgtgatgcttctctgtctcagtttccctgtctgtcaaatggtatcatagagcagcctacaaaagtcccaaactcagtctttgcctggggcaaaatcacattgggggcagggaagggttttcccagagctggggcgcccagccctactttttctgtgttaaggagggagcttggggcctgaccccggtggggcaggagagcactgaaagggccctgatactgattttggttccagaccaacatgatcccgggctcccccggcagtacggagttagagggtggcttcagtcggcaacgcaagcgcaagttgtccttccgcaggcgcacggacaagggtgaggcgggggaggggaggaagggggagggcggggacaaggtgaggctgggagctggaaggcggggtgggccgtgtctgctttacccaggcctcagaccttcccatcccttcctccagtgtgcccactccacaccccagctgtccagatgctgcccatctttcagggcccctgcagctgtcacctcctccaggaagccctcttccaccctccagggcaagcctaggctttttggacttcacagggctggggtctctgtgagcactgaggaggaaagaacatagaacaaaggagggccagggagccaacgatggggctgaggccccgcagtcccagagatccgccaacccctgaagcaccattgccagtgcttgggcagtcagggggtcctgggagttcttggtcggcttgacagtgggtgcaagatagcagaagaagcgactggggacaaaccagggcttcctgcccagtcctctctcgggctcgctcctgtcccctcctccaccctcgccccctcctctctgttctcctcccctctctgaggcccattctctgtttcccacagacacggagcagccaggggaggtgtcggccttggggccgggccgggcgggggcagggccgagtagccggggccggccgggggggccgtggggggagagcccgtccagtggcccctccagccctgagagcagtgaggatgagggcccaggccgcagctccagccccctccgcctggtgcccttctccagccccaggccccccggagagccgccgggtggggagcccctgatggaggactgcgagaagagcagcgacacttgcaaccccctgtcaggtatcccgggcgacgggcgggcgagggaggaccgggcgtggcagcggtggtgcgtctaccccgctcacccagctctgctctctggctgcaggcgccttctcaggagtgtccaacattttcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggtgagggagtgcaggtggggtgggggggcacgccctggagtctggtccaggtcctggcggtgttgtctggtagagggagagggcctgtctgtgtgtgcagcagctggatccccttcttccattcctagcccagctgggggctgccacacctctagcgcggagggcctgggttgacaggctgcccctcccccctccccttccccttccccactcccggtggaggctgtcactggtgtccccacttctctgagcatcccccacttcctgccccaggctggagacccggctgagtgcagacatggccactgtcctgcagctgctacagaggcagatgacgctggtcccgcccgcctacagtgctgtgaccaccccggggcctggccccacttccacatccccgctgttgcccgtcagccccctccccaccctcaccttggactcgctttctcaggtaagctccagccctgcttcctcgatgtaccgtgacccgcttgttccccgattccagcccaaacctgctttgctgcctttctgctgggctctgtggcccagcctccctgaaccttgttcctgccctcctcccacccctgtcctcctggaggaaggctgcttcaggagctgcaggctcagggtagggcaggagagtcccccgtccaaagcccctagacagctgggtgcagggaacctgtaggctaagtggcccgcagcttcactcccctagtgtccacagcctccaccgccaggccccggagcatcgcctgaagagccagctccaacggtggtgcctgtctcacggccacgggtggtctccaagaactgactgagcccgagacgtggcggtggaggctgcataccagagtatctagggacagggtcccgggtcccttctgtgagtgacactccctggtctcaccgtcctgcccatccttgcccttggcagtggctgtcacagggtcatcttgagggtgcttggcatttcccagggtgcagaggccaagcctccaggggaggacttcctgggcctgctttgccccctctgctagagatgggccttagttgccccttgtcctctcctgggtggacctgcatgttcctggcctctgcaggatggcggtgtctgtgtcaacctccgcgtccatggtggggactcctctggctgccagaggcggcctgggatctgctccctccccacttcccttggcatccgctcccccctcccatatgctgcctgctcctgtttgcagacacgagggcccacgtcagcaaatgtgccagtctcccttcgcagccgcccccgcagagctctcaccagcagacgctcagtacccacaaacccctcccgcctgccccggccctctccctggccttcagatgcctggccgccagcctgcctctgtttctaggtccccgagttctttctggattgcgggaaggaatcttgtctctttttctgtcccagcttctgtcccaacacagagactgcttgttccaggttgggttgggctcagcggccacattccctcgggaagagacaggggcctagggttttccctgctcccagctctcttgtttggctcctgctctcagagaatgcctttctctacttcccaccttggtgcctccccttggtggcccctgtcctgctctcgctgccttggctcttgtcccctccagcttctctgcccacctgactctcctcttggccctcctgtcctcccgtccatcctctgtccccgggttctcctgcccctttccctccccttcctcctcctccatggcctcttcgcctgcccatgctctgtgtgtattgcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctcccccagcccttgggaccatcttctcctgcagtcccctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctgaggagactccagtggtgctgggagggtgtaactgttacttgctgtgtcctgtgttcctgtctggacatgcataggtgtgcctgcacaggaatccgggtctgtctgcatgcccaggcccacagggctgcccctgtatccaggtctgggtgtgtgcagtgggggtgctccctgggggctgacacaggtcatctccagggagacagaatcttgtctctgtagggccctggattcaagataacaaaaaaccccctgaaccacatgcatttagaggcagtcctgatgggacactgacctggtgtctagcccctgagggccatgtgcctctgctgggtggggcaccctggctcccacagcttggcttcacactgactgtggaagcagccctgcacttgtctccctcacccagttcctgagcctgcgttgaccctaacctgaaattggtctgagtcctggctccccctgccacccacaacttagccttatcttatccaatacaattgggccccggacacactggtgactccagccctgaccagagctcacctggtgtctggctgcagatggacctcacttgtatcaccttggtcccctgtgatcctggatctcaagaggagcttcctgaagagggtgcaaccttcagggtgactcattcccatgaccggggagcaaggcaaggcagatgtcttggggacagtgaagggtgtgtgtgcaagtgcctgcgtgtgcctgtgtgtgtgtacatgtgtgtgcatgtgctgctgggcttgtaaggacatgcagcccccagaggaatgtggtgcaatgactgaggctggtgtggagagccaatgggtggcgggcaggctgtgcccagctgggtgggtttgcaggcagggagctgccaaaggcctccagagacagagcagcttctcactgagtctttgaaacctctgaccctcggaggtgggtttgttgactgttttattttattaatttttttttgagatggagtcccgctctgtcacccaggctagagtgcagtggcacaatctcaactccttgcaagctccgcctcctgggttcaggccattctcctgcctcagcctcccgagtagctgggactacaggcacccaccgccacgctcagctaattttttgtatttttagtagagacagggtttcactgtgttagccaggatggtcttgatctcctgacctcatgatccgcccgcctcagcctcccaaagtactgggattacaggtgtgagccaccgcgcctggctgttgactgttttaaagacaactgtgccgttctcactgcccatgcctgggtggggcgggtgttggtctctgagcagcctggaaggttccctgtgcccagagcagggaggagagaaggaagggatctccccctttccagggcctgggagagacagggagaaggaagagatccacaggtcagagggggagaggggtgacagagagggatgccaggcagaaaagacaggtttgtgcatcaggatctgtcccacacatgtacacacatgcacatgtgagtgtgagcttgcttctgctcatggtttaaaagtttaacacaggccttcctggttggttgatgtgactgtcactgcaggtgggggcctagctggggtggcctagatttggtgtcagtggggcatggctctgcttatggactctggagcccagggcaggagacagacccaggcagtggcttatggggagcagtgaaggtacacacgaaactcaatgctcttcgcatgctgggctgtgagctgagccaactccccgctccctggtgctgtttcatccttgtcatggtctgcccttgtccttagagtgccttcatcttgggagtctgcctgatgcccaccactccgtgtccagcagccgggctgggtgttggtggacacagagaggagaggaagaaagggcctttgcccccctcctggctttgtagcagaggtgccaccggttatttctttgtggcaccatgccagcaccacggttagctatcttcccctaggtgagggccctgcctgggcggtggaggtctggcgtggattttggtgctcctgaggagtggatgcatgtgtgtgagtgagtgtgcatgtgtctgtgctcaggatggggtctgggcccagcagaaggcaacctgtccatgctggtcctcgatagaaatacacaggtgtcccggagtcagttcagtctggatgggtcaggctgcccagatgccccttgccaagtcccttccaggactcccctgccaaggctggagagtgggtgaggggcagtcacagtggctgcgtttgccaggtggtccctgggtccggtatgcagctgggtgctctgcccttgtgtcctgaatccctaccccagcggagggcatgttagcatccacatgaggacagtcagtttctggctggtccagtgactggctggaggtcacatccctagttggtggcaggtgcgtcagacttcaggttctccccacccatcctcccgcctgcactgcccagccacaggcaggcctgctccttggctcctcccctcatctgggctcccagagcgacaggaagtttggtggtgaggacaagggcaagccgtggtggtgcagtccctcccctcccgcagggctgggcacctggctgttaagggcctgtcatccagagctgagggttttccccaaccaagagagccagagggtgggacgggagctggagggagctgtggcaagagaggaagggatccatgtggttgtcaacacgtggcagaagcctggcgcagggccccaagctggagtctggtcaggggctgggagcaggaacagaagcaggagggcagcgtggcctgtctcgcctccacctccatccccaggcgtggagggatgcccagcctgcctatccacgtgcaagctggtctccagcacctgtccttacctaagatctcatccccactcagccgggtggtggcagctctcacatttcactgacaaataacagcaatggatagttcctgagcacgccctttgcggcaagcattattccagccacctgaaaccaaagccccagaggctgagtgacttgcccgagcataccccactcctgagagtggagctggaaggtgagcccaggtggtctgagtcacatgcctgctggtcctgaagggacaggtggacttctcccccttgcctgcagggcaaggccctctgtgccagttttgcacagaggttctcatctttctttccagactcacctgccctctcccctccctgccatgtgggtcatgctgcagccacgcgagcttccgtcctgttcaccatgttcttgcatctgccctgtcttgctctcttcttgtgacgcagactccctcatccttggtgtggaaagacccttctgtcttcccagccctagcatggacgtcgccgctcctgaggccttctgcaggtttctcagccggttgtggcactcgctggcacctgtgttaggggctccccacaccctgcctgcttgctcgtctgtcctccgtaaaggggaagggctgaatgctggtcatcttttcgcctattcccacccagcatctagcacagtgcccaggacctgatgtggccactaggcagcccacaagaccccatgtttgaggattttgcacagaaaagggagatgtcttcctgacagagttggctgggctaaaatttgcgtctgtccctggaggtcactttcttcccaaaggcttggcctctggattatggctgcctccccgcctgcctccccgcctgcctccccagggagcacaagccccactccttcactggcaatgtggctacacatgcttatctttttttttctttttactttagcacaaccaaggtaaatattaaatatttgaaagagaataacgggagcagtggggaggataaaccagagacttggaccgagagcctcaagtccattcattttgtagattgaatgttggggcctgtccatggctgccccagtctgcgggcttgtgggccccaccctgttcccatgctctggaatgcctctgaggtggaactggggatacttttttgcaggggggtttgctcccagtttccagtttccaggtggcctctgagtggagggctccagctcaccgtcctctgggtggttgttcatttgtccttcgatggtcaaggctgagggaggttacaccgggggctttgcagttccagattcgggtctgtgggatctaccttttcccctggtggtggacagtcttccggaaactgaaacctgattgaacttgcttttcagtgagagcttacactgctgtaggaagaggtatttctttgtaggagtcctggcagcttgacaacacaaggaccataagaggacacatgtggtgtgttagtgtctctcaagtgctcaacgatgttgaaataaacggaaaacgcagggccttccaaagtgactgttttgaggcatttttagataattgtatatcattaaagagtggttagtgtgaaaattgatttagtaaaagattaaatagtaactattttcttaaagctgcatatatgcctggtattaagcgataaaaactcaatttaaggctggatgcggtggctcacgcctctaatcccagcacttttgggggcccgaggcaggtggattgcttgagattaggagttggagaccaacctgggcaatatggcaaaaccctgtctctacaaaaaaatacaaaaattagccagcatgatagcacgcacctgtagtcccagctacttgggaggctaaagtgggaggacagcttgagcctgggaggcggaggtttcagtgagctgagatcgcaccactgcactctagactgggcaacagagccagaccctgtctcaaaaaaacccaaccctcccacccccaaaactcaatttatcttgatctttttattacagtagcattttaaagagggtgcttcttaatcattttgaattactaaacatccaagtacaattctaggttttttgttgttgttgttgttaacttttgtcttccaaaaaaagaaaaagagaatgcattctgaggcacttgtttaaataatcagcttcattattttatattaataatcacaccttataagtgagttggaagtctgcaagagacattgctaagaaaccagagcagaagaatttagcatgatcctcttaccattattttaaaattagcaatagcataaggtctggctgcaaaagacttagatgctaactggcaagaaaatcagtcattagggaaacagtctggagagggctctcatagcaacacaaccatatgtgacagctctgcttcccctttctgctctaccaggtgatggcagccagataatcagatggaacttgctgatgagggacactaggaaggtcaaatcagggtggtctcctggacttaagcagcccaggtggaatggaagtcttagcagagaggctgtatttaatgtcaagttaccctgggtgccctgggatgatgactcttccgctgagaagtttggctttctgtggggctctaagtgaccttagggaagtgttattctcaggctggagaaaggagcatggaggaatgaggattaggcgacatgggaatgagtgaagggactcagctgtcctccatcctctggccctgggggagctttttctttcagatactgagaaatgggttgagcccatgtgcctagtgccaccccatgtctctggggatgcctgaggggcaggggcgaggcttatgttctgagtcaaggcacctgagacattggagtcagcaggcactggctcctaagcatgcagctggttcctgtgcctgggaggattgctttagctcaggggttcaagactagcctgggcaacaggctcttaaaaaaataattaaaaaaatcagctgggcattgtggcatgtgcctgtagtcccagctacttgggagactgaggcaggaggattccttgagcccaggaagttgaggctgcagtgagtcatgatcgccccactgcactccagcctgggcaacagagcaaaataccctgtctccaaaaagaaaaaaatgtgaggggcctttgtgagcactggggaagttacctcatgatacaggccagaaaacaacttaaaagatgatcccagaccttcaagccctaagttcttggccaccctgtcagtgccacctcactggtgacctttttccttgtcctcccacagccactgggatgctatccagatgcatctgatgaaccccagggaggaattaaaacatggccctggaagggaggagaggctgcagtatggcttctgtcttggtcagcaagcagttttcccataataataattagccatcataatgaggcagcacgttgcagagatgcggagctggcgaggatgaggaagctgcaaaggaactgtgctgaatgggaggcacaggatctcctgggagagcagagcctggtgcaggtctgagggttgggctgggcttggctcagtggctcctgtcatgccttaaaggcagtcctgaggcgcacaggaagtggtgcgtgatcgtaggctgagctgttcagctcacggcttgcaaagcccaggtcttaggaatatcccttcctgagccaattagcttcctacttgccgaggcagctgctgcagctttagcccagcctatcctcttgcaacctcaggcatcaggtgaaggatcagtgtttggaggggacggcaagtgccattgcttattagagactcaagtcacaccagacatgactgaggaggtgttggggcacagcgttgcttgctgaggacaaactcctcgaagtttcctgctaacttttcaccaactggtaaacgttgaatgttctgggtaactgccaaatttgtggttcagaaatggaaaaagtgcagaaaagctgaaagtgactttagcaaagaggcagctcctttggctgaagtgcttggcagggtggacgtaactgacgcagcaggacagacacgcctctctcctcagcatcccctgtgggtggcgtctccttggtcctgggtcttgggttagccccgcagctggatccggtgctggtgaggctcctgtccaggtggcctcactctagcagagcagactgggccttgtgggtgcttaccatgcccgggatcccccgtggagactttataccccaacccagggcaggagagctttcacttaaaatgttttccttgagccccacctagaatcacagaaagtcgccaaaagtcatgagagagcacagtctaccccgtcgtttttcagtggaggggaatgaggcttaaagttgctcaaggcaggagtttccagagcagcacggcccctcacttcccgtcctgctgcaggctggatgggatgcaaccgcacccttcagtagctcataatttagctgggaccatataagagaaataaaagaaaatgaccatggccccacttttatgaagtgcctaacagagcttcttttattcctattcaagtcctcctcattctccaggacctggctcctggcagccctctccataaagcctctccatgaacccttgtcagtctacagctatcctctgtggcattgcatgacacacaaagccacaccgtcctgtaacttttttttttttttgagatggagttgagttttgcttttttcgcccaggctggagtgcaatggcacgatctcactgcaacctctgcctcccgggttcaagcgattctcctgcctcagcttcctgagtagctgggattacaggcatgcggtactatgcccagataattttgtatttttatagagaggtggggtttcaccatattggccaggctagtcacgaattcctgaccttgggtgatccacccgcgttggcctcccaaagtgctgggactacaggcgtgagccactgtgcctggtcctgtaacagttttttttaattaattattatttttttaagagacaaggtctccctctgttacccaggctggagtgcagtggtgcaactatggctcactgcagtctcaacctcctgagctcaagtgatcctcccgccccagcttcccgagcagctgagaccacaggcgtgtgccaccacacctggataatgttttctcactgaaagtggaaacagccatttctgtcttctatattagcagaaaaaatatttttaaaaacccgaaggactgaactttcagttcttactgcaaagcccgcaggggcagggttatctggactggagggatgtccactctttgctcacagcctgactttgatactgtgttctctgtggtctaaggaacttaccaatggggcttcagtagtctcatatcctaaacacgttatcgagttgttttcattttcagaaatcattaagggacacatttgacccacatagagactggcagggtcccagttgcctgctaagttctcagacagggccaggctgatgaaaattcaacttaagtcattaattgctgcataatagcaatggtgccgttgtgaatggaggtggggtccttagaaactggctctggaggatggggcagggacttggctcttggagatgcggccatgagagctcctgggaatgacatggagggaataacaggtgtcttgacactagcacctggaggtgtgtgaggggccaggatggactgcggatagaccagtcagcgtacccagcacagtcagcacaaccagatggccatgtgctccggggccagagggagacggagggacactgtggcccagatgtaaatgatggatttgctctttttgtattttattttattttttgagatggagtctcacactgttgcccaggctggagtgcagtggggcgatgtcagctgaagcgattctctgcctcagccctcccgagtagctgggattacaggcgtgaaccaccatgcctggctaatttttgtatttttagtagaaatggcatttcatcatgttggccaggctgctcttgaactcctgacctcaagcaatcctcctggctctgactcccaaagtgctgggattacaggtgtgggccaccatgcccggccacatctttttgtattttaaagtgaaatttaaaaacacaggttaagggttaaaattatgaaacagacctgatataaaacatgttattttggggataaattttcctggttgctgttgtggagaaggtggaatatttcacctttggtgaaataaactagaaatgtggtgttagtcttgtctacctaacacgactataaattctttgcagccagggctgagattgcggtggagatgaagtgagggtctgtttgaggaagtctctctccagaggtgtgcacgaaggaccagcagcagagtggcactgcctgaaggtgtctttgtgaacatccccgcccctgaggattggaaatagaaacctggggttttaattctgtccatttttgtcattgtcacagagctcagtgaaagctgactggctacttgaaaatatcagggttggaaagtgggcttttgagaaaacttatcaagcgatagatcactggaggctgggaggggcacaggatcaggtgctggggagctgagaccggcagactggaaggctcttgagagtgcagggctccatctatttaccatgccgagcaggagatggagtcccggaggcaggaggtggcttgccaaggccatagaaatagagtcagggccaggtttaggacacagctctggcccctcaattccacaaatgcagaactgtgatgctcccaacccttggaacatagctttgtaaaacccagatttttcttttttttttctttttttttgagatagggtctccctctgacagccaggctggagtgcagtgacatgatcacagctcattgcagcctcaacctcccttggctcaagcgatcctcccaactcagcctcctgagttgctgggactacaggtgagcaccaccatatctggctattttttttttttttttttggtattttgtagggtttcaccatgttgcccaggctggtcttgaactcctgggctcaagaaatccacctgtctcagcctcccaaagtgctgggattacaggtgtgagccaccatgcctggcctggcctgttcttgggtgtgaaggtatctgatgtgctgggcggcctgtgcgtggggttctttctccagggttggagagggatggtgcggagccctttagctgctcccattcatttccgcagaaggtgttatgtctttgagaagagggaaacagtggaatctgtttcaatcaatatttatttggataatcaccatctggctggagctcccaggccctcaccctacccatctctccacttctctggctgcctgccagtggatcccagttacaggcctggacctcaagggagggtgaggacagtctcaggtcagaaggaacaaaaccaggctgtcttgtcctgctcttatgtccaggcaggcatgtctttcctccagtccacggttttcaaccagaggtgatattgccccccaggcatgtgtggcaatgtctgtgcactttcggttgtcccacttcagggtggtggtagatgggttgttactggcatctagtgggtagaggccagtaacatcctgcaggcacaggacagcccccacaacagagaatcagccagccccagatggccatagtgctgaggctcagaaaccccgctccaggcctgttctttatgattttttgggaagaggggtttcccagctgccttcttcccctacacaacgtgacagcaagccactgcggggcctggtttcacctcctacctcaatgttttctcactgaaagtggaaacagccatttctgtcttctatattaacagtaaaaatatttttaaaagctgactgtagtttaaactgaatgtcctgggagaaaggcaggttattcctgtgaggaagagatggctccttttgttcagaagtaccctgtagtctgtttggttattaacgatgaggtccttagagaggggcctgggtaagtgagagctggtcagagatggtacaccaggaatcgtttctgagtcttttttttttttttgagacagagtctcactctgttgcccaggctggagtgcagtggcatgatcttggctcactgcaacctctgcctcttgggttcaagtgattcttgtgcctcagcctccccagtagctgggattacaggtgtgcagcaccacgcccagttaatttttgtatttttagtagagacggagtttcaccatgttggccagtctggtcttgaactcttggccttaagtgatccgcctgccttggcctcccaaagtgctggggttacaggcatgagccaccccacctggcacacttttgagtctttaagggcatcctgggagagatgaggcccagcggtgagagggagaagagacttccatggcctatgaagacgtgcggaattattttttggtgggaaatggccaatgaatatttaggaaaattgatgttcgacatttagtgttaggttacttcgccccagtggttctgttaccctcctagtcctcagtaaacgcttgtcacacacattgctgtttgttagtggtgcttggggcagtagaggaggggacatttcctggaggacagagctacacgctgagcggaggcagggtagagggaggtgggcaggagccggccacacccccccatggctgcagtctgctcccagcatgggtgatgctaggacattcccttggcccccagatatactactgaaggtgactttaaaaattttttatttaattatttatttatttctgagatggagtctcgctctgtcacccaagctggagtgcagtggtgtgatcttgactcattgcaacctctgcctccctggttcaagcgattctcctgcctcagcctcccgagtagctgggattacgagtgtgtgccaccacgcccagctaatttttgtgtttttagtaggggcggggtttcaccatgttggccaggctggtcccgaacgtctgacctcaagtgatccacttgccttggcctcccaaagtgctgggattacagatgtgagcccccgtgcccagccccatttcaaaaatttttaaattttcatttttttaaccttttattttaggttcaagggtacatgtgcaggtttgttatgtgggtaaattgcatgtcgtgggggtttgctgtacaggttgttttattacccaggtaataagtgtaatacctgaggtagttttttgggctgcaccctcctcccatggaagatgactttttttttcttttgaaacagagttttgctctgtcacccagctggagtgcaatggcatgaccttggctcactgcaacctctgcctcccgggttcaagcgattctcctgcctcaccctgctgagtagctgggattacaggcacccgccatcatgcccgggcaacttttgtatttttagtagagatggggtttcaccattttggctaggctggtctcgaactgctgacctcaggcgatccacccacctcagcctctgaaggtgctgggattacaaacgtgagccacggtgcccggccagaaggtgactttttaaggggcttgctgggaggagtgcagcagacaggccaatctccattttgtatgtgtgggccttccccatggtagacacaggggttacatatatcatcacaaccctttgtgaccacagctgctcattgcctgccccaatatccattattcttttcctcttcagtaatggaacctccaatgttgagctcatcccatggcttcctagaataacgaccattcaccagccccctttgcagcttggtgttgccctgtgattaagcttgggccagtaggatgggagtgaaagtgccatatgtaacttttgggaagtgctttttaagggaggagagtttctccttcacctctccttctccctgctgactgaagcgtgaggtgtcactctcaaggtggatgagcctcatggacaaaagctcccaggtttctaacgatggaagagcttccacactgtgctgactgctgcagctgctgcctactggcccgaggcagttgagagctaggaagaggagtgtatgggaccagccatgctgcctcccttctccagcatccttttctctcccctgagcagaggaaggcaaagcggactctctctgggtctgtgaattaatcacaagccactggccttcataggatgcttgggactaattccggagcttattcatggctgttctgccctgaattcatggccgttagcccctcttccctcagctcctggcaatcccatacccgtctttctttgcataagcttcttatcagctctacacctgttatagctgctggtcatctggtgtcatgatgtatcagccagtgtgcagtcataaaagcagacattactccagatatttcaaagaggatttagttcaggaactattggaaacatgggctacacatgtggaagaagagctgccacagtgaacaggaggaaagggtgatgccaataggtcaggaagctgccactgccccttggagagagcccacagcacacactccctgctgctgctggaaagctgccaaacgcaagctgctctgtggtccccatgaagccaccagcgctgctaaaagccacagtagcctgctgcagttgtggcagaagcttagtggcttctttctcgtctcctctcctctcctgtcattgattctcattggtgaaactcagccagaacccagttggtgagggagtctgaaatgtaatttttacaattcagagggaagtatggaaaggagtgtgggtgtcagggctaaaggccaataattggctcatggaggaaaatgctcagctttccaggtgagcctcaccccttgtattttttcatttttgaattaaaatgtgtttttattgaggaaaatttaaaatatatacgaaagcactaagaacagtctaataatcctttaggtatctatcagataactttaacaatgatcaattcatatccaatcttgtttccacataccctccactccccaacaccagattattttggtgcaaatcccaaacaccatataatttctttcttttttttttttctgagatggagtctcagctctgttccccaggctggagtgcagtggtgcgatctcggctcactgcaagctccgcctcccgggctcacgccattctcccgcctcaggctcccaagtagctgagactacaggcacccaccaccatgcccggctaattttttgtatttttagtagagacggggtttcaccgtgttagccaggatggtcttgatctcctgacctcgtgatccggctgcctcggcctcccaaagtgctgggattacaggcatgagccaccgcgcctggcccaaacaccatataatttcatctgtaaatattccaatttttctaaaagatgaggactcaaaaaatacatagccacaatagcttaccacatctaaggtagagtaattccctgatatcatcaaatgttccgttagcaatcaaacttcagttgtttcatatatctatatctctgtatatgtatatatacacacatacatatattttatagagacagggccttgctatattgcccaggttggacttgaacttgtgggctcaagtgatcctcctgcctcatcctcccaagtagctgaggatacaggtgtgcaccactgcatccagcttcatatatttttgaaatagttttctttatttgaaccagaaaccaaataagatccatacattgtaacgagtagatatgactcttaagtaccttttattctatggggtcctcctccatatttttctttgtgttttgttttgattgaagaatctaggttgttcattctttagagttttctacaatctgaattttgctgattgtatccttatgatatggctcaacattagaggggaccaacaggtcttggttttacccactgctaaaaccaagaaagtcctgagcaaaccagaatggttggtcactctgcatttttctctgtcacccgtatttctcataagttggtagttaaacctagaatttttatcagactcaggcttcaatttttggcaagattattccctagttagtgatgtattattccaacaggagacacagaaatagctggctgcctctcttcttgtgattttagcagctataaacgacggttgcttaaacctatgaattcattacaggttgcaaaatagtgatgttctaattctgtcttcctttttcatttattagctggaattctcttatagtgagaaatgaactctcagcaactctttggttacccagaggtaaagttcatatcgtaaaggcaatataaacatgcagttcattccctttatttgctacctttcaaaatatggttctctgacatctccccaaagtgaagaatgatattcctctagtggtactgtaaactcataggctggaaaaaaaaaacaatgtatttcaacacttcccagttattatccttattgatctcacatgtttccatctttggccagtgggaacttatattcaggttggttcctgagttattttgacatgaccctggtaggtttttttttccccccaaacacagctttattgagccgtcattgacaatcaaaggattgcacatatttaacgtatataatctaatgagtttggacatatgcaaatgcctgtgatagcatgtccacaatcagggtgaaagatccaaaacctcccagagtttccttgtgggcccttgtgtgtgttaagagtacttagcatacaaacttgatagcttccttgttttatgatattacaagatgttccagaccaaatcattttgtacctttcctgtcctgatcttggaaacagccatttctccgatgagtctcggttctttttaataggaaatgtatttatagctaggagttctcattactactactagatggtctgggtcctttcaatggctatagctaggaaataagcattccttttaagacattatataatgtgttcatgctgttgtcactaattctaattcagaactgcagagttttaatttaacctcatggatcttacatctttatccccttttccccacactgaaaatcctgactcttcatggcaccaacatcattactcattggctttatctcacaacaaacacacatgcaatagtctcagagcagtaataccaaccaccacaactaacactatggtgactggaaatctctttgtgatatttttgaagttctttttgtccttaatatatcccactagggacgtatagtgaaattactgtgtttaagtcggttggaataattccttcttgcatggttatgttccgtaattatggttcatttgtgtaatttcccttttcatttttaggacttgcattttaagtttaattctaaagttgaatctacaaagcaaagtatattcaaagaagtctcatttctatgcctgtctactcccctcctctcccatagataactgttaaggtatttgtgtttgtcctttcaacattttttaaaataagcaagtgtatgtatgtatgcctctagtttccctacttgtgttttttagatgaatgaaatgtccatacgtacttttttcttccttgcttgatccacttagtatctggagaggagtccacatcagtaagaagagacacgcctcattccctcacagctgtgtagtatgtcatcatttggatatagctgactcaaacggtcccctggtggttgccatttgtttccagtcctttgttgttattacaaaattctgctacaatacatagtcttgtgcatacatcctttcatatttttgctactatatctttgggaggaattccaagatttgctgggtcaaaggtcaatgcatatgtaattttgtaagatattgctaaagttcccaccagcaacgtgggaatacttctttctttaacctcgccaacagactatgctgtcacacttttggatctttgcccaatttgatagatgagaaatggtatctgtgtctttttaatttatatatttccatcacaggttgaattccctgggagcagactctgagacagagactggaaggagggagaagagggaggactgggtagagggacaagtccgcctgtgactcaacctcaacagagagcccagctgagcccacagtgacctctagggctggcagggcccttcagagaggctgcgtaggaatgatgggcctggctgttctatccccgtgttaatccatcactgagtgtgggctgctccggaaggaggtgtgacctttggtgaggcagtttttttcctgccaaggcaaatccatgggagggcggacagcagagggccatcctctggtggcactttccatcataggtagggattatgacatttatttcagaaagacaatctgggtgacacatcacggcatccaccctcattgcttaatttacctataatatctactttaatgattttgttttctacatactatctatctatctatcatctatctaatctatctatgtatctatcatctatcaattatctacctatcatctatcaatcacctttctatctctgttatctatgtatctatgtatctatctatctatcttatatctatcaatcatccatcatctatcaattttctttgtatctatcaatcaatcatccatctatctctctcatctctctcttctatctatctatctatctatctatctatctatctatctatctatctatctatcatctatctatctctatcatctatttatctatttatctagttgatttgtcttggattgagacaggtgtgttaaatattcttatttttttttaaaacaacatgtttctgtatatttctcctgtcatctcttatattttctgcttcatgacagttgttgctaagccactgccatataagtggcacctactgttagatctccatcatgattgcagactttgggattctgtagcctccttctgtgtctcatttaatgctctctggtctgaatcctgccttgttggatatcaagatggtgactcataatttcttttaatttttatttgcctgttgtatctttcaattatactgaacattttgataagcttttatttttaaacttttgcaatctctttgtattagtattgcctctgatatatagtataatattggatttttccttttttgccaatatggatacctttttcttctaacagctgagttaagccccattatattgattgatctgatctatgtgtttgaccccagttgtcacattgttttattatacatatcattgtatgcacatatctatgtctatatcgatatatcaatgtgatcaatttttttagctttcttttggtatttagaaggtttgaatttttgttctaataaatacctttattctaatacctttatatgacacttttagcttcctagttgtggttattttgtattagttccctacttcaagcaagattaaaattggttagtaatatcttctccctcccttgtctgctccagcatatattctgaagcgatactctttgaatttctgtttctacctataaggcaaccagcaagcttgttttactttttatctactttccccactctctcccctgttttctttttctcaagggatgcggtctctctctgtcatccaggctggagtgcagtcgtgtgatcagaactcactgtggcctcgaattcttgggtttatgtgatcctcctgcctcagcctcccgagtagctggggacacaggtgccaccaccatgctgggctccctcctggatttttgactgttgtaatctatctacagtgtcagaacacagccctcaccttctacatgaccgcccttataattatcgtttcatcttggcactgaacttacagccagtccttgtatgaacggctttccagtcatttgtgttgtttgaagcttgttctttagtggattcttcagtaaaagtgcatgagagtgacactccctgagttctccaacatttgcagacataactaagatctgtcaatagcctttccacttaaaggttgtcttggctcacattgtctttccttgagtacttaaaatattttacttcactgtcttctggcataaagcatggccattgaaaaatctaaatgcaacctaatctttcctccacttccttccataagtaacttggtctgttaaactggacatccaaagatttttttcttttcaaagtgtgtagtcccacaagcatatgtccctgttggtgatcctgtgacgactttcctattgtacaatatgcttccatatccattacagtatgcagttttaagtatctttatttcaggaaaattctaaatttagttttccatattattctgttctgtggcttttgttttcttcttggggatttttattatatgaatacttcatcttcttagtccacctcctgttactttctcttgtattcttttcattgccttgttcataccttttaactaaaacttttttcttttttcatcctttatttcatttaagacattatccactgtgtctatttgcaccgacagttcttctaacttagacttcatttctaaaataatttttatttcacatctgagtctcttctgtcttttcatactattgttttatttccttattttggatcttttctacttctgactcatgctggtcttcatagcatccatcactttgtgtatttttgttcattttgaactatgaagggccagtgttggtttgtgctttggccaagtcattctggttggtgagccttcattgtctgcaggatagtatttggctcctcatcgcttttttctcaaattaacttagaatgatatttatgtgaaattatttcccactgctcatgcttaagtaaaatgaattttctgtacttttagggaagaaggttgggctaggataactttttttggactttatgactctagagtctgatttctgttctttcactcggggttagaagatacgaaccccacattctgagcactctctctcctttgatctcctcctcactttaaactgggccttgtcttctctttgtccccattgaccccaacccaatcaattcacattcttttctcagcagtttttccccagtgcaagatttggactcagaaggcagctgtggtgtgtcagtgtgctgaattcccagggtccaggtcactccagcacagttccatcttactgaggtccccttgttctcacctctgactcggcacctacacaccccttgcccggtgctggcagctgcgctccgacaggcctgcagggagtccctggacacgcaccagacgggctgtgctgttatgatccccgggcccagcagaggcccagctgtttttcctgctcttcctctttcctacacaactgtttacatcacgctgctcttgaagctatcagcagtttgcccggacacattcataatttgggtttgtgagtttgtggggacaccttgtcacccagatttgttgtagatattctccatagatctacaacaggaaacgttttcaggaagggttttggttttgctattctggttctgttctcttttatgtggtgatttggggacatatatacatatatatatattttcttctttttctttttagagacagggtctcactctgttgcccaggctggagtgcagtggtgccatcgtagctcactgcagcctcaaactcctgggctctgacaatcctcctgcttcagcctccagagtagctgggactataggtgtgagccaccaggcccagcattgatttgaggatattaaacaaacaagcaattgtgggccattaatatccatatctggtcctgtttattaattgaaattattaagaaattttaagtgtaatatatacctggtgacgttaatgaaatgctagttaactactgtatcctatgtgctggaaatgtcctatttagggcaatgtgtccaaagggcacagactgaataaacataataaagatttcagggttgaattaagttttctagggctgctataacaaaatgccacaaacctggtagttttaaatggcagaaacagactttctggcagttctggaagacaggagttgaaagtgttggcaggctatgctccctctgaagggtccagggaggagtcttcttgcctctctcagcttctggtggttgccagcaattcttggcatcttgatgacatctgcaaaggccttatttctaaagaaagccacgtccacagggaccaggtggacatggattttgggggacatgatttaactcagtacaggggtcttaggttaggtaattatataatagggggacttcctagataaagagaaataaacatattccagaaaaagagtcaggagacctagacccagctcttccaacctctggcatcagcaagatgaccactgaatccctattaatgagtttctttttagaagcctgaaaccctcctgtaggctaagaaggaaatgagtcagaataggtgccaagagctataaattttctctgtctggggtcattattccattgcctacaggcacatacttggcagctcaaagtaaatcagtcacattcaccagtctaggtggatgcattggttatttaattaattggatgtacatggttcagggtcctagttcttgatgggcacctgccaaattcttggcagtctagaaatatcccaagggaacttttctgacttataaatagaattctcataatcacacatgccacccttgttctaccaccaagcctacacctcatcagtgtattttaacaacaacgacaacaacgacaatgacaatgaacaacagcagcaatcctattccaactcactatttctggacagtgttttatgtcttcagaacattagtagctgcttcacaatgaatatggagcagtctcttagctagttggcatggtcctatgaacgattattatgctctttgtctttctgtatcatttttaaaagatttgagcagcttctccaggaactttaattctactggacacacactgaagttgtgatatttgaggcccaaggtaagatagagttagctgtttattcccccaaggtcacagttatccagtgtattgcacactatcctccaccattctcaacaactttccactcattctctgctaacgtcataccaacttcccaccagcctcgcaagtcagcctcccaatttcgtattaccaactggtcatctctcaaccatgggccattgtccccagcaaggccttttacctttatgtggagcatcctcttgggtcttaatgaatagcaatttgagtcatttttgcacttgcatctgtccctgcatgcatctttctatttctgcgtatcttttcatacgtccttctctcctactggccttctctttaattctccttttcctctggtaacgagatctgtctagtctactttccttctattcctttctgtaacaggggtatcaggcagacttgacttgcagacaatagaactaactctagccgtttaaatcagaaaaggatttaatacagagaattaagtgcctataaaaatgttgccaaattggaagactgtttctagacccactcttagaacaccagcaaggaactggcaagggaactgctacctctcccatcaaccaggaagcggacaccagaatcacccactagctgcaatccaggatcaggaagccatggctatgcctgtttctccccaaacacaacgccgttcattgcaatctgcaggcagaaatgttgttgtcacaattgttggtggaaaatggatgccttccatactgctgcctctcttcctacttaaatcagttttgagatctagtctatgggcatgcacactttacctggaagaatggatgggctggagtgaagctcaacagtaattcatgggcaatggaaaatatctggccagagactcagaggcttggcagggacccagatggatgattggtgatagaacaacctgaggaagagggaggtgggtgaaccctgaacatgtgaggatatttgtgtcccatgtgaatactccagaagaggctctcagtaaacgcaacccagtctgtggacactggtcagcctcccctccacttcccccagccatcccagtgatctctcaatgggcccgtgtacaaaatgcctgtggcagcagagacagaggcccagatttgggctcaacgctatggattttccctcaccaagtctggtctgcatcctgctagtactaagtgctcagcttcttctttttttttgagatgaagtctccctctcttgcccaggctggagtgcagtggcatgagcttggctcactacaacctcagcctcctgggttctaagcaattctcctgcctcagcctcctgagtagctgggactacaggtgtgccccatcatgcccggctaattttgtatttttagtagagatggactttcaccatgttggccaggctggtcttgaactcctgacctcaggtgatctgcccaccttggcctcccaaagtgctgggattacaggcgtgagccactgcacccggcctcagcttcttaataagtgtcttcttgaccatgacagtattacatacaaattacttctaaccaaggaagtgattttacttcaaaagagtgagatgctggagggacattcgcaggattccactgtctggcaatgtcctcagatcacctgaagtgctggctgttggagatgcattccaggcacgggcctgctcatgtcacaaggcccaggctgttgctctcctctgatccttattcttactcccttctgccccatctatcttagcctttttctcttttcccagcttcctaaaattttcactccccagtgtgtcctatgaaccattgttctactggtggtaaagttcaaggtcaactcatttcttcccctcactctaccttcatattaactgaagccttgctctctgtcttctgaacacatttttattagacaaggcactttatgttggaagttgcagaaacccaactccaactagcttatgctaaaagggaatctgttgggtgctataacatagaagggcaggatattactggttttaggttaggctggatttacatgatcaactgatgtcctgagagctcagtctgtcgccaactttggctctgctttactcttgttgggttcattctctggcagtatctttctgtggctttaagaaagcgactggtagctccaggttgtgatgtttacaaatgcagctctcatgagggaagccctgtttctctttaatagaaataaccaggctggatgcagaggctcacacctttaatcccaacatttcgggaggccgaggtgggagcattgcttgagcctaggcatttgagaccagcctaggcaacataaagagaccccatctttacccccgccaacaacaaaaaacagaattagctgggtgtagtcccagctactcaggaggctgaggtaggaggatcacttgagcccaggagtttttgaggctgcagtgagctatgatagtgccaccgtactctagactgggcaacagagtgaggccctgtctctaaagaaaaagaaataaaattaaatcagcagcatcaaatggaaaattggccctgcttgggtcatgtgcccatccttcttgaattaatctaggatgaccaggcatgtgccacgtgattcttcctctgtggtgtagttgaaccatgcaaagctgtgtgaggggcaatttccaaaaggaaggagagctgggccgctggagcatagcagagcccactgtgattctgtgtttcatacccctgccatttatgccacaagtgcctttcctcttcttcctttagcctgcacctgcgcttctagctgctcatgtcctatttcttgctggtgagtgtgcctatattttcatacttgattcactcagacaaccaccatctaggttgggaaatcgaactcaccggccccctagaagctcctgtgtgatgcttcctgatcacaatctgtctgtgaaagacaaaacaaaaaatacctttagaaagtaatagcaggaaactagaagcactaaatctaaaggaaaacattagttcatatgactacactaaaatgaagaatttctgtttatcaagagacatctttagggagtacccatacaaattcccacaatgacaaggacatatcacaaggatagaggagccagcctgaacgagcttccagtggccaaagctggaacaatttgagcagcaaagtaaataacaatagtagtgaattataaactaaagaataaaataaatatctgtgagtacaaactgatataaatacatgattgagtatgtaaataaaatgggaagacgggataagtcttccatacagaagaattctaaagtaggtagacgctcctccctccagaaatatgagtttcagcatgagctagacttagggacttgcttccaaagaacggaatatggaaaaggcagaagagtcacattacagtgggaaagccttaaccaaatgctcaaagctaatattccccatgatgagccatgctgagatcacgtgccctagatatgaagtgaggagaagggcgcctctcgtctgtggttcgcctctaacacatatgcccagtctaatcgtccaaagacatcagacaagcccaaaatgagggacattctacaaaatacttaatcttcaaaggtgtcaagatcctaaaaaaggactaagaaatggtcacacgcgggaggaggaaacctaaggagacatgacaatgaagtgaaacgcagtgaccgggattggattccgaaacagcaaaaggacatgaatggaaagagtggtgaagagtgtttcgtttaattaatagtattgcaccactgtcagttcctcagtgttgacaaatgtactgtggtaacttaagatgttaacgttaggggaagctgggtgaagcctatgtggaactctgcattatctttgcaacttttctgtaaacctaaaattattcgaaaatagaagtttattaaaaacacatctgtatggccaggtggggtggctcccgcctgtaatcccagcactttgggaggctgaggcgggcagatcacttcagatcaggagtttgagactagcctgaccaacatggggaaaccccgtctctactaaaaatacaaaaattagccgggtgaggtggcgcatgcctgtaatcccagctactccggaggctgagacaagagaattgcttgaacccgggaggtggaggtcgcagtgagccgagatcacgccactgcactctagcctgggtgacaaagtgagactctgcctaaaacaaaaaacaaaacaaaacaaaacatctctgagaggaaaaaaagctgaatcacagaggggaagaaggtatgtgcagtgcacataacctacaaaagactcctattcagaatgtacagagtccttacaaatcaacatgaaaaaggcactggaatcaatagaaaaataaatgagtaaaagaacagaacaagcacattgcaaaataggacagccaaatggccaagaaacatgaaaaagtgccttgtctcattagggaactgtgcatgaattattgtttaaaatatttgttttgtggctgtgtttcttcttcgtgcattccaattttgtgggagttgcagctcctctgccttccttcatagctgtcactttctctctttgtttgcctttcatttcgctcgcccgtctaatccgtttcccccttctgggttccgaagtactttctcgtgctgcttccagttttgtcttcatttttgtgatgatttaaattttgattctactctttcctgggttttgccagctttcttttcatatccttctgttttctcaccatctctttcttgagctgttacttaagtttaaaaaattcatggcaaaatatttggatatgcttttcatctgttcattgcaacacatttttgacaagtgttttttatctgccatttttctctcatttttagtctataatatttttgtatagattgtgtatagatctaaatattatccttctttgatgcagacaagtttttcttggaccagatatttgcaggaggttcgtaagaggtaggggccggggccattctaggctgacacaaatgaacctgtgaattatacatatattttaaaaaacagaatttgtttaaactttttcttttctccgctcagcagggataggaaggtgtagagctgtctgcaatgcaaagtctttcttctgctgttgcgttagggtgtgtattactttcatatttgtagtaacaaacactgcaaacttagaacaatgcacatttggcttaaaataacacaactttatatcttacagttctgtagatccaaaaggggtcatagtgggcaaaatgatttatgaccccttttggatctccagaactgtaagatataaagtggtgtcaagatgtttgcagggctatgttccttctggtggttctaggggagaatccacttccttgtctttttcagtgcctggaggtcaacgacatcccttagcttatggcctggtcctccatcttcaaatgcataaacacagcatctccagatctctctcttggacattcctgcctctcataagaacccttgtgattacattgggcccacctggaaaatccaggctaatctcagcatctcaagatccttcatttaatcatacctgcgaagtcccttttggcaagtaaagtagcgtgttcacaggttttggagattataatgaggacatcttggcgggggcactcttctgctgcctcaggggtcacagtctggattaggatgcttattatatgtgcccttgggtcaatgcctgaggaagggaggaggggaagcaggaatgggcagaggcagttgttgggctgggatgcagcctgacagcctctgctcacccatgaggaggtccggggccgaaaggaacaagagagttgtctggggttgggcagatgtggtgaactttgatacttctgcttccattagtctttggatatgggttgcacacaagctgatgtgacctggatgagcagtggtcctcagctgaagaagccctggcgaggctgacagctcgaggtcgcccctgatggcacttgcagaaggtgggacaggtccttcctcaaagcagggtttgggtggcgcatctccatgggtcctctggacagactgcttcctacaaaaagcgctcatcagtgtgactgcaccttcacccgcctctgcttcttgggatccgattcggtcttgggaggccccctggggtctgcctccactgttggaagtgaggagtcccaggttttctctctgggctgcaccctcatcctcctgagccaccactgccaaggactctctcctctcatcctgcatgcgcagtcttcactccatttggagaggatattgttcagagacctatctgtctcctagcttcatcaggtatggccactgtgttttggttttcctttctgctcgatggtccagggcaatttccaagaaggtaaggggaaagccatctcacaccataggatccaaactgctctctccccttcttagagaatcaacttctctccactctaggaggacaggaggcactgtgacctgcgctcgctcccgcaccccaccctctgccactccacttcaaaggcacgccatcccttgcaacacacagtcccaacaatctgtgtggctggtgccctctggccttaccccctctcctggatgatcctgacttctcgtcactccattcctggggcacacacattatggtgagcataacttgcaggctccctccatctccacctcgctgtagacatacctgaactccatcctgtcttggccttagctgcatcaggcttctgagatcccagacttggcatttccccactggtcagcactgcctgcatctccagcctgtccttcacctccctgatcagcgttctcagatccaggtgtccttccctccctgattgacccagttcatcccactgttgttgctacacttgagccctcataacttttcagctacttcatgaaattctagcacttggacattaaaatgggacttacatgtcctctaggtcaacttgtatttgtgggaaacagcctccagctttctgtgtggtgaagcaaggggcccgggcgtgcgtggcctaggcctgggtgtgtggtcatgttttctctagctggaggatgctcctccagctgtctcttggctgaggggcttgcagagtggacaggagcgaggtatagaggagagctttgagcatataaagaagttcttttgggttgagttctctagatggggtttaggggaggaaaaagaatccccagtcaacagaattaatttgggactatcctctttgaagaaagggagttagtatagagtggggaaaacatttgccttggagttggattgacttgggttcaaatatgagctccaacatgtgctggctgtgtgacctcagagtcattgcttaaaggacctcatttattgtacctgtaaagtggttagtgacaggatctccccatatgtggtcatgcaatttaaaggatatgtgaaaagcttggcaagtgtttagttaggttaagccatgctcactgctgtagtaagccaactccaaaaccttaaccatggttaagaaataaacctcaaccgtggtttatttctcattagggcaaggtcccaggcagtgctcctccctgccatgacagaggtcgaggggctcacatcctgtgactctgccctctcagcaggcggcctctgtagtggctgccatgtggagagtggctaccaggtggtgaccgaagagacacaccagcttggagctttgcttggagccagtttcatggccccattgaaatgcatgggaggccaggaaacatgagggagactgacgggctgactcacgtatcttagttctttactccacaaacatgacaacattttgcattttcctttgaatgagaaccccataacaattcctttagcaaatcccatggtggcctcagatgtcctattagaaaagggggttcacacttccacactcaggtctggattgggaccaggaatgtgatggagaggctggcagtaaggacattttaaaaaaagatgtctaaatttctcagaaggagaagggaaaccagaaaaagatgggagaaatttaaaactctgggggattgaacctggagtggtggtgaatgtactttccttactgctggaatgttcctttgaatccatgcaaaatgaaaatcccctccaccacagcccagatggatggacccctgtccaggaacagagcatgcttgacttcgctggacagtgcctgttgtaggcgaaatctgtcttctagtgccttgcatctgttggtcctgcttctccttccagctgctccataagcccagcctctgacaacgactcagatatgttaggcaaatgctcgggtcccctcaaccttttcttctctgcgcaaaacagcccttaacactgcaaccactcctgggaggatagaattttgaggtgctggcaagacacagggagagagccctcactagcccaacatcgctggcttcatgagtctgcagagcttaacacttggctgcccctgtggggacaaaagaaaggcccccaggagagcttggttactagaatcaatgcaaatggcaggagacaggttgccttctaggccaaaggtaaatcagacatgactttaataaagctaaataaataatgcgagcagaggaagggcgacttggggatagacaacccacaaaatggggagtccgagagatggatgttgacggtgtctgcccagcactgtccgggggacatggaatttgagtgttgtgagcatccaggatgctggagcgctgatgtctcgggcagggagagtcatcaggccatatcatagcgttggggagatgccctccaatattagcacctgccatggaccaaattccatgttcacaggcaatgtttagtttaacaattttacgtaccagttctctgatcctgggaaagacagtgttctggtgggaaggtcattctggtggttggagtgggaacgaatccactggaccctggttcatctatcagtctattgcgggcaggaaccattctctgctagaacgattccccagggaggctgtgcaccactgacagttgccactgttatctattttccattcttccctgttagtagaatccacatgccagctaaaatactcaccctccagaccctcctgaagctcaggggagctgtgtgccacagttctggccaatgcaacgtgggcggaagtttatagggagtgtatcctttttcacgataacaaaggtaaagccctgctggagaaaacctttttgcccttcccatttctttctacctagaacatgattgtgaggcttggaagtgcagcggcgattttgtgacaatgaagacaaaagctacactcaaggatatcagaggaaggagagagagaggggctgtggctccttggtgacatccatgagaagctgccccagcccccacttgccttgttctggacattgtagaaaataagctcctgtctgtttaagccagagttggtggtggtcttcactgatgcaggtgctaagcagagtttctgggctagcagagctgagacaggaccctacaatgtagtcagtgcacaaggtgatgcgtctgcgaggtccttggtggtcttccccttggatacttctcagtgtttttctggtcataaatataactcacatacttagtgaaaattcagatgaatcagtgaattttaaagaataaagaaaaaaacttccttaagcctaccacccagagataaccactgtttacacagtggtgaatatcctcagagatatctgtgggtctagtcgatataggtaatgcatttttaaaaacatatataggattgcattttgaaacttgctattcactcagcagtgttttgtgaacctctttctagtgattttgttaagaaaatcccttctgaatgttgtctgattgaaaaaatatctccattattaatgttagctcttttcacacttaaatactattatttaatctattatactgtaatttagccgatctatcctcagtgggtattgaatttctggtattatgtgtagagctgccgtgcagggtcttgggagaatgtctttgagaacctcctgatcgcctcccgaggaacatctctgggagtgggtttgctggctcagagggatgcaagcatgagggtctctcactccctggcctgagctgcttcctgctgtgaggtccccgctcctgcactgtgggatgtttctggagatggtctcagctttgctgacttcttctacatgtctgtgctctctggttcaaaacgacccgagacagctcatcagtagttcaatcactgccgttgccctgacacatgccccatgacagctattctaattcctatcccacttcttaagcccccagtcctacctttctggaaccactctcagggagatttccttctttgaagatccaaattaggctaaatttgagctcagtgtataaggcactctgcaaaaggtttcgctttccaagaaaagcactagtcagaatggattttctttacaaaatccttttattttccaatagaaagggccctgagtgggtgccgagacatcgcctccagtgcgttcagccacccttttgcagggtgctctctgtacagtgaacttgtttgtacccagctctccatgtcctcctcctccccaacttagggggagggtcggtcatccacagggactctgtggctgtaacccagtcccgcttttctcctccaaggtgagctgcaccccttcttttcgcccaagttgattgacagcaatcacaatggatctcagtgtccctgtcctcattaggggaattgccaagctggctccctctgtcttgtaacagagataccgtacagtagccagcactcaacgttttctaatgaaacaatgtaagacatgaggctgaagaacattctgtgcccattgtattcatttgttacattaacaaaatgcattaagtatctcgtgggatcaggctctcctaggccttggagtactggtctatttagtgatggttttcgaagtccacacattcacaggtggaggaagtgttgtaattagcaaatgggcagcggccatcccccagcctgccacttctgcagggtggctcaagtgtccctggcaggtcaaccctttcttcctttcctcctggataagaggaaagggagattggattccaaatcttcccacatcctctggttcatggcgctttgtccctttagatatgttaattattcagcttctcgagtaacgaagaagctcccttcatgagtgccccccttaccatgagaagcttgccctgggctccatcccagttctcaccagatttcctgacagacacacaaccctctccgcttctcacacgtgcgctctttcatgcacagcctggctcagctcctgcactgtcttgaaaacacaccactgaccgcccccctggacctggaatctgtgttctctccaggcttcgacgtcttccactgccacctcctccagcttcacgagagcagtcagtggccgcctgacttgcaagctgacttccattcccttcctcttctctgcaccgaccattcttccaggtcgcctttgttggcttcttgtttctcctcctgtaaagggctgatggcccccaaggtttcctctgcgccttgagctcgttcctgtctacatctagtttgaagagctcaggcacgtgcacaacttcctaagacatatgtaggaggatagctcccaggcccttgtgtgtggcagggtgtgtgcatgggtgcacgtacgtgtgtgtggcagggtgtgcacatgtctctgtgtgtgtgcacgtgcatatgtgtgtgcacatagcagggtgtgtgtgtgcatgtatggcaggtgtgtgtgcgcatgtgtgtgtgtgtgtgtgtgttgaattttctgatgagtgggagcgatgtaactttcactctctctattccactatactggcctcctcgccagtccaaaaacaaggcgagccttctctcacctctgcccttttttctgcagaaatgctctctctccaggtgtccccatgacgctgtcctcatcccttctggtttctgctccaagggcaccttgtgaaagacttcctgacccatccatataaaatagcgacctcatttgctgagctttaaaatgtttctccatagcccgtaccaccacttgacatctctcaaacacacacacacacacacacaccacacaccacacacacacaccacacacaccacacacacacaccacacacacacacaccacacacaccacacaccacacacacaccacacacacaccacacacaccacacacacgacacacacaccacacacaccacacatacaccacacacaccacacacacaccatacacacacaccacacacacaccacacacaccacacacacaccacacacaccacacacacaccacacacacaccacacacacaccaaacacaccacacacaccacacacacaccacacaccacacacacacaccacacacacacaccacatacaccacacacacaccacacaccacacacacactacacacacacaccacacacacaccacacacacaccacacacacaccacacacaccgcacacacaccgcacacacacaccacacacaccccacacacaccccacacacaccccacacacaccccacacacaccacacacacaccacacacacacaccacacacacacaccacacaccacacacacaccacacacaccacacacacaccacacacaccacacaccacacacacacaacacacacccacacacacaccacacaccacacacacaccacacacaccacacaccacacacacaccacacacacacaccacacacaccacacacaccacacacacaccgcacacacacaccgcacacacacacaccacacacacaccatacacaccacacacacaccacacacaccacacacacacaccacacacacaccacacacacacaccacacacaccacacacaccacacacaccacacacacaccacacacacacacacaccacacacacacaccacacacacaccacacaccacacacacaccacacacacacacacacaccacacacacaccacacacacacacaccccacacgtttatttctttattgtctgtctccacaaacttagaagctcctagtgaaaaaagattttgtctccctggaagtcatacagtaaatatttgttgaataagtgaattctcattaacacctggtaggagcaaatctgttgataaggttattagctgcagaatcccctctactcagtttaagaagaaaaggattgattcggggtttgtagtagatcataggatcttggagcttggaagaaacagactcaagaatgagctttcaagaatgacttcccgtgtgataccgcagaccagccccttgcctctgcctcagtcaagagtttctagagcaggaagccccatcagccgccagctccaacagtgcacggcttctgctaccaaccacaatgggacctctgcactttccctcttccccacataactcaggtctaaatctaagtgtcatgggcccatatgtggttagtggaacctaaatcccatgtccattccctaacaataactgagactcaaaaatgtgggctcctccccaccctccagtgttaggaaggcaatgttcacttggggaagaggtgttcaaaagatttggggggctgagcgtgatggttcacgcctataatcccagcactttgggaggctgaggcagctggatcacttgaggccaggagtttgagaccagcctggtcaacacggtgaaaccccatctctactgaaaacacaaaaattagccgggcatggtggtgcacacccatagtcccagctactcgggaggctgagctgggaggcttgcttgagctcaggaggcagaggttgtagtaagccaagatcatgccactacacttcagcctgggtgacagagtgagaccctgtctccaaaaaaaaaaaaaaaaaaagattttgggaaggctggaggcatggtggctcatgcctgtaatcctaccaccttgggaggctgatgccagaggatcacttgagcccaggagttcaagaccagcctgggaaacatagtgaaaccctgtgtctacaaaaaataaattagctgggtgtggtggcacctccctctactcccagctacttgggaggctgaggtgggaggattgcttgagcccaggaagtcaagactgcagtgagctgtgactgcaccattgcattccaacctgagtgacagagagagaccctgtcacaaaaaaagacaaaagattttggggagccatgaatgacagatgccaattatatatactttcctaggttttccattctgatgggattaaatgtttctgtcactgtaattttaattttctattagctttcctttcttgtatgttctgttaatgcttagtcagtttttttttttttaaatagaaacgaggtctcactatgttgcccaggatggtcttgaactcctgagctcaagtgattctcttgctttggcctcccaaagtgctaggataacaggtatgagctatggtggccggccattaatacttactcacttttagacattgcaaatgcctttttctaatcaggcttccatatgttagttttgtctatggtattctttattgattgattgattgagacaggatcttgctatgtcactcaggctggagcacagtggcacaaacatggctcactgacacttcaacttcctgggctccagtgatcctcccagactctccagtagttgggaccacaggcatgtgccaccatgcccagctaatttttgtatttttggtagagacggggttttgcagtgttgcccaggttgtctcaaactcctgagctcaagcaatccaaccaccttggccccccaaagtgctgggattataggtgtgaacaactgcacctggccttgtctacggtatcccttaaatagaaattctttttgcccctgaatggtcataataagttaacttttacctatggtgggtcctccagagtgctgagttgtatcaattagattttttaaaaaataaatttgattgtgtatatttaaggcatacaacatgatgttacgagatccatgtagatagtaaaataattactatagtgaagtaaagtaacatatccatcatcttatattagcactttttttttggtaagagtagttacaatatactcatttagcaaaaattcccaatgtgatacactattagtaaccaaagtcctcatgtctggatctttagatttgtccatcctacatatctgctattctgtgtactttgactcacatcttcccatttctttctcccaccttactcctggtaaccactgttttattctctatctctgtgtatttgcctttctttctttttttcttttttaagattccacatataagtttgatccactatatttgtctttctgtatctggcttatttcagttagcataatgtcctccagctctgtctacattgtgtcaaatggcaggatctcctttataaagcctaattaatattccactgtgtatacataccatagtttctttatccatttgtccactgacagacatctaggctgtttctgtatcttggctattgtgaataatgctgcaatgaacttgggagtgcagatatctttatgaggtggtgatctcattttctttgggtatatggccagtaatgggattgctggattataaggtaattttatttttaatttttttgaggagcttctatattgtttactataatggctaaacgagcttatattctcaccagtagtgtacaaggaaggttcccttttctccacaccaacaccaacacttgtaatctctagtctttttggtaatggtcaccttgacagatgtgaggtggtatctcatagtggttttgatttgcatttacctgatcattagtgatgtcgggcatctttcatatatctgctggccatttctatgtcttctttggagaaatgtttattcaggttctttgcccatttttaaagtggattgtttgttgtttttgctgttgagttgtatgcgtttttaaaaggcattttcgatattaactccctattagatacatggtttacaaatatttttctctgatttgttggttgcctttttttttgttgtcgattgtttgctttgctgtgcagaagctttttagtttgatgcggtcccattgatttatttttgcttttgtagcctgagttttggtgtggtatccaaaaagtcattgccagggccaatgtcgaaaactttttcccgcttgttttcttctaggagttttatggtttcaggtcttacctttaagatcttttatccattttgagttgatttttgtgtatggtgtaagacaagagtccagtttcattcttttgcatttggaaatccagttttgaatataaattcttaatttttatatagggaaaacatcaagttttgccttatagtttgtgctttttaggtctttcttatgaaagcttccctgaatccaaccccaggtatcaaatacatgattgtaattttttctattgcctttatagttacatctttcacattgagatctttaattcacctggagcccacctctgcatatgggtgtggtgggaatccaacaccctccaccccctattaaggagctagttttctcagcaatcatttgctacacatgttcttctttctacactgacttgtggtggcttctctgccataaaccaagttcttgtacacacgtgggtctatatccaagttctctattttggtttatgatgccagcactttaccttcttattactatgatttttgggttatcttccttctggtgagatacattcttcttggctcatctgggatctgtggaagggtgagtaaaagcaaatctttctgtccttttcttcggagtccctaagctccacaatagtcaaaatgaaagaaaaataccgggcctctgacagccagttaaaagcgaacagtgcggctgccggacttaaggcatggaggatggccagaagatgaagagggcagagagatgatgggacaggacgaccagctgcagagaggagtaccctctacgctgagagctgcagagaggagtaccctctctgctgagagctgcagagatgaccagtgtgcagagaggagctaccctgtctgctgagagtttcagagacctgcagagacctccgaatgacttgcctgcagacaggagccaccctctccaggcctcctctgctgagagaggaacactcaacggaggacctgcctatagaaaggagctacccactcctctgagctgttctaacactaaataaaactcttcttctttacccatcacttgtctgtgtacctcattcttcctggacacaggacaagaactcgggcaaaggcgccgtggccacagaggtttccagtcagaaaagtcgacaccccagagatcctgtaacatctttaaaaaaattatggtagtaatttgggaacttttattcttccttataaattttagaataaatgtattgcattcctaaaaaaggacagttggagtttgattaggacgacaattgtggtaataattgggtagaattgatactttaatattaagttgtccaatccaacaacacagattattctgtttatttagatccacttttatctcctttattagagggtaaaaatttcctttacagaggactagtatattttttttcaggcattttataggttgtgttgctgttatgaaaggtatcctattttcttatatgtatatatgtcttattttctcctatatattataggtggttaatgtggtatagacaaagtgttattggtctttgtaagttgactttacatccatccagcaaccctgttattagttttaataattagttgaaatttctatgtaaattttcatatagtccacaaataacattttaatctctttcctccttccgacttctacacctcccatttccttttcttgttttataacagtggccctgactctggctctttgttacatagcagcaatgctaacaggcaccttatcttcttgccaatctagatggggatgtttctaaggtttctccattggatgtgatatttgcttggggttttggtatgccgtctttaaaagttgaggtgattctattcaaattctagttttctgaattactctttggctctttgccatgaagggctgcctgtccctcatgcccttggcccacagagcacagccaggcttccgccatgccaccacaggcaactccatgacttacaagctggtggcttacaaacaggatgtcactcctcctgggaagcatcctccaccactgtcctggagggacatagctcagcccaggtggaggagagtggtgatgccctcctgtgacacacagacacctcatgcacacctgtgacctgtggtacacaggcaggaggggtcatggagagaaatgacattggctgtgaaacaaggtgatttggcctcaaagttgggacctgccatgtactagctgtgtgactgtgaacaatttattcaaccactctaaacctcagcttccacatttgtgaaatggggaatctaactgttcttggggaaaccacgtggtagtttgttaaataaaatagccagcaaaaagtattcagcagagtaataactgtccgctattgtatttgtaatccataaacgaatatcattcacacattatgagcagggtaaatgctcttgataagaagttaagcaaaagctatatatagactaagtcgacgtttgttttaaaatttgcataagtaaaagaccgaggagaaatagatcctttatatttgtgttttcgaatttttctgtagtgagcacatgattacctcataaatctctgaaacatgttttatggaaacagaaagcccagtgtgactcagcagtgccaaggctgccaagagagctggcggtggcccggccgcttcagcggaaacagtgcccgcacctggaggtcctgggcctgccaccctgggccctggctggagcccagctacaccagcgctttgtttagctctgggcataggtagccatggagaccctgagtgccacggtggaacaagaatgtggcgagtgtgtgaaggccacaaaatctgcaggacaagagggctgagaaagccaggaggggtgatgtgggatgggaagaagcagggagccccccgcccggtaggcttaggggggtaggggagagggggagaagagagagggacaaatagagacagagaaagagagagagaggtatggagagagagatggagagaggccgggcgtggtggctcacgcctgtaatcccagcactttgggaggcagaggcgggcggatcacgaggtcaggagattgagaccatcctggctaacacggtgaaaccccgtctctactaaaaatacaaaaaattagccggacgtggtggtgggcgcctgcaatcccagctactcagggggctgaggcaggagaatggcgtcaacctgggaggcagagcttgcagtgagccgagatcacgccactgcactccagcctgggtgacagagcgagactccgtctcaaaaaaaaaaaaaaaaaaagagagatggagagagaggaggaggtgaaggagaaggaggaggagggagtcccagcgtgaggaggcgcttctgctgtggccgtctgacctcagggcccacctattgctttcctcgtgcctggccccagcatgttcttctgggcactgccctccccactcagccacaatgttcctacaggtccgtccattgccccatggtccatggtcctgagccctgagatgtctttcttgggagtttgcaaactggcctgggaatagagactctctctcaggctgcagggcctgcagtgtcctcaaaggccatggccctgcaagaggaaaaagatgagaatgaaatcaaccagttcaggcgtgagcgcccggccagctcctcccagaggcaggtccctgcccttctccagggtctggttgttgaacgttccttcactgggctcgactcccaggcatcttgtcaaagttcatctcctttttcttgatcttgttcaagttgaagttttatcacttgcaaccaaaaaggtcctgagtaacacaaaatgaccggtatcagtggtaaagaggagcctgaaggagaggctccaggagagggtggcctgggaaagacattgtaaaggtgtggctcctggggatgggggtggggccccagctgcctgtgctgggtgtgcacatgctctgtctctctgtctctctctgagtctctatctccctccctctgagttttcatctctgtcactctgtctcattttctcagctcagtagagacattggccctcttttccaagctccctattttgccctgtctccttcactctctgctgctgacccgctgctaatatgctctgcctcagcagcctccccaccccgcagcccaactgttcccgcgccatccacgaccattcctgcaggctcagggacaagctgggctttgacacatgcccttgactcctacccccttggtaacatttcccacccccaccctgcagtccagctctccctcctgggtcccgatgtgggcggtggcagtatatctgtgcccaagcttgatgccccctccttccttctgtgtgtcctggattctctgagatctggtgctttaacctctgggatccttcctggatgtgcctcttctttcaaagcctcctaccttggccctgatttagactcctatcatctctcgtatgaagattttctgtctcctgcatgatttctctgtttttgttcctccctaatccaccccccaccccgctgtcatcatggcaagctcacagatctctttgtgccactgccatgcagagagctctgccaaggccccgccagctgtgcagtaaaccccaaggtcgggccctctccaggctcagccaggcaactgcccacctgtcacattttactccaggcaccctggactattacagctcccagcacagaatgcagtgatgtttctcaactgtgtgccttcgatcaagctgtcgccctcggttggaacaccccctccacagttccccaagcctggctcactctgatgcattggacctctgccagacccctcccctcgccataccccagcctgcagggagaggtaacctctgcatttacaccacaatttctagttacttcctcatgaatcagtgcttcccactaagcagcaggggccttgaggttgtggggcctctgatttcacctctttgtagtatagtccagatattcaataaacagggactcaggcctcacggagcaaggaggggacgggccgaggctgcctgggccggacacagagctgcaagggtgagtgcagtgcatgtgcagtgtggctggggagggagctcaagttcgctctgcagaggcttggctgcagcagcagccctttgatccccgagttacagaccttgccctgggccggttcttcctgctctggagctgggggcagggacaatatcacagagtaaggccagtctggactctagaaaagtgtctctaaactgggagactcctccatcccacccagagtccagaagcaggctagggtcccctccatccagaaagaaggtgccctccccgcagcaagctggaaacaccagagtcgactggaattccaggtttactgagggcctgctgtgttccaggtcccagaggtgtaggtcctggaggtgtaaaaatgagccaggggctttcaacccagcgaggcagagaggcaagtgaggccaggggtgagagcagctgggtaagcacagggaagaggccccggtacccgcgagtgctccatggtacagagcctgggttctcactggagagagagacagagtaagtgcaagtgcataaggcaattccctacagcaacagtgagggcagaagacagggctgtgggggctgggtcgccgtggagaaagtctctttgggaagtgacatttgaactggatgcgctgggtttaccttttaaggtcaggagaggcagacgcagaggaatcagaagatgcaaggccctgaggtggaaacaagttttggtgtggctggaaatgaggatgtcataattttgtcaaagtaatgctgcccaggccaggtgccgtggttcacacctgtcaccccaacgccttgggaggccgaggcaggaggatcactgagcccaggagtttgagaccagcctgggcaacatagtgagacccctactctaaaaaaaaaattagccaggcatggtgcacacctgtagtcccagatatttaggaggctgaggtgggagaactgcttgagcccaggagttcaaggctgcaggagtgacctgtgattgcaccactgcactccatcctggaagacagagagagactctgtctctaaaataataatcataataacaaacagctctcaaactcagtgcattatgacaaccagtgttaattactctcatactcacaggtctcagatggctataatttggctgatccaggataggtgtggctggacggccctgccttaggctgtaggtagcctgggtttgacgcaagttcaggtggttgcaccaagtttgtcctggggcacagcagaggctctctggaggaagctcttcttaccctggacttctggagtggaaagaaggagccaggccatgtgggcgcatggagtgcttctgctagttccatcctccaacagccccagggccaaaacacgtcaggtggtcaagtccaacatcaatgagcaggggagtctatacgggaggagtgtgagtatttgctgaataataataacccagactgtcacccgccacctcagagaggagctgtgaggacggagggagtcactgcctggtttgtgcacatgttaaatgcttaccccatgctaactgatacgtggaggatgtagggatgggtcagattctcaaggtcttgataaatcacgttgaaaattttgggagccatggaggcttcaatcagaagggtgacagggtttgatctggatttcagagcaacccctctggaagccgcgttgaggttggtctgatggaggcgagactggggtctcagggtgatgagcagtaagtcatcatggggaaaggaaagatggaacgaattcaggaaatgctgggaaggtgggactcacgggtagatggcagaggggctgtgtggagggaagcaggtgcctaggctctcggttcttggcttgggtcaagggacatgatgatagaccctgggctggggagcacaggaggaagggctggcctgtgcaggggatagaggaggtgataaaccggcttagacatgtggagtgtgaggttctcacaggacgtttaggtagaggtacaggtcttggcgtgtaagagaagaatatggacatgggacatatatttgggagtcaaatcggttaaggggcaggcaggaagtgagccccagttattgaggtttccagggaatgggaaatatgctgggttggcgcaggggaactccagtggcgcatattcacatgtggctgacgtcgccgtgagatagccatcctcatattcttcttctaaactaaagcctgaaattacttgggggtggcaaagcccagcaaaagagcccacccccagcctccatggctaaggcttggccaatgagttgtaagacaagtgatgtctgtgaattccggcaaagcacagtgaaggtagccatacccttctctgtcccctcctccatcctactgcctgacttgtatgagatggctggagctctggcagtcaccgtggactaggaggctgggggctacatcccaggtggaggccgtgaggaggaaggaggctgcgtgccctaggccttcatggggcccctaagccactcaggactgtgtttacagagaaacacgactgtctcttgttgaagccgctgtgaacacatttttctgttccattcagctgaacttggtccacagggagccattttgagtctgccgttcttggtcaagcctcaccccgggggcatttccagcctctgttttctccgcgggattaataagaggcagccgtgcccggtccagtcgccgcgaggtgttgtgcgccacctggtggtcgcgtggcagacagcattcctccaagcgagacagcaccagcggctaaaatgcagctatctgcacctcgaacccagcccatcttttagccaatgacaagccaagtgccccagagtcctgcatggcagtggacgctgacaagaactccaggaattccagattgcatggagcttctcggctcaggtgtgttttcggaatcaactgcgggcagtttccaaggagccagttggcggtccctgcgtctcctcgtccaggtcgtgaacttctgtactaaaggattccatgtgacccctctgctgcagactctggtctcagagcaatagtgagagctggagagaagggagggagatgactcactgctttactgagcaggaaattaacaccaagggagcctaacctggcagcagcctggaaaaattggtttgcggtggtttgagcagtgggcaaagtgggtttatgtgggcgagcttattaacacttccttttgctgactgcgggtacaagcttgaaatggccaacagtgcagcaaatagagaccaagttgcaaaaatgagtcttcatctcactgaagtttgagaaattgcagaggctcgtggagagactcctggtgccaggacacgcaggtctccacccaatctggccactctgtgtgtgacccggggcccgtcctctgtctccaggctccccttgctacatgaggtggccggaacactgcctgggttttgaggccaagggtttgtaggtgttggtgaagagaaggggcccccaggctaggtgaggggacctcagttacctccccctttcccaatcatccttttctgaggccaccttcaattgctaccctatcctaaaaggcctcgaaaagcaacaggctctggtgtcccgacatcttctggtttcctcttctttctgtgaaacaactgagtctcagcttttctcatttgcatccccacctggcagctgaagagccgcaaacaaaataacacctgctttacatgaaggggaagtgacttggggctggagtgagaggtgggcccgggtcataagtccttgtttgttttcttctttccttacactgcttggtgggttcttcgtggtcctccgcaaagagggtttgggaatggcgggtgtctctctcactcggagccagcccctgtctctcttctgcactgttcctgagcctggggtgggtgtctggagcgaatggactggattcctccccagccccagggtctctgtctctggtgaggggcaggtggctgtgtgttgaacaagcctctccctcctctgatccacaaccaaacacatacagggatgtcccgggtaactctgggagtgtccctgtctctggccctgcattctggggtctgtgaactgcaaattgctagatggagggatctgcctaccccaaaggggaatttccagggagagggatctgtccaccccaaggggtgtggccagggatcctcctccaggagatgaaccccacagacatgactttgggtccaagcaccatcaatgccatttcctggggctgcatggctgggaaccagtttgccgaccagtcggagctagatagggagggggcagggccgaagtggaggtctccccctttcctttcactgcctttctacatgcggtgctggtcctggatctgttgtcctgagactctacacttgtcctctccctcctctgccatgtcttgtggggacagacccctgcaagtggtatctcccacacttccaggttccacccatgggaggcctgagcatgagacagagggggctggaccttctctccctttctctccagctgcgacagacaggcccccagggctcccagcttccactggtgacccggctgcagggtctgggaactccacgccctccctctgcccctgcctctctgggcattgctgtctctggagtacccaccctgtttatctcttagttcacccatcctcccagcttccagttccctgaagtccagtgtctccgtgctaagtctcccagcagtccctgattcccaacccgtgtgtcttgctggatcttccttccccaccttaatcaggctggcgcagatcccaccatagttttttgattgtgtttgtgtgtgaaacaggtctgtcaagttcaaccaacatctgacatccagttcagttttgcctctcctcccagctctgctggaccccaggtccaaggctcctaccctggggaggggcaggtctggccgtcccctcctctcttcctctcccacacctgctgatgctcctggggccaggatggaggggagggggcttggaggaaaagtggccccactggcgtggccatttttgcttacatggacccttgggctctgggtggctgatatgcaacactggctcttctgctggatgcaggtgtgtgttcttccgagcatcatggacctggacctgcacagtgccctgatgacctgtcccctgctgtccaccccacagcctctaactgcatagttctcctcgtctgcctggctgccctcttagaagggggtgttactggattcctgtggccaccaccacaaggtgcataaactgggtgactcaaaacaacagaaatgtattctttcatggttctggaggccagaaggtcaaaatcaaggtgttggtagggccacgctccttctgcaacctctaggggagcatgcttccttatccatctggcttctggtagccccaggtgtttcatggtttgtgaaagcatcactgcaatctctgcctctgtctgcatatgggcttcttctttgagtgtgtatgtgtctctctgtgtcttctcttcttcttataaggacactggccattggattagggtccacgctactctagcgtgacctcgtcttaactgatcacatctgcaaagacctgtttccaaataaggtcacagtgataggtaccaagggttagaacttcaatatatctttttggaggacacagttcaacccacaacaggtgcagacacaccttggaaatattgtgggttcactttcagaccccgcaataaagcaaatattgcaataaagtgagttataaaaatccactggttttccagtgcatataaaagttatgtttatattatactgtggcctattaagtgttcaatagcattatgtcaaaaatacaatgtacatactttaaattaaaaaaatctttattgcaaaaaaatgctaacaatcatctgagcgttcagtgagtcatcatctttttcctggtggagggttctgccttggtgttggtggctgctgactgatcagggtggtggttcctgaaggctggggtggctgtggcaatttcttaaaacaagaaaacaatgaattttgccacatcaatggactgtcctttcataatatattgccttgtagcatgcaatgctgtttggtagcattttacccaaggtagaacttctttcaaaattggagtcaattctctcaaaccctgctgctgctttatcaaccaagtttatgtcatattctaatttttttgttgtcgtttcaacaatgtttacagcgtctttaccaggagtatattccatctaaggaaacaggcaggatgtggtggctcatgtctgtaatcccagcctggaatcatcccaggcctaggtggaaggatcacttgaggccaggactttgagaccagcctgggcgacatagtgagaccctgcctatatataaaaaaaaaaaagaaagaaaaagaaccaggcatggtagcattcacttgttctagctattttggaggctgaggtgggaggattacttgaggagcttgaggctgcagtgattcatgattacatcactgcactccagcctgggcaacagagcaagactctgtctcaaaaaagaaaataaaaaagaaagaagaaactgttttctttgctcattcataagaagcaacacctcatccattcaaggtttttttttgtttgttttgttttgagatggagtctcgctttgttgcccaggctggagggcagtggcacaatttcagttcactgcaacctctgcctcctgggttcaagtgatctcctgtctcagcctcctgagtagctgggactaccggcacatgtcaccatgccctgctaatttttgtatttttgtagagaaggggtttcaccatgttggctaggctggtcttgaactactgacctctgatgatccgctcacctcggcctcccaaagttctgggattacaggcttgagccactgcgcctggctgccagtcatgtttagtcatgagattgcagcaactcagtcacctcttcaggctccccttttaattctacttctcttgctattcccaccacatctgcagtgagttcctccattgaagtcttgaacccttcaaaatcattcaggagggttggaatcaatttcttccaaacttctgttaatgttgctattttgacctcttcccattaattacaaatgttcttaatggcatctagaatggtgaatcctttcaggaaggttttcaatttacttagcccagatccatcagaggaatcactatctacgacagctagagccttacaaaatgtatttcctaaataataagacttgaaagttgaaattgctccttgatccatgggctgcagaatggatgttgtattagtgggcatgaaaacaacattaactccttgcatgtctccatcagagctcttgggtgattaggtgcattgtcaatgggcagtgatattttgaaaagaacagtttttttctgagcagtaggtctcaacagtggccttaaaatattcagtaaaccattctgtaaacagatatactgtcatccaggctttgttgtttcatttatagagcacaggtagagtagatatagcgttactcttaaaggctccagaattttcagaatggtaaatgagcattgacttcaacttaaaatcaccagctgcatcagctcctaacaagagagtcagcctgtcctttgaggctttgaagccgggcattgactatgaatgtctctagttatgaaagtcctcgatggcatcttcttccaacagaaggctgtcttatttactttgagaatttgttgtttatgtagccaccttcatcattgatcttggctaggtcttctggataacttgctgcagcttctctttgcactttgatgttatgaagataccttctttccttaaacctcatgagccaatctctgctgggttcagacttttcttctgtagcttcctcaactctcagccttcatagaattgaagagagttcgagccttgctctggattagacattggctcaagggaatgtcgtggctggtttgatcttgtatccaaaccactaaaatttcctccatatcagcaataaggctgtttgctttcttatcattcatgtgtttactggagtagcacttttaatttccttcaagaacttttcctttgcattcaaaacttggctaactggtgcaagagactcagtttttggcccatcttggcttttgacatgcctttcccactaagctaaaccatttctagagcttgacttaaagtgagagatatgcaactcttcctttcacttgaacatttagaggccattgtagtgttattaattggtctaactgcaatgttattgtgcctcgggaattgggaggcccaaggagagggagatagatgtgaaatggtcagtgaagcattcagaacacacacagcattaaccgactgagttcaccgtcttacacgggcatggctcacggtgcttcaaaacaataacagtagtaacatcagatcacagatcactaatcacagatcaccctaacagatataataatagtgaaaaagtttgaaatattgcacaaattaccaaaatatgacccagagacacgaagtgagcacttgcttttggaaaaatggtgctgatagacttgctccatgcagggttgctgcaaaccttcaatttgtaagaaatacaatatatgcaaagcgcaataaagcaaggtgcaataacatgaggcatatctgtatcttcaagaggtccacaggccactttctctggagtttcccgtcatccttgtcactataagaggtgggtgtaggctattcccactgcctggccatctcaggctgcttggctaaccggccaccttcaagcttctggcaataagtaggcaccagtctctaaatccatgtatgtgccaaacttgtggggtccatggcaagctccagataggaagggcctgtgtgtttccacaaccactcaacaggtagccggggtgtggggtcctctcccatgccccttccccaggcaggtgctgcatctctcccagtcattccctgggggcccctcatgtgacttgaagtggtgggaggagagccatggcaccccttctccaagcacacccctgcctcagtgaacccccttcatgctcaaataggctggaggagatggtggttccaggacagctgggccacttcacagcacacctggggctgggggcagctctgtgatgtcacctttagaatggggggttctgagtgcctccttttcactccactgctgagggagggatcctctgccttaaatattatgggatggcccaacatatgacagccgacatgggacagatgagatcaacagcagttcattagtcacatgaactcacagccccagggatggaggatgcgcatgtcacacagggccacacgggcgggtgcacttgtagcagggctgtaggaggcaggctgtggagtgacaagaggatggggtggaccccagttcccatgggaggatgtgattggcctttttgaataatttcacaggctggcaggtaagtaaacctattaggttgacggccaggtggagtccagctggtctgggtgacaggggaactagaggatggggagcctcttctgtggggtgggggcacctctggagaactctaacccctaactgcgggggagcttgcggttaggcctttgaagctccatggtgctcagagatgtcaaggcagcctatgaaattttaggccttaaaatacattgcagtgctatgtgctggatgttttcagctttgggctttagaaaaaactgatagacactgaaaaagtcccattcaatcatctattgcctttttctcattctttttaatgagctaccataacagtgagaattcaggtgtctgctcaggtttgtggtcaaatctaaatctgttcaattacttcttggctgtataaattgttcctgcagtggcctgacctgtcaatcaggacttcctgctaagtcacccactcattaattaaccctcatccctctcccttcccctcccctcccttttccttctccttccctctctccctttctccttcctccttaccttcccttctgctttcctccctcctcctctccgtcccctgcttttaaaaatataacagtgggaggctgaggtgggaagatcacctgaacctgggaagttaaggctgcagtgagctgagattgcatcactgcactcaagcctggacagtgggagtgaggccctgtctcaaaaaatgttgtatctgtctgtctgtctatctatctatctatctatctatctatctatctatctatcatctatctatttacagatttatcgagttataatttacataccttacaattcatccatttagcctgtgcagttcaatggtttctaatatattaacagaggttgtgcaacaatctgaattttagaacatttttaacattccccaaagtaaccctgtacccattggcaattactcccaatttccccccaagtcccctcagccctaagcaatcacgaacctacagaaagtagtaaaaaggtggtaccattttacattctcaccagcatgtatgaaggtttcaatttctctacttctctacattcttttttttttttttttttgagatggagtttcactcttattgctctggctggagtgcaatggcacgatctcggctcactgcaacctccgcttcccgggttcaagcgattctcctgcctcagcctcctgtgtagctgggattacaggcatgcaccaccacgcatagctaattttgtatttttagtagagacgggatttcaccatgttggtcatggctggtcttgaactcctgacctcagttgatctgcccgcctcggcctcccaaagtgctgggattacaggcacgagcccctgcgcatggcctaatttctctacattcttaacaacacttgttattgtcttatctttttcattatagccttcctagtaatgggaaatggcattgctctgtggttttggtttgcatttctctaatgactggtcatgttgagcatcttttcatgtgcttattggcaatttgtttatcttctttggagaaatgtctattcaaatgctttgcccatctttaattgggttgtctttttattattgaggtgtgtgtgtgtgtgtgtgtgtgtgtgtgtgtatggtggacactagactcttaccaggtatataaatttataaatatttgctgccattcttgttgttgtcctttcactttcttgataatgtcctttgaagtgcaaacatttttaatgttgatgaagtcaaatgtatctattttttctttagttgcttgtatttttggtgtaatagtgaagaaatcataccctaattctaggtatttcaatattttttatttttatcttttaagagacagggtctcactctgctacccaagctggagtgcagtggcataattacagtccactgcagcctcgaactcctgaattaagttattctcccacctcagcttcccgaatagctgggactacagacatgtgcctctatgcctggatttaaaaaatattttttagagagggggctcactatgttgcccaggctggtctcaaactcctgggctcaagtgatcatactgccttggcctcccaaagtgctgggattacaggcgtgagccactatgcccagcctacagtttatatcttgatcttgcattctgcaaatagagatagtttacttcttcctttccaatctgaaagcccttatttaattttcttccctaatttccctgaataggacctctgggacaatgttgaatagaagtgataaaagtagatatttttatcttatttctgatcttagcaggaaagcattcagtctttcctcattaagtatgatctcagctgtgtgtgtgtgtgtgtgtgtgtgtgtgtgtgtgtgtgaatttttttggtggattccctttatcaggttgatgaaggtttcttctattcctagtttgttcagtgttttcatcatgacagggtattgaatttacttaatgttttactgaatccattgaaatgatcatgtgggttttgtcctttattctactgatatgatgtattaaattagttgaactttggatgttaaaccaactttgcattcctaggataaatcccagctagtccgggtgtgtaatcctttttatatactgctgaattttgtttgctggtattttgttgaggatttttgtacctatattaataagatctctctctctatatataacatttatatctattataaaatataatacatatattttatagagacagggtctcactctgccacccagggtggagtgcaatggtgcaatcatagctcactgcagcttcaaactcctggcctcaagtgatcctcctcggcctcccaaagtgctgggatataggcatgagccactgtgactggcctcataagagatattgatgtgtagttttcatttcttgtgatgtctttgtctggttttggtgtaggataatactggccccatagaataagttgagaaatactctcttctcttttattttttggaagtgtttgtaaaagattgatcttaattctactttagaatttggtagaattcaccatttgaagccatctggatctgggccttcctttgtgggaaatttaacatgactaattcattctctttacttgttataggtccattcagattttctgtttcttcttgagtcaccttcagtagttgtgtctgttgggaacaggccccccaaaatctggccataagctggccccaaaactggccataaacaaaatgtctgcagcactgtgacatgttcatgatagccataatgcccacgctggaaggttgtgggtttaccagaatgagggcaaggtacacctggcccacccagggcagaaaaccgcttaaaggcattcttaaaccacaaacaatagcatgagagatctgggccttagggacatgctcctgctgcagataacaagccagacccatcccttcctttcccataagggatacctttagttaatcccgtttcccataaggaatacttttagttaatctaatatctatagaaacaaagctaatgactggcttgctgttaatcaatacgtgggtaaactctgtttggggttctcagctctgaaggctatgagatccctgatttcccacttcatacctctatgtttttgtgtgtgtgtctttaattcttctagtaccactgggttagggtctccccgaccgagctggtcttggcagtgtctttctagaaatatgttcatttcttctaagttgtctaatttgctggcatagagtatcgttttataatcatttttatttctgaaaagttggtgcattagttgctaggacctccataacaaagtatcacagattgggtggcttaaacaatagaaatttattttctggccaggtgcagtggttcacgcctgtaatcctagcactttgggaggctgaggtgggcagatcacttgaggtcaggagtttgagaccagcctggccaacatggtgaaatcctgtctctactcaaaaaaaaaaaaacaaaaaaaaacccaaaaattagctgggtgtggtggcacatgcctgtaatcccagctacttgggaggctgaggcaggggaattgcttgaacctggtgtcaggcctctgagcccaagctaagccatcatatccccagtgacctgcacgtatacatccagatggcctgaagcaaatgaagatccacaaaagtgaaaatagccttaactgatgacattccaccattgtgatttgtttctgccccaccgtaattgatcaatgtactttgtaatctcccccacccttaagaaggttctttataatctcccccacccttaagaagtttctttgtaattgtccccacccttgagaatgtactttgtgagatccatccctgcccctaaaacattgctcttaactccacctcctatcccaaaacctataagaaccaatgataatcccaccaccctttgctgactgtcttttcagactcagcccgcctgcacccaggtgaaataaacagccttgttactcacacaaagcctgtttggtggtctcttcacactgacgcatgagacacctgggaggcggaggttggagtgagctgagatcacgccacagcactccaacctgggtgacagagcaagactctgtctcaactaaaaaaaaaagaaagaaatgtattttctcatgattctggagtctagaagtctaagattaagtccttggaaattaatttcttctcaggcctctctccttggcttgtagatgaccatctcctctctgtgaacttcacgctgtgcattgtctatgtcttaatctttttttttttaataaggacaccaattattttggattaggtcctcccaaattacctcacttaccttaattacctctttcaaggtcctgcgtccaaatacagtcacattctgaagaactgggggttaggacttcaatatataagttttgtttttatcgggggagacacatttcatcacataacagtagtaatgtagtaatgtcccctttttcatttctgattttgacagtttgagcctttctctctagctttcatcaatctagctaaagatttgtccattttgttgattttttttcaaagaactaacttttggtattattgatgctctctatttttttctgttctctttatctctgttttaatctttattatttcttttcttctgcttgctttacgctgagtttgctcttctagtgttttaaggtggaaggttagtttagtgatagaaaatttcttcttttttaacatagttatttatagatataaattttcttctaagcactgctttagttgcatcctatactgtgtcttatatattgtgtcttcattttcattcatgtcaaagattttctaatttctcttgggatttcttctttgacccattgttatttagggaatatgttgtttaatttcaacttattgtgaatttctcaaatttctttttgtattgatttcttttatttcatgtggtcagaaaacatatgttatatgattttaaccctcagaaatttattgaggcttcttttgtggcctagaaaatggttgatccaaccaggtgcggtggctcatacctgtaatcctggcactttaggaggccaaggtgggcggatcatgaggtcaggagattgagaccatcctggccaacatggtaaaaccctgtctctattaaaatacaaaaaattagctgggtgtggtggtgcgtgcctgtagtcccagctacttgggaggctgaggcaggggaatcacttgaactcaggaagcagagattgcagtgagccaagatcacactactgcactccagcctggcgacagagtgagactccatctcaaaaaaaccaaccaacaaaaaccaacaaaaccgaaaatggtttatccagagaatgttccatgtgcacttgagaaaaatttgctttcattgggtggggtattctgtggacatttgttaggtctagttagcttataaacagtcttctgtagtcttgttgatctccttcctagttgttctgttctttactgaaaatagggaattgaagtccctaactattatttttacattgtctatttctcttttcaattattttagtttagttttatgtattttagagctctgttattaggtgcatttatgtttatgattattatatttccctgatggattaactccttttgttattgtaaaatgttctttatcttgagtaacatttttgttttaatgtctattttgtctaatactagtatagctactccagctttcttatggtaacttttgtatgatatatcttttcccatcctttgccttttggcctatttataattttgaatctaagattcatctcatatagacaaaatatagttagatcttgcttttgtgtccagtttgataatctctgccttttgattaaattgtttaatgccttaacattgaacattgttattgatatagttggatttatatctgccattttgctatttgttttctgtatgtcttttgtttcctgtattcctcctttattgctttcttttggattaagtgaatattttctaatgtaacactttaattccattaatttttttgtctgtatatttttctttttcttattttttaatttcaatagtttttgggggtacaggtggtttttggttacatgaatacgtttagcagtgatttctgagattttagcacacccatcacccgagcagtgtacactacccaacaggtagtcttttatccctcatcctcctctcaaccttctctcccaagtccccaaagtccatcatatcattcttattcctttgaatcctcatagcttagctaccacttataagtgagaacaaatggcatttggttttccattcctgagttatttcacttagagtaatggcctccagctccttccaggttgctgcaaaagacattatttcattcatttttatggctgagtagtgttccttggtgtagatataccacattttctttatccacttgttggtcgatgcgcacttaggatggttccatttctctgcaattgcaagttgtgttgctataatcatgcatgtgcatatgtttttttcatatagtgacttttttgtttcctttgggtagatacccagtagtgggattgctgaatcaaatggcagttctacttttagttctttaaggaatcttcttactgttttccatagtgattgtactaatttatattctcaccagcagtgtaaaagtgttcctttatcaccacatccatgtgaacatctattgtgttttgactttttaattatggccattcttgtaggagtaaggtggtacctcactgtggctttaatttgcatttccctgatgattagtgacattgagcatattttcatgattgttggctgtttgtatatcttattttgagacatgtctattcatgtcctttgcccactttttgatgggattatttaatttttcttactgatttgtttgagttctcgtagattctgaatagtagtcctttgtcagatgcaccgtttgcaaatattttctcccactctctgggttgtctgtttactctgctgctgactattattattattattttttgctgtacagaagctttttagtttaattaagtcccatttatttatttttgtttttgttgcatttgcttttggggtcttagtcatgaattctttgcttaagccaatgtctagaagagttttcccaatgctatcttctagaatttttattgtttcaggtcttagatttaagtcttcgatccatcttgagttgatttttgaataaggtgagagatggggatccagttttattcttctacatgtagcttgccagttttcctagcaccatttattgaatagggtgtttcttttttcccagtttatgtttttgtatgctttgccaaagatcagttggctataagtatttggctttatttctgggttctctattctgctccattggtatacgtgggtatacctgcctatttttataccagtatcatgctattttggtaactatagccttgcaggataatttgatgttgggtaatgtaatgcctcctgattttttgttgttgttgttgcttagtattgctttggcaatgtgggctcttttttggttccatataaattttagatttgttttttctagttccatgaagaatgatgatggaattttgataggaattgcactgaacctgtagattgctttgggcaatacggtcattttcacaatattgattctttccatccatgagtgtgggatgtgtttccatttttttgtgtcatctatgatttctttaagcagtgttttgtagttttctttgtagaaatctttcactttcttgggtaagtacattcctaagtattttatttttacagctgttataaaagggattgagttcttgatttgattttcagcttggttgttgctgctgtatagcagtgctactgatttgtgtacattgattttgtaatttgagacttcactgaatttgtttatcagatctaggaggtttttggatgagtctttagggttttctaggtacatgatcatatcattggtgaacagcgacaatttgacttcctattttccaatttggatcccctttattttttctcttgtctgattgctctggcgaggacttttagtactatgttaaatagaagtggtgaaagtgggcatacttgtcttattccatttatcgggggaatgctttcaacttttccccattcagtatggtgttgactgtgggtttgtcatatacggcttttattactttgaggtaagtcccttttatgcctattttgttaatggtttttatcataaagcaatgccggattttataaaattattttctgcatctattgagatgatcagatgatttttgtttttaattctgtttatgtgagagatcacatttattgacttgagtatgctaaacattccctgcatccttgggatgaaacccatttgatcatggtggattatctttttgatatgctgttggatttggttagctagtatttttgttgaggatttttgcctctatgttcatcagggatattggtctgtagttttctttttttgttatgtcctttcctggttttggtattcgggtgatactggcttcatagaatgatttagggaggattccctctttctgtatcttttgaaaagtttctgtaggattggtactgattcttctttgaatgtctgatagaattcagctgtgaatccatctagtcctgaacttttgttgttgttggaaattttttttattactgttgaaatctcactacttgttattggtccgatcagggtttatatttcttcctgatttattctaggagagttgtatgttcccaggaatttatctatttcctctagattctctagtttgtgtgtgtaaagctattcatagtagccttgaatgatttttgtatttctgtggtattggttgtaatatctccagtttcatttctaattgagcttatttggatagtctctcttcttttcttggttaatctcatttatctgtatttttttttttagttattttcttagtggttgctctaggccttaccatacacattttaacttatcagaatctgcttcagattatactaacttaattccaacgagttatagaaatgctgcttttgtatagctctatattctgttctccttttgtgtcattattgttatacatattatatctatatatgttgcaaacccaaaataacatagttataactattactttatggaattctgtaccttttaaagaagctgagagaagaaaggaaagcaagtatgtatttatagattttgttatattaaccttcttatttatcatttttggctctttttattgtacctgtggattcaagttaccatcagctgatatttccttattccagtgcagctttgctcccacctactggttttgtgctattattgtaaaataaatacatttctatatgtgtagacccaacaatacaattttaaacacatacacacacacacacacacacacacacacacagagcccacaattgcttttaaaattagttaagtaaagaaagaagaagaaatatgcatttacactattgtttttataattacaaaattatctacattggtgctctttaaattttgtttgtgggtttaagttactgtctaggccatttgctttcagcctaaagaatttattttgctattttttgtgaggtggcatgccagcaaggaattctcttagtttttgtttatctaagaatggttttattttactttcatttttaaaaaaacaatattgctggatataagattcttgcttgacagttttttttctttcagcactttaaatatgttatctcagtgcctctggcctccattatttctgatgaaaagtcaattgttaatctcattggggttcccttgtatgtgactagtatttttctctcggtgatttcaatattttctttatgtctttggctttcaacatttttaagatgatgtgtctgggttaaatctgtttttgtttctcctaattgaagcttgttgagcttcttgaacatgtggattaatgttttccatcatatttgggaagttttcaggcattatttcttagatttttttttctgttttcttctctctcttcctccttcagttactcccattttgcatatttggtacacttaataatgtcacacatttctctgaggctctgttcatttttctttctgctttttttctctctgcttttcaaattgcataatctttattgatctgtattcaagtttgctgattttttcttcttccagttcaaatccactactcagctcctctagcaaattcttcattttagttattatatttctcaactccagaatttccatttggttcttttaaaaaatactttctgtttttatattaatattctctatttgagtggacattgtcataaccttattcacttctttaagcatagtttcctttagtactttgaccatatttataacagctgctttgatgtctctgttaattcccccatctgggccctctcacagagtttttgttgccgggtttttttattctgtgggttatacttttctgtttctttgcatgtctcataatgctttgttgttaaaagctgatcattttagataacatattttagataatatattggagcaactctggatactgatgctgccctcccctccacgtactccttactcctggccaaggcttcttgttgtttttggcttatttgtttagtgactttgcttgactattttgtgaagtgtatttccccataatgtgaagcctctgatttcactcctcagagggcacagccttaggtacatgtacagtcagtcatctggggtgacagaagttttaaccggcctctctttaattttctcatttcctgatctctttgctaagccatcagtctctgttggcatcacacccagctgtcagggtacactaattactggctgattttctattgtttttctacaatgcctggagtatgcaatgcttcacagtatgatccagataaatttgggtccctttgtaggattgttttgagtccagtctttggggtttgttcagacagtggaaggactcttcttagctatttgttttgttttctctggtaaactggctggcatatagtttatcccattatctttattgtttaccaccaaaatctccattgtttttgcgagttcccttatgcttgaacttctctacatcctgttttaaatcaagttagtttcttggggggtcgggggagagcttcagtgctctctgttcttatgatctacctcttcctttgggcaaaatctttgagtcactgctcaagacctgggggtaggggctgtggctggcttctctcagagccctcctgctttacagagcagggctctgcgtggtggcagtagcctcttgtcttctcaggttgctgttgtagcatggaacctctgatccaaacgcaattggggcttcagtaatttcagcctgcatcacctggggtagtctccacctatgagtggggactgggtggaggagagaagcttccattctctcagctgcactcatctacaatttagcctgtgcaaaatgggggctgaggaattctggtggcctgcctcttctggggagccattgtattgcttgactgggagctggatggagagggagctgtgttttcctggctaagtccatgaagagtggagcttctgttaagtgagttggggggatggaggagagaggaagtgagtcatggctcaagtgtcatagattctcattgttcttattgggaacaatttccagagactttaaatgcttaaaaatcatttaactagatataagtgttttgctggggagcaggtctgcagagctcctcatacaatcattctggaagtggtctctgcttttttctcttccttcttttttctttcttccctttctttttctttctgtgtgtagtttctgttttgttttgttaacctatggatcaacagcagaagatgtcagatgtaagaaatgatggtaggacgtgggatgctattagtaggtatatcagctaatgttgaagacactactcttaaatcaaggaaaatatgatcagaataataaatttttaaagtatagtgaacaaattcttcagtaaggctgaaggttaaaagtaaaaagtttcaaagcaatacttttcttggctcttctttataataatttattgtctagtgagctactaaccctttttctttatgacttgattgcccccgtatgctaaaatacttgctgttttacttttcctttcattgacatttacaatcctttgtcttttagtagtttcacaagctttgaaacaatgtttagataattttaaaaaataaaaataaaacaatgctaagggtacaatcattgatgttttaaatatatcagctgctataaggcactttgtccaattttcataataattttgtcttaatggtgttaagagcaaagatttaagatttactttcttagtgccataaaaataagagctattcagctgggtttctgaaatattaagtgcaatgcaaaagtttgtttgcctaatatccctggacaccaggcttcccaaaatatcctgccccagaccatagccacatcttcccactagattcctgggcaactagaaacaatggtaaaggaaaacaaggtcacacaattttttttgagatggagtcttgctctgtcacccaggctggactgcagtggcgcgatgtcggctcactgcaagctcagcctccctgattcacaccattctcctgcctcagcctcatgagttgctgggactacaggcgcccgccaccacgcccagctaattttcttttctatttttcgtggagatggggtttcaccatgttagccaggatggtcttgatctccgacctcgtgatccacccgcctcggcctcccaaagtgctgggataacaggcgtgagacactgtgctcggctaaggtcacactaattgttagctgggagtggaccccaaacctgttgaaagaacccatcagctttcctttaagaaggtaatgccacagaccacaacagataattgagggttattctgtgagcttccactaaagctaaaacatgtgtggaagggacagaagagaggataacaggtttgctggcctgtttaccacttggggacgtttggatggatgatgaagaagaaaaagaatcaaaaggactggggctcatcacaggtgggaatagtataatattagctcttcattcagaaccatggtagcaaaaagagagaaaactgcatctgtggactgaattattcccctcagccctctaccccagtgtgtcttctttttgggaatagagtagaaagccaggaaaatggtggggatctaggaggaagcaggcatctcctctgacttgcacgtccccctgtttcactgtcctttgttaactcactgtgtttgacagccacatctgtggtcagccaggggtgcagctgctcctactggtagctaatggccatagaacaccaggggcgtcttaaagccccttctgtgatccgcaccactgctcctgggtatactcccagggtctgttatatgggtaacatgcacctcgcagcaagatctcctgaaatgggttaggacaggaatattaggtaattgcaaacccatacttcccaccattcttgtcttcaattatggccaattacatagttacggcagccttgtattgttacaatacaatcttcctctatgcttaggaacctctatggagatggttgtgttacttcaaccaaagacaagaagagactaatctgcagaattagaacaattccctagttcttcaacaaatcagtgctgcttttcttgccaataatagacgtgtttgtatttctccgtggaaacccttggggtaaacatgttgcttgttcttccaataaagaattgaaccaccagagggcctcaggcgactcaggaggtttgggaagagacaaaggcacatgcttagagggtctggagaaggcgaggaagaaggaagggagccaagtaaaacatgtgactgaccaggggctttggagaagacaagccctgcaggaaggcacgcatgtggtcattctgtctgtagcctcccattcctccctgctttccccagctgcatctacctggatcctgaatttgaaccaagtggtccaaacggcccggtcacctgagcaacccctctgcaggaaccgcaggtgtgggcggggtggtggggaggaggcgggggggtgggggaaaggcggggggtggggggagctcagcggcgccatctagcgtccagacagcggtggctctgggaaagctgattgttttcttagccagaggaggaagagaaggttggtcctcagcgcctggacgcctggtagacgataggggatgacatgatgagtaaaataaggacaggaacacgccgaatcccctttcataatgataggaccacgccaaatcccctttctttttaaaatttgacatatacccttgaatatatatgtattcttataaaatatggttatctggtatgtatttatgtatattgatataaagctgcagatttaaaaatagtacttctttcatctctctccatctacatagtcttcgtggttttcagtaaaatgataatttctggattacttagatgtagttattatgatccaacccttgaataaggggagttgagagttggtgaaacatccctgtctcaatatttgttcatgccatatttcctttgaaagaatttacagataaaggcatcaaatacctgaaaaagtaacaagtttactatattttacttgagaatttgtatatatatttttaagaaagctttttagttttggcgtaattataaactcacaagaggtagcaaaaagagtacggagttctgtgaaccttcaactggatttctctaatggtgacatcttgcaatggactgagtatgtctccctcaaattcatgtgttgaaatcttaatctccatagtggtagcattaggagatggggcctttggaaggtgattaggtcacaagggcagtgccctcacaaatgagattaatgcccttataaaaaaaaaaaaagaccgcagaaaactctcttgtcccttccaccatgtgaggacgcagtgggaagatggccagtccatgcaccaggaagcaggccctccccagacactgaagctgccagggccttgatcttggacttccagcctccagaactgtgagaaattaacttatgttgtttataggccacctagctacgtgtttggttataacaccctcaatggactaagacacagataactggagtacaatgtcaaaaccagaaaatccacataggtacacactactattaactaggctacagaagttattcggtgttcactgcttttaaacctgcattcatctctctctctctctgtctctctctctgtctctctctgtgtgtgtggttttgtgtgtgcatacagttctatgcaagtttatgtcaggtgtttttgtcaggtgtggatttgtgtaagcagcgcctcagtcaagatgcagaactgctccaacaccacaaaagaactccctcttgctacctctttttattaacatccatgccaccaccccaatccatccccatcccctggaaatccctaaccttttctccatctctgttgttttcttattttgggaatgctatccgagtgaaatcatactgcatgtgacatttggagtttggctttctccgccactaagcatatgcttagcgatgtctgtgctggttgttgcatatatcaatcgttcattccttttcatgactgaatagtattttattgtgacagagttcgttaaaccatttatccactgagagacatctgggctgtttcctatgctgttataagtaaagctactatgaacattagcgtacaggcttttgtttgaatgtaagttttcatccctctgggataagtgcccagaaatgtcattgcagggtaatacggtaagtgagtgtttagttttataagctaacaaagtatgttttcatttacatcagcaatgtgtaagagattcagtttctctgcaacctctccagcatttggtattatcaccatttttaaatttaactttcctaatttgtgtgtagagacatctcaatgtggctttaatttggatttccccaatggctgtttgtgtgtgtgtgcgtgtgcgtgtgtgtgtgagagtgtgtgtgcatgtgtgtgtgtgcgtgtgtgtgtgtgcacgtgtgtgcgtgcgtgcttgtgtgtgtgcatgtgtgtgtggggtcagctgatggctcaagctgttagattcttcagggtctatcttagcttttgagtgaggctctgctcttctctgggtggtccccagtcaatgactgagccgagtggcagttcaaagtctggaccatctctaccccctacaggattccttcctcaggccatcttagttctggcctcttttccttttctttcccaggtgttagctccacaataaatctaactccatttcagcatctcagtgtctgcttccttgagaacccaacaagtacagcatgtttcttggtacttcatggtgtacattcagtccatttgactcatccattcctccaaggatggatactgaatttgcctccaactcccactgccatgacaaatgctatgacgaacatccttgttctcatcccttcatagtcctgggggagaatttctttcaattaggtataatttgtagtgggctttctgagtcataggatgtatgtatgttcaatttcaccaagtacatgcaggctatgttacagagaggcttcatcagtccacatttccaaaggcacaaaacccaccttagacccatgtttgtgtttctgaaagccctgcttatatttggcactagataattttctaattttgataatctcttgatatatttgttattaatttgttttttctatgaattacttgcttctatactttgccatttatagaatgggtttctgacttttacttacagatttgcagaagtttcctatatattctaattatgaattctttgtcagtttgagatgttgaaagtatcttctccctctcaactttgactatggattcctttgttgaatagaaacctgtaatattaatgaaatcaaatctacatatttttttaccttgtggtttatgatttttaggtcttgtttaagaaaatttccacctttaggtcacaaatattttcctacatttttagtttcactgtttatgtatagattcttactcttgctgaagttcattgtatattatatcaggtaaggatgcagttttatttttctccatattatgggagcttttccccactataacctactaaacagtcagttttttcctgtttcttcgtaattcccttatattcatgagtctctgagctctttttggttctgttggtctgttggtctactcttgagccaataccatgattaaaaaaatttccatggctttatagtgtaacttaatatttgatgggaccagtctcacttctttgtccttctttctgaaaaatgatttcaccatttgtgaacccatttttcatatgttttagaataaattcattaacccctaaaaaattctggttgggattttgattgggattggaattataaaaaacatttgaggaggatggatatctttacaatgttaagccatactatcaaagagcacggtttttttatttatttattcatatatttcattacattatggtctcagaacatggtctgtatgctttcaattctttagaatttgagacttcttttaaaatcattatttggtcagtttatgtgaatgttatatgtacacaatatacacatgcattctttggtttgtggagggttatatacaaatatgagtttattaaatgtcttatttagataatctatgtctttgctttttttgtctacttgatctatcagttctgagatttatgtactaaaatcagcaatgttgttggttttcttcttcttgcttgagattatgttgttagatgcatatatgttatgcatgttgtatcttctttgtctattgtttctttcatcaagatatactatacctctttcaagctgatacagaagtagagagaaggatataatgaaccctctcaaatccatcatccagcttcaactactcatggctactcttattttatccatactacacaaactcttccacaccccttctactggattattttgaggtaatggcaaacataatatcatttaaaaagtaaatacactagcatctatctataaaagataaggaattctttttaagcataatcataataccctatcaaacctaaagaattaacaataatttcttaataccatcaaatatccagtgttctaattttccaattgtcttataaatatttctattctctttacttaaattaggatcctaatgagattcataccttagaattagctgatatgcttcttgagtttcttttcatctatagatataacatatctctatctcttttgatatttcctggctatgaattctattttgttatatattaggatggctacatttttgtaattaaattttttaaagattacaaaaacaatatatgagtaaatgttcataaaacattaaaacacatatggaagtgtgttttttgtttatataaatagaattctacaatgtttattattctgtgacttgcctttatcacttaacagcaaatactgaaacatatcctttttaaaatatcacagctttattgatatacaattcacatactatacaatttatagatttattaaatctattgtcacaaccaattttagaatgttttcattacctctaaaagaaactctatatccaattctccccaatcctcccagaccatggcaaccactaatctactttctgcctctatggatttgtatattatgaacacttcaaataagtagaatcatatactacatggtcttttgcatttgtcttctttcatttagctaatgttttcaaggtacatccatgttgtagcatgtatcaatatttcatttttccttattgcagaatgatattccattgtatggatatatgacattttgtttatttaatcatcagttattggatatttgttttgtttcaactttttgactattataaataatgctgctataaacattcatgtacaactttttgtatggacacattttcatatttcttggacacatacctggggtgaaatttctgtattctatagtagtctgtctaaccttttgaagaactgccagactgttttccaaagtagctgcactattttatattcccaccagcaatgtatgaagtttataatttcaccacatcctcaccaacacttgttgttatctgtctttctgattacagccatcctggtggggatgaagtggtatcccattgtggttttgatttgcatttcccttatgactaatgatgttgagcaacttttcatgtgatattggttactatgtatcttccttggagaaatgtctgttcagatcctttgcccatttttaaattgggttacccatatcagatatatgatttgcaagtattttctcccattctgtgggttgtcttttcattttcttaatgatatcctttgaagcacaaaggtttctacattttgatgaagtttattttatcatttttttcttttgttgcttgggcatttgatgttatatctcagaaatcattgcctaaaattggcaaggtcgtgaagatttatgcttacattttattctaagagttttagctgttacatttaggtctttgattcattttgagataatttttatatatgataaatactagggttccggtttcattcttttacatgtgtatatccagttgtcccagcactgtttgttgaaagtctattttgctattgaattgttttggtaatctcatcaaaagtcaactctatatgtgaggttttatttaattaatgtatttattctgagacagggtctcactctgtcacccaggctgcagtgcagtggtgtgatcatggctccactgcagccttgaacttctgggctcaagccattctctgcctcagcctcccaagcagttgagactataggtgtgcacaaccatgcctggctaattaaaaaaaacctttttatttttttttttgaagcgacaagttctctttattttgatcaggttgatctcaaactcctgggctaagcgatcttcctgcttcagcttcctaaagtgttgggaggccaagttgggaggccaggttcctaggagaatgggccctgcagcacacacaagtgcatgatcattctgccagtccctgcctttctaggcctgggaagctggggactggaatgctgttgccactccttgacctcgcctgcaaacacagcagcatcaagggcagaaaggcagtttcagtatccctttcatcttccagatcttgctcaaatgctcctgattggtagaaactaattctatacagagctttagatataaaacaatctgggaaatggagagtttaactttctagttgctgcagaacaggaagatacattaggagggaaatataatagaggttaaggaagtgtccatcatatttcccatgagtccagtgacttgggaaatggctgttctcagtcctggtgagactgtctagaattctgtgtccatttctttccctgaaatgtagagatatagaaaagatttgtattgtgagctaaattgtgaccccctcaaaagatatatttgagtcctaatccccagttcccatgaacgtaaccttatttggaattagagtcttgcagatgtaattgagttaaaatgaggtcctactggagtagggtgggccctaaacccaatgactagtgtccttataaaaggagaaatgcaaagacacagagacacccaggcaagccagccatgtgaagagggagacagagatctgagtgattcctgagctatcctttaaaccatcacctgtatctgtattgcctctcaatgtacagccaggccagcagctacagggaactcagaatattcaggctgtgctctcagttcccccctacctcctacttatttccatacttcctttcttggggacaagtttccatctcagcaggggctcagtgaaggctgtggtgatattgggatgctgggttaggatcatggctggggcaaagacctttttttgatacaaggtctcactctgttgctcaggctggagtgcagtagtacaatcacggctcactgtaacctctgcctcccgggctcaagcaatcctcccacctcagcctcccaagtagctgggactacatgcatgcaccaccaacgcagctaatttttgtattttttgtagagactgggtcttgtcatgttgcctaggctggtctcaaactcctgggctcaagctatctgcatgcctgagcctcctgaagttctgggattacaggcatgagccactgcacctggccttggggcaaatactttgaaacccaactagaaaacctagtccagatcctgcgtgggcagcagcaagtcaatagaacacaggtcattcacagtgacacagagagaggggacaaattccagcctttcctggatctttaggatgtcccttactgtctgtaacttttctgagctcaagtgcacaagctctatgattggtcttagagcttaaacacctgttacaacactactgttaaatgtcaccatcaaactcagctattgacatcctaaactattgctctgggctcagagaagggacaagaaacaagtttttttgtacacgttaagagtatagccaggcatgatagcaagtgcctgtaatcccagctattcgggagactgaggtaggagaatcgcttgaacccggcaggcggaggttgcagtgagccaagatcgcatcattgcactccagcctgggcaatgagagtgagactctgtctaaaaaaaaaccaaaaaaaaaaaaaaaaaaaaaaaagtggtgttttcaaacctggctcctctctcagaatgatctttagagcttcccaaaaacacagtattcaggaccacccttggatattctgatatgactggtgtggcacgaagcagcacaacactgggatccttaagaagcctctctaggtgactctggtgcacagccagggttgacactgctgggatagagaagggcagcaaagaaaacatagaaatggatgctgagaaataagcatcacaaatcaacagagggcaacggggtgagaactaggggcagtaggaacacaggaacaagagtggacaagtgctcttggggatggacagggaaggctcattccaccgaagctggtgggaagcacaggggcttttgaatgttgtggcctggggcttttcctcctagttgtgaaggagccctgttgcagtgtggttggaaggttgtgtggtttttgacaatttcccccttcccaacagggtcgggccacagggagaggagcgaggccttgatgtcacagatctgctttgaggcccagcctttggatgtgcactgctgccagttcttgattattaaatcccattgtggtggaagcattgtctggtaatatccagaaactcctctttcattagaactgggaataagcagggtggccatgggtgaatttcagcctctgatttgtgggtgggagctgaggggccactgagaggctgagcaaatcttcggggtgcatggtcactgtcactagaaagcaacaaggtctatgaccagggtgactggaaaggaggtagattaaataatcccctgaggttttggagcagtgtgcaaggaattggatttagggtagcttccagtctcttttttggggtcctgtttcttggattgtcacctgcaagtggccttatccagctggaccacagttgggtggtcagtctgtgctgcatgtggttcttctaggacagcagacacttcaggaaccacagaatatggggcacttgatgtccctgggatagctcggtgcctctgtgcagaccgctgtccagaatgtccttctcccttcagttgatgttaaagctcaaactctacttcctttttaaagttttctgtgactttccttgaatgaattaggagggactttctccattattcttgagttattctttacgtgactttttcttacagaaaaacaagcttctagaaaccagagactatgtctttcatcttcgtatccccaaaacctacagcaggatctaatccatagccatttagttaagtgttcgttgaatgaatgaaagagttgagtcatcacagacatgtaagttgtgaatgcgtgttcacacattctaatgagtgaggctatgacactgtgaaagaagactctgctgcagggctgagtagtcctgatgcatcgctggaggtcatatttgataataaggctggtgcctttctgaaatgacaagaacaggacatacatataccactctctcctcccacaccacagcagaggtttcgaattcactatggcgttgttatttactgagcctggttgtgaattcggaatcttttgtgacacagccactacaggcagcttaatgatcaaaactaggatgagagaggaaagctgttttccatcaagagcatgttctgttttgctggcaaatatggatattgtggtgaaaggagaacatttttaccttgacagcagaatataaggagtttctaaagtggaaggtaaactggagacactgctccaaggtgtagaaaacttcggaggctggaaccaaagacttttgaaacatgattgcagcttcagcagaggtagagctgcctttactataaaggaaatgagtcatggagtggcagttctgaaccatggcccctctcacttttttgctggtcctcccattgagatgtggggtctatgtcttcttcctttccatttgggtgcaatggtgaccactgaccaatagagtatggcagaaatagtcatgggatttctgaagttaggtcataaaaggcatgcggcttccttcttgtgtgtgagaacacccatcttgaagccctgagcctccatgcaagagtctgattacttgagaccactatgctgtgaggaagccccagccccgtggggagaccacacataggtgcttggtctacagttctagttgagcacagaccagtccagatgccagacatgtaagggaaaaagctgccagacaattgctgcctccagtattagcatccaagatgctatcagcttccgagtcctcccagctgaagccccagacatcatggatcagagagaagccatctccagggtgtcctgtcggaatccttgtcccattgagttcatgagcataataaaatagttgttgttttgtgccactgagttgaggtggcttgttatgtagcaatggataactgtaacgtggaatcagctctcaggcagtgacgggggatcttgtgagttttgcaaaccaatccttggatgctctagcaaataagcatgagggtttagcaggcaaccttttaacatcctgactaagttcttggatcagacatctacacctaatatttttttttttttaacttttaagttcacagtgcatgtgcaggtttgtttcataggtaaacttgcatcatgggggtttgttacacagattatttcatcacccacgtattaagcttagtacccattattatttttcatggtcctgtccctcctcccaccctccactctccaacaggcctcagtgtgtgttgttctcctctatgcgttctcatcatttagctcccacttataagtgagaacataaggtattttggtttcctgtgttagtttgctaaagataatggcctccagctccatctgtatccctgcaaaggacatgatctcattctttttttatggcagactagtattccatggtgtatatatatcacattttcttcatccagtctatcactgatgggtatttaggttgattccatgtctgtcgcccagattggagtgcagtggcgtgatctcggctcactgcaacctccgcctcctgggttcaagcgattctcctgcctcagcctcccaagtagctgggactacaggcacctgccaccacgcctggataatttttatatttttagtagagatggggttttaccatattggccaggctggtctcaaattcctgaccttgtgatctgcccgccttggcccctccaaagtactgggattacaggtgtgagccactgcacctggccaattccatgtcttttctattgtgaatagtgctgcagtgaacataggtgtgcatgtgtctttataatagaatgatttatattcctttgggcatacacccagtaatgagattgctgggtcaaatggtattttgtctttatacacctgatatgttttcatgagatatcaggttcatcctggccttagccattagaaattccaggttatgggatgtagccaccttgaagtggccccaggatggggaatccatgcagtccaaagtagcaggtcaattaccaaatgtatgaccaaaaattatgaatgtctccccctaactgggagaggcacagcaaattaagaggagagattaatgagacaattagtatatatgttctgagaaacagctcgtagttggccaagagtttaggattagtccctcaggaacttacagttgagaaaagcatttagctaatcacgtattttttgtaaaaatgtttactgccaagataacttagggttaagtgtgcaattgctctaatttgcataagcttgaatttggtggtaaatgaaacatttactataactggcatattgatttaatacatatttatttgcttttgagaagcagaacatgctttgaggagaagattatgtgctctcttgctgcaatgcattactattagaaacacagcccaggaaatagctgccacctcagggccatggccgaggtgggtagtgggagcagacggcaggaccagctccttggggctggtatcttagcctggggtttcactctctgctgtcaacacctttaaattcttaataattttgaaacaagggcttgcattatcatttgaggcccacaagctatgtgccggtcctggcgtgcaggggtctgcatcagagtgagctctgggttagatgttagctgaggtctcctcctacattgaagggacagagggaatggttctgcagggagcttaagaggaaaggtttaaaggctcccaaaggtagaggggcaggttgtggagggcttggtccactggcccaactggaggtttaggcagaggccaccagcagtcttgatgaaacaactccaagccccaggacttcttggttgacatcactcttactgagctccaccagctaacagagaccttgtcctatttatgccctatgagtgctggtcagtcactctcagggaaggcccactggctgcctgggccatgccgtccatctccactcagggattcttggggcatccgagttttcagaggtgagccaggctgatcatggagattcctgaactgcctgtcttctgggtctcccactcttgggtcatagttgggacttgggtggggaatacctgctgctctcagttctccctgttgaggagggtcagacaacagggacagtagccctctcacgtgagtgtacgtggtgctcagggagaattcaccacccaggcagagctgaccttccaggcctggggaggctatgtgcttgggaatggcagagtcgcacatggacaatcattgagtgagtccacggggaccaagctctgcctacttgagggttagaccaggcttgcatttttttttaagaggtagggtcttgcaatgttgcccaggctgtaggcttggactcctaggctcaagcaatcctcctgcttcagccttctgagtacttccagtttttattaggaaacagaggatgagcatccgaggacatccccgcctcggtacaggagccctcaggcttccctgtctgtccctccctgtctgtcgctctgggctgtcacccctgtgactgtggacatcttgaggtcggggacttcatcttccttgtctttgtgtcccaggccagttacattctgcttaagggaaggaggaacagtgagaaatgctgaaaagtagaagccggggcctcaggggaggagggggaaagtagtacctgttaggaccattagagatggggcctgggaggaagggaaggggccctgggattcttggggctgctttctcaggggtgaagtcaggtccttctgccatcttgttaggggtggatggtgttgggagatggcactgtggtggccacaggaatggccagaataattatgtggggcaaagtgcaaagactcaacagggcagggaagtgagaatgtgacttgaggcttgtatttctgaggctctcagccgttagtcactcaacaaggactgctgagtgcccgctgaatgcacaacaccaacaaacaactatgaaaaatcacccaggtaaagtaagcaatgcctttggtcttctagctgcccttggtatggtgggtgatgacagtcatacacccacatctcagtgtgtaaaggagcccctgagcctctggtgtcctgcacccccttgaaatgtttatcaaaaccacgcacacccttcctttctgtcttcttggagggagagaaaggctggaatctgttctattgaattgtccagtttgaaaagatccaggaccctgccccacatgacctgactcccctgttcctgcctccctgtcactggttcctggttctgcggctggctgtgggtgactgagctctgagcagggctgggagggacagtgtgagatcccccatctgttcgcttgtctgctttcctctgtcagtggttccccatgatagaaaactccacatccattgtattagctcctgtggctgctataaacacagtaccacaaacttagtggcctcaaacaacaccattgtattctcttaccatctgaggtcttcagggccttgttcctaatggaggctctaggggaaaatctgtttccttgtcttttccagtttctagaggtcgcttacattccttggcttgtggccccttctgtcatcttcacagccggcagtgtggcatcttctctcctctcttctctcctgtctcccgctcacaagggccttgtgattactcaagcccacctggatgatccaggataatttcccatctcaagatccttaccttaatcatgcccacagaattccttcctagtgcatgtaaggtaacagatccacaggtcccagggatcaggatgtggacatcattagtggggggtggagggcattattctatctaccccatccatcctggccagctactatagtaccacacatcagcaattagagtttcatttttctttctctctttccctccctcatttcctcccttcctccctcttgtaaaatttagatttcagttttttgaataggtaatacattctcacgattcaaaaataaaaataacatagcactggggcgagaggctgtggcacctgggtttctgcagttagtgctttcctgggccatgtgccatggccgggacacttggggctccctcagctccagagggagggaggagaccctccttgccccatccccatccccatagcgtctggccaggccactctgctttctccccagcctctatctccctacctggccagcccgtggcccggccctctccatcattccccttctgtccccaaaagcaagcaaacaaaacaacaaaacccctaacaactcaatagaaaggtttccatgaagaaagcctgctcctatccctgttctcatccaccatgcttccctgtcgtctacatggagaccagtctagggaaactcctgtcctttctcatgcaaagttagcatgctgtctgtattattctatgcctcttctcttttcttacttgctatggcctgaagttttgccctatcagcacacagagtatcctcattcgtgtgtttctcttacaatcagctagaattgcactgtgaggttgtgccacagttcattcaattggggttttctacagatgagaatttggttgtttccagactttcgctgttacaaacaatgctgcaatgaatcactttgtacatatgtcgttcctgtgtttacaggtggatcttggggataaaccccctgaggttgggccagtgtgccaatggataaaggcatggtgatcctgctagatctccctgtagcatcttctctatggttgtgccattttgcaagcctgtcactgacactgggaaattcccttgcagcctccccaagagaaagttgtcactctcagatttttttttttttttttttgagacagggtctcactgtgtctgtgttgcccaggctggagtgcagtggcgtgatctcggcttctcagctcaagagatcttcctatctaaccccctctgccccaggactacaggcgtatgctgccctgcctggctaattttttttgtattttttaggagagatggggtttagcgtgttgctcaggctggtcttgaactcctggactcaagtgatcctcccatcctcccgtctcagcctcccaaagtgctgggattaccagcgtgagccaccgtgcctggccagtctcagattttaaaaaaacaatctgataggtgcaggatttcagcgagcttcctttttgttagtaatggtggcttttctggactgcagtagaccagtgtgaataaagtacatgccatgtgtgtgcatgtccgtgtgagtgcgtgcacgtctgtgtgtgtgcacgtctgtgtgtgtgtgcatgtctgtgtgtgtgtgcacgtctgtgtgtgtgcacgtctgttcgtgtgtttcctacacacatggccctgtgcctccccgcaagaagcagcacacagagcgaggctctgagggtttattgtctgccccagtgaggctcctgggcttcctgggaggaactgggggaggaactgggggctggtcacacaggtctataggtcccattgtagctaaaagggggaggcatcgagcagtccctgtcctcagggatccagcgctggacgtagttggggccgttgtcccgaggccacacgatcacagtgtctctggatgccagggaggggtcctctgggaagaagttgaatggccggagcaggaagcccacggagttcccaggtgtggctgtgttgggaatgtcctctgagtgggggatgtgcaggaagcccaccgtcacccaggccaccaggtcctgcaggagacagggtgggcttcagtgggcagggctgagtactgaccactggaggccactctagcctttggtcattttcagttctgcctggaaacttgctgaattcctctccagcccctttttaaagagatgagcagctctgttgtgacctctgaacttgccgtccacacagcaaggcacagctcctgcgactggggacagatctgggcaaagggtggttgggactccctgatggtgatgaggatggtcctgggctgagctggaaggaggcagggccagcaccgggcagggctggggacagggcagtacctcattttcaatgttctcgttgttgtgaagaaactgctcaaagaccacgggcgggtgccaggggtcgttctggtggtagatgctgctgctgcacagctccgactcccggtacttggtcactgccagggggtacctgccaggcacaggcgaagcagcttggctcagggccctgggctggcccccctcagtcctgcccagggaacagcctcagggtcagaatagaggaagatgattgccttccccaagatgacagatcatctgtcctgggagtcagcaggacgggctgctgttaaccgggttcaggtgacccacaggagtcctccccgcccccctccccaaatgcacagagacacaggcccagaacagcaggcaacccttgcacaacacaggtgtgagctgcatgggtcctctttctctctctttccttccttcttttcttttctttttctttttttttgatggagttttgctctgtcacccaggctggagtgcagtgatgcgatcttggctcactgcaacctctgcctcccaggttcaagtgattctcctgcctcagcctcccgagtagctgggattacaggcgcccacgaccacacccggctaacttttgtatctttagtagagacagggtttcgctgtgttggccaggctggtctcgaactcctgacctcaggtgatctgcccaccttggcctcccaaagtgctgggattacaggcgtgagctcctgcgcccagcacacaagtccactttcatttggagtttcttccgcctctgccaccgtgagacagcaagaccagcccctcctcctcctcttcctcagcccacttaaagtgaaggagacgaggataaagacctttgggatgagccactcccacttaatggattgtagatatattttcttttccttaggatttttttttttttttttttgagaactagtcttgctctgttgcccagactggagtgcagtggtgtgatctcggctcactgcaagctccgcctcccgggttcacgccattctcctgcctcagcctcccaagtagctgggactacaggtgcctgccaccatgcccagctaattttttgtgtttttagtagagatgaggtttcaccgtgttagccaggatggtcttgatctcctgacctcgtgatctgtctgcctcagcttcccaaagtgctgggattacaggcgtgagccaccgtgcccggccaggattttattaataacattttcttttctctagcttactttattgtaagaacacagtatctgacacacagaacctacaaaatatgtgttcacggaatgtttctgttagtggtaaggcttccggttaacagtaggctattcgtagttacgttgtgggggagtcatagttacacttggcttctttactgctttggggggttggcacccctaccccccatattgttcagggtcaattgtacacacagatatacacatacgtatatgtgtatatccacatagactaggaaccccatagacacaaacacagacagacacagacacacacactgagggaagccactgaccctcccccaggccccctgggtcttcctcaccttgcccaggtgatggcctgctcctcctgccagcctgggggcagcacctggtcggccatggagtggatctgcaggcggtacgtgcgcttgtggccccaggggttctcctgggggctggtaaagagcaggtacttaggcagcttccttttgaagcggaaggccgcctggcgctcccaggagtactgcgtctgctccagagttggctggaccacgcggtgtcttgggctccaggggttggtgatgttttctagcttcatctgcagtgtctggaagctgttcttggtgcctggaggtatgcagggagaaggagaacgagaatcaagctgccagaactgaaacctcctcattctaccccaggatctccatcctccaccacatccaacagccaactgtcttgaataaccgggatgttgggggatgccctgggcggctgtggtgattccattaccactctgggaagttcctctcaagagctgtgctcatgcccatctgctgtggctgcaatcctagagcaggggcacccatttttctccaggcatgggaggctctgtccagagaggtgactggggctgaggggtaggagccgcccgtgtggtcctggtggccttgttgggtctggcagcattagttattctacccatgccattcttttatggtgatatcatccaggagacaccctgaatattcccagacaatactacactccatctcaaagcgctagacagtgacatttcttaccctcataggcaccgtcccctcccttgccccatgcacagccccagggtcaggacagggtccacactgttgcatccagggcaaccctcggcactgttcgctttcaccatttttcagggacacacaaatttctagctttaggttttacagaagcaggcttggcaaatgctcctaactttccaccaccagggagttatagtgccgtctcctgggagtttaagttattggctggatgcagatgtttgaacgggagagtctcgctttgagtcctacctgccacatccaggtctacgcggtagtgcaccaagtgagtgtgtatgttgccaatcaggtgggtgtgcaggcgagtgccgtggcgcagcccctcgggggtgtagaaggtggcgtggacgtagccagtggcatgcatcttggcctccatcaccccgttggggtagaagataaagtcccaaatgtaatcataattgtagacagttgaagttgtccgcagcaccagcacctggcccttcagccccgcatagaagttgaagccacctttaaagttggaattaaagtgccgccgaaggggcacccctgtgggcatttcaaagaggcagagggctcggggataatggaccgggtcatcggcatcatagtagtggaaagtgtccaggaaggtggcggtctccgggcagtcgatgccgggggctaactcatgagtgacgctgcccaggccccagccgacatcgaggtacttggtctgcatgcctgcaggtgtgtgtcctccatacagcgccactgcctcttgcacgctgacctcataggcaatgcgctctccgccgaagtgcacgttcaggacctgcagcccggaggaggagcgcagccggaaggcaaagctccagccgccgtagagcacagcgttgccctccagcctgaagcgagggccgtggggctggaccaagcgggggccgctcacatggatggggctggggaagtccccgcggggcttgtgggaggagaagaggggcggctcctctgtgctgtcatgccccttgcccccaggcagcgggtcctccaggaccaccacgtccacctctccatctgcatacttccgagccagttcctctgggctcccatagaacttcccgttgtaccacacctgctccacggcccagtgcccagcatctgtgctcccatgatccacgaggagctccagcccagtggggtgcagaaagtagccttctacatagcgctgtatgataagccaactgcggcgctggccagaagccacaccccggggggccacatcggtgaaggccaggcatctgtcatggcagtcttggaatgagaagcctgtggtattgaggaagaactgatgcaggggcttggtggcttcctgcagggtgtggtagaggagggcatactctgctgtggagatgggcctcgatgcccaggaggactggtacccaggcctgggggacagtgctcgcatgtagcagggccctggcaggggccccacagcaaactcggtgacattgggatgctcctggtcaccaaagaagatgacggcacgggcttcccgcacaggatgcctttcacctttatccagaaacctcagcacatggtacttcttgggcagcagcatctcgatgagaaacacggtgttcttggccatggtggtggtactggagggctgcagcctcagctccttcttggaccagaggaagctgtgcactgccttcagctcttggttgcttaggtctgaaaacacccctgccttcctgggcagagtccccggggagggctccgccatggccgtctgcagcatcaggatggcagccacggcccagcccagggccggcatctctcgctccacggctctggaatgcaatagaggagatgaacttagttgtcttatgggcagagatgggcttccctcaggttagggccatggaattttcccatggactgagcttcctccccttgccctgccccaagctggaggctgtcctggggcagctggggccccatgcatagtccccagcgccgtcgggccgctgcctgtgcatccatccatttatttctgccctctcctcactcctctgtaaatgtccttcagtcctgcagccttccttactcaggggaacacccttgtttttgtgtattatctcagccaggggtgccgtgagtcacagaggccaggctgggcccctgcacatgcccccaggtgcttcttgtgtcctggagaagaagacacctgtattaacagcaaaactacatttctgacacaacgaaataccttttaggtagacagattttgaaatttagtgtagaaattcaaaggtaggctctagagtcaggctgtctgagtcaagtcccagtgactcatgccactaggacttgctgtgtggccttgggcacgctgcttaaactctctgggccttcatgttcttagttttaaaatgaaaataatgacaacagtgcttagctcctagggttgtggagagaaatcaattaaacagtaaatataaagtgtttgtaacaatgtctgccatatgggaaatacatgagaaatgttagctgctcttcttgttaaatacaggctatcgacaccagcccatttaaagttttacgcaatgtagagtgattcaggtgtgactaggctgcagactgatggctttgggggtgaggtagaggtgcccagtcctgcctagccttctttgtgccccattcacctctcttgtccacccaaggctactaggaggggacctcagggagggtttcatcttaggaagatgccttttcctttctcagggagggtgggtcagggtcttcacctcataaccccattccccaagcagctgtaaaatcctgtgcttgtagctgtgagcctcctgcagggctgggagacgtggtggccacagctctgtcttcccatgtgctgtgtgcggagtctctgggagactgttactcttgcctgttgcgctgttgctacagatgctggctggagctgtctcccagccttagtttctccagaccctaacttgtcctcctaggtgatgtgggcctccctggaaggctgccgtcaccgtgaaatttccctacagaagcactgcctttgccaccttgcacccccttcctcaaggctctgggttgagctgggagccccgcttcaggattcctccctgtctcagctgtgcttttcacttcctgcaagcagtgcctgaggcacagacacttgatttataaggtggatgcatgagtgggttggactctgagagatccttgttttcatattttcataggtagttgccttttgctccctaaatcagaagccctgggggtaaacctggagaaaactcgttctcctgtgcagacagacaggtagcagagagggttaatccactcctgtctcagacctctgcctggcccagcctcttcccagggggcccaggctgcctgcaagggaggccccgaggatttcacctggaaagtcggcggcacagggtgtgaggtgtaactgaggtgcagcagctccactttgggtgtatcgtggagtgacccactgaggaaacctgaccatcatgagcgcttttcatttcttgcttttgtttttggaaaatgcatttacacatcacatttccgaagcacaagcgttgggaacacaacccatgtgttaactagaggccctgttttcccgtggcttttttcctccagagaagctcagctgcacattgtcccttcccacccgactctgggccagtgtcacatcctttgccaccttttgaggtcagctgaaaccccgcactgccgaggaatgctgtttttggccccaactaacatacttctccactagtccccttagcactttgtatttaatttgtacacgatgggcagttcttgattcatagacaaatgaaaggtgttggctgggcctgttccatcacccgagggctctctagccctggaggccacggtaaaggctgatctgagatgtccttctctccctttcccatgcccctctccccgagggctctccccttgccctcgttttgctccatggtcatggcctctcatggggatgtccctctagttgccttgtcttgccctctggtgctggcagaagaccctggaacccacatgatcttgggctctcggaggccctgcttacctggagggagcaggtgaggcaggggctgcaggcggaacccagagccagcaggaaggatatgaggtgagttcttgtgttctcctattaaatattggccaggcctcttttttttcttctttaaatagactattttttctttttcctgagacagtcttgctctgtagcccaggctggagtgcagtgatgcgatcttggctcactgctacctctgcctcccaggttcaagcaattctcctgcctcagcctctggaatagttgggattacaggtgtgcaccaccatgcccggctaattttttgtttttagtagagatggtgtttcaccgtgttggtcaggctggtcttgaattcctgacctcaagtggtccacctgcctcagcctcccaaagtgctgggattacaggcatgagccaccaggcctggccccaaatagacttcttattagacttaaataaataaataaataaatatatatatatatatatatatatatatatatatatagtcaggatctcactatgttgcccaggctggtcttgaactcctgggctcaagtgatcctcctgcgttggcctcccaaagtgctgggattatagtagactttttttttaatagacttttaaaaatagactttaatagatttcttaatagactttataaagtctgttaaaagtctttaaaaagtctattaaaagtcttttaacaaactttataaagtctattaaagtcttttaaataggagtcttttaaagaggaattttaggttcatagcaaaattgagcgaaaggtactgagagtttctgtatactcacagcccctacacacgcagcctccccactatcaatatccacaccagagccatacatttgtggctgatgaacctgcacatcactctcacccagagcccacagtttacatcaggactcactcttgctgctgcatattctatgggttggacaaacggacaatgacatggatccaccattagaatatcacacagaatagttccacctcccccaaaatcttctgtgctccacctcttcctccgaaaccctagcaatcactgctctttttattgtctccatagttttgccttttccagaacgtcctgtatttggaatcttacagtctgcagccttttcagattggcttcttttgcttggcagtgtgcatttagggtacctccatgtcctttcacggctgggtctccttttttacaacctcttatacccacgtttctttttgcttttccaggaaggagaaagatgtggaagagacctttgctttccccaggacaaacctctgtccccatgtgcagtggcagtgggggtggtggctggtgagacctccaggcaggaacaggaagcaagccctctccctgctcaccctcctctctgagctttccccactccaccctggccggctgttgcctgccaccaagcacccgggcaccttctgtgatgtgctgggctcccgccctcacttcctggccctcctccctctgtgtcctgtttcttctgcccctcactctgtgccctccttccactgcttttctgtcctccaggtcagccccttcttgactctcccgaatacccatcagaacgcacctgtgtgctctgctcccagttcgctctgcttccagcctttgcccttaagctgatctctgactccttcttgaagtcaatcagaccccgccctgcagggagggacaaggtgaggcctgagctggcctaggaggggcctatggcttgggaggtgcctctgtgggcagctacagtggcgagagtgggtttgaggaagctggctgtgcagcacacttgtcctgagtctgtttccagacaagtgccgccttccacaagaatttgccttggcttctctgtgacgagccatgcaatgccacgatctgttaatttaggtggcatattttagaggcagagataaggacaaggggccatttcctagccggtagtcttacctgaagctgacagatggaccagggcaggggctgatagaggctggcacccacagcaaaacagagaattcaaccgctcctagaacaagacaccagaggcagaaccgtttgggaggagcagccactcaagacgagttgcaaactttggcggctttttaacgatctttgagaccctgaccagattcagaaaggaggaaggacttggctgggagaaagctggccagggtagctaaggctatggcacagagcggagaggggagaggacactggggcaggtagtgcccatgcagtgggcggacagtgctaacgcccacttagtcaggttgagaagggcgaacgtggtgaccggggtaactcctagttggaaaggaaagaatagagtcaggaaaagttcgtggctcaggagtgccaaggggtcatcatcccccattaccaaggtttggttgctcagggattgcacaccgctttgtggttataggggttttgtatttctcatcatcatccttcctgctgcccgcaatgcaagccatttcagtgtgcactggcagctagatgaaggaaggtgaacacacttagtcaacttgaagcttgcttgcaattccagaaggtctttggtgtttctgaggaaggggatttgccttccatgttaaaatgatgattgatacaaagacaatgaatgctaacgtctttcaccctcagtgttcaagaggactgtgagttatgtattctcagttatgggctcaccaactccgcagagaattggggggatttggattagaagagagtttcaggaacaacctgattttgaggactacaatctgtttccattccacaaaggaaactgcgacaaagttaatggagtgaggatggatcgagaaaagagacttgcaaagatttaaagggaaaggggccacatgcacatgatggagttagaccctttcacacacggaaacggactcgaaagggaccaaagacatacatgtaagagctaaaactgtaaaactcttaaaaagaaaacataggagtaaatctgcttgactttacatctaattcttggatgtgacctcaaagcacaaataaccaaagaaaaaaaaatagataaattgacatcatcagtattaaaagacttttatgcttcaaaggacacccacaggaaaatgaaaagacaaagcatagaatgggagaaaatattcacagattatatatctgataagaaaattatatctagaatgtaagaagaactcttccaattccataataagaggcaaataatccaattaaaaatgagccaaagatctgaatagatattcccctcacgaagatacacaaatggccaatatgcacatggaaagctgttcaatgtcattagtcatcaggggatgcaaatcaaaaccaccaggagataccactttatatccactaggatggctagaattcaaaagcaaggtaataacaggtggggccaggaggcagagaaactggaagcctcacaggcagttcatggtgagatgacgcagccacttcggaaaactgtctggctgttcctcaaatgacttaacgttgttatcatataacccagcaatcccactcctgggtatatgctcaagagaaaggaaagcctatgtccatggggaaacctgtaccagagtgtttactgcagtgttattcacaatagccaaacagtggagacgactcatatgtctctgcattgataaatgagtcaacaaaatgtggtctatccactcaatggaacatcattcagtcataaaaaggaaggaatcactgttacatgacacaatgtggatgaaccttaaaaccactacggcaaatgaaagaagccagtcacaaaagaccacattattccatttatatgaaacgtgtggggtaggtaaatctctcaagcagatgagaagcacattagtggttgcttagggctggggtgcgatggagggatggggtgagagctaatgcttatggggtttctttttgaggtgattaaaaagttctaaaattgaaggtgatggctgcatgtacctgtgaatgtactaaaatgcattgaattatacactttaaatgggtgaattgtaaggtgtgtctcaataaagctgttttcaaaaagtgacaggactaatatctagaatacacaaggagctcttgcaaatcggtcagaaagaggcagcagtccccatggaaacctggtaaagaatcccaagggtaacttgcagaagaggcaccccaaagggctaaagagcacatggaaagatgctcaaatgtagtggttactagaaaaatgcaaagcattcaacaacgagatataatttttcatgggaaagctggatgatgccaagtgttgacagagatgtggggaaacggggaccttatgtgtggttgtgggaaggggttattgatggcacagccattctggagggcactttgcagggtgtgggcaaatgagagaattgcatgctctccagactcaggaactctgtctcttggaatatatgtcaaagaggttctcacccaggcctagaggtgggatgcagacacaagtggctgtgaggctggggagctggaggccatcggggtgccacccccaggagagtggtcactgcacaccatggggtgttgtgcagttggcgggtgcaaaggcatggatgtccacacagccactcctgagaagggatctcaggatcatggaagacgcaggatgagtgatagcacgatgccattacacaacaggaaacacgtacacaccaagccacccgctttcaagagtggatacacattagaatggatgtgagggcgggggtgggagtgggaatacatacatacacacgtgagaaagacaagagagaggacttgtatgggccagtgatgacgacatccatgcactgaggtagaattaattcagttctgcaatggacgtccataaataaataaaagaaaggcctgggagacagactgagtgactacaggtcctcacaccagggtagatgtggctgaggacaggaaccaccacaggtcccgcacctggaggatgcagtgagggcagggaggaacactgcgtgtaggcagggagctgaagcacaccagaaagaattgcattttttatgtaacggggcccataacatgtacatagaaggattaatattacaaggtggcacagagtaagtgcaacacattgatgcccaagggcctgtcctgcaagggcttggaaggagattcccctcaagactgcaagcccccaagtcctgggactctatcccctctgcagtagcctccatggctgctgtcacagaggaccacacacaggggcttaaagtaacagaaatgggttgtctcacagttctggaggcctaaagtgtgaaatcaaggtgtaggcagggccatgctccctttggaggctcaagaagagggtccttcctctcctcttccagcttctgtgttgccagcaatccttggtgtccctcagtgccttggcttgtggccatgtcactccaatctctgtcctcacatggcgtcctccttgtctcagtacctctattttcaagaacaccagtgattgtattgagggcctaccctactccagtatgacatcatcctaactaattcatctgcaacgaccctatttccaaataagaccatattctgaggttccagggaggacatgaatttttagggggatgctatgcaacccagcacaccttctttacctgcctcattgcagagagcatggtccttggccagtgagtgaattccaagccctgtgccctggggggctgctgccccgaggatccacaaggtagagcctgtgtggggttttgcgatacacgagggacttaggaggaagaggacacactgggcaggggcgggggtgggagtgggagtgtgagtgggggtaggagcagagtcctgaactgagatgtggtgtgtttcccaacatgggaaaaggtcagggctgatgcggggagtggggtgcggtttgtgtcgctgtgctgaggaagggcaggtggtgtgtctggaaggaggaggtagagtgaggaacctccctatgcgcttctagagaagtgtgggggtgaagaggggcttgtgggaatcctatagagacagaggagatagagaagccctctagagaggcactgggaaagctgaggcgaacagaatccttgtgcagaaaagctggtaagtctgttgttatatacatatatatatttgtagagacggggtcatgctgtgttgcccacgctggtcttgaactcctggcctcaagtgatcctcctgccttggcctcccagagtgccgggattacaggcatgagtgaccatgtctggccaaggccattgtttctgctcatgtttgtgtgcactgtggctggggaacttgagatgtcacacttgaaatttggggtctgttgccttgccacctctcttcctgctccctggctggggctggcccctccatactgaaggtgaccttggtttctgaggtgtggttcctcgcttgtggaattaatgattgctgacagttagagatagcacttgggcaaagaccgtatcctgtcagttgttcgctgcttgcctttcttaaggaggtccaggcctaaggaggggcagcgctatatacaaaggtggagctaggaagccagaggtcacagctcaccatgtcctgtggctaaatcttgatattttgctttcagaaagtcacaacctgtcagagctaatttgagaggatctagagagtgggattgtttccacgaaaccacagagaagaaacagagcaacccgcgcctgcaccaggacctactgggggtacaccagggaagctcattcgattagatctttatgtgaatgaagccaacatcatagcttttgtccctgattagggaaggtgggtttgtaaaaaagaaaattccaccattttctgaggcagggccattggtcataaggggccctggtgaggtcctgatggcttgggcagccccacccagagaggggagaacgttcatctccaggtgctagccctgcttctgccactggctggtgggcttatacttgacagtccttaattcattcaacaaatgtttatggagcactcattctgcaccagggagacacagcaacgaacaaacaaaaccaaagcctctatggggctcatattttagtgaagactatccaacagcgaagcttgtgagccttcacagcagacctcctcactgggacagctgatgacaggggctggccctgggctggcatctgggaacttaactttcaggatcctgccccgctgtgccggcctgctgactgtttttacagacaatgtgattagtgaacacctgctttcctattgggaatctggaatcttgttagttgtggtgggcagagagtgtgcctacgtgaccagccccaacctctgccccagctctgagcttctacttccctggggagatgcagggcgcagggtatgctctgtgcagccttcatgggagggagagctcagcgagtctgtgccctgacccctccagaccccgctgtgtccttgctgtgtgttggccgtgggtataactgtctgcttagtctggtgagtcctagtgaagctctgacagcagaggtgccatgaggtgtcacgggtgttcagagaggtgtcctgcaggcgttggcggcaagtggtgacccagtgtgttccagtggggcacatgctcaggggaaaacagagcaggggcatgtggtgggggcagggcctgacctttcagaaaggggactcctcttctcctcaatgtggtgaaggagtgggccacaaggatgcctggtggcgggggcatttcaggctgaaggagcaaggaatgcaaagtccctgatgcagagtgaggggactgctgtcgccaggggcaagtggtggcaggtggattcagagagtgaccaaacgccctcgcctccaaggctgtcactgggattttactctgagccacttgggaagcctctgtcaggttcgtgcagaggccaaaactgacctgcctctagcaagtgctatctggaggtgctgggggagacagaatgcaaaagagtgaaggctgcaatgatggcaggagcagagagcaggccggggggtggttgcaatagtcttggggggcaaggctggttgccaggtcagggttgcaggggtggaagtgatgagaagtggccacattctggatgtagctggaagggaggctgggggagatttgctgagggctgggatatgagactccagagagaagagccaggtgaccccaagttcgggcagaggttctgctctgctggggcagccaggagctgagtcaggatgcttcagtgtgtgagcatggctggctgctggctgagcccacttctggactttgatgctggatcccaaggcacatgaggggcaagggtggagggagccccaaggagacctttgtgaggagtcagagaccagggctgggtcctccaggcgctctttgtatcttcactgaccatgcctggcagtgctggccagctgacagcttccccgtcaaatcccacattcctccctccagctgcagctgtgtctggcagccggggctgggcagtagacacagcagaattcttccttcctcctggctctctttagtagctacctcacgaaatgtgcattggattcttaaagaagaaaaaaatcaagaggccagaaaatcaggaagcagaagttaaaatatgttgctgatctttgaaataaagaatttgtgttggtagacatgtgaccttgtgtggtgcagggatgtatttgtgttaaaccattttggtgactatgacattccaggtgcatattggaggtagcatgtaggacttcagaaatcaccagaacagtcactgcctctgtgcagccctttgctgagcacaattttggaaggaaatatagcagcatggttactggtacaggatatagagccagaaggcctgagtttgaatccaggttctacttcttttagttggatgttatgtgggaaaagcggttaacttttccttttagagacggtgattttctctggtggtatgatttgatttcttgctttttaatttttgtgcatctgttgtatgttttttgatttgagattaccacagggcttgcaaatactcttacaatctattaagttgataacaacttaacactacttgcataaacaagcaaactaaaaagcaaaaagaacactaataaagactttctctttatctttgttcccctactttttgttcttttttttttttgtttgagacagcatctcactctgtatctaggctgaagtgaggtgcatggcgtgatctcagctcactgccacctccgcctctggggctcaagcgatcctcccacttcagcccccaaagtagccgggaccacagatgtgagccaccatgccagttaatttttgtatattttgtagagatggggtttcgccatgtcatccaggctggtcttgaattcctgagctcaagcaatctgcctacctctggcctcccaaagtgcttggattacaggggtgccctgtgggattataggcagaagccaccatgtgaggccttcccccactttttaactcttgatgtttccatttatatcttaccgtactgtctatgttttgaaaagttgttatgatttttgattggttcatattttggtctttctacttaaaagtagtttacacaccacagttacagtgttgtattctgtgtttttctgtgtacttactaatacccgtgagttttgtatctttagataatttcttattgctcattaacatccttttctttctgattgaagtactccctttagcatttttttgtaggacaggtctggtgttgatgaaattcctcagcttttgtttgtctgggaaagtatttctccttcatgtttgaaggatattttcaccagatatataattctagagtaaaagttttttccttcagcaccttaaatatgtcatgccactatctcctggcttgtaagatttccactaaaaagtctgctgccaaatgtattggacctccattgtatgttacttgttttttttttttttttctcttgctgcttttaggatcatttttaaaaaaaatccttgccctttgggagtgtgattattaagtgccttgaagtggtcttctttgggttcaatctgcttggtgttctataaccttcttgtactcagatcttgatacttttctctagttttgggaagttctctgttactatccctttgaataaactgtctaccccatctctttctcaacctcctctttaaggccaacaactcttagatctgcccttttgaggctattttctagatcctgtaggtgtgcttcattaaaaaaaaattttttttgtctcttctggcgatataatttcaaatagcctgtctattctcactaattctttcttctgcttgagcagttctgctattaagagactctgacgcattcttcagtatgtcaattgaaattttcaactccagaatttctgtttgattcttttcaattatttcaatctctgttaaattttctgacaggattctgaattccttctctgtgttatcttgaatttctttgagtatcttcaaaacagctattttgaattctctgtctgaaaggtcagatatctctgtttctccaggttggtccctggtgccttatttagttcatttgatgaggtcttgttttcctggatggctttgatgcttgtggatgttcgtcagtgttcgagcattaaaaagttaggtatttattgccatgtttgcagtctgagtttgtttgagcctgtcctccttgggaacagtttccaggtattcaaaaggacttgggtgctatgatctaagctgtatctgctttagtgggcacccctagcccagtagcaccgtggttcttgcacacttgtagaggtatcacgttggtggtctttgataaggtccagaagaattctccggattaccaagcagagactcttttttcttcccttactttctcccaaacaaatggagtctctctctctgtgttgagctgtctggagccaggggtagagtaacacaagcacccctgtggccaccgccactgggactgtgctgggtcggatatggagtatcagcacaacactgggtcttgcccaaggcctgctgtaaccactacctggctactgcctatttgctcaaggccctagggctctacaatcagcaaaggtggtgacgccagccaggcttacatccttcccttcaggttggtgaggtcccctaggtcctgagtgggtccagggatgccatctggagccatggatgggaatctaaaatcttagaagtctacctgttgttctattctactgcagctgagctggaactcaaaccacaggatgcagtccttctcattcttacatcccattctcacaggcagaggagcctcaccaggcccgtggggagtactgccaggctaccactgatgctcagttaaggaccaaaggaacttcagtcagcttgtggtgaatgttgccaggcataggaactcatccttcaagacaatgggctcccttggcccatggtgtgtccagaaatgttgtctgggagctagggcctggaatgggggcctcacagcctttatcagtgccctaacatactgtggctgagctggtatccaaaatgcgagacaaaatcctctttactcttccctctcctcaagcagaaggaaggggtctcttttggagctgtgtgctgtgctgcctggggttggggaaggagtggtgcaaacacttccttagacaccacagttggtgtctcatgtgccccaccagttcactaactccaagcccagctcagcactaggtcttgcctaggaattgcagtccttgttgcgtagactgctcctcaagttcacttagggtcccaaagcactgcagccaatgggggtgaggcttgctggaactcatgctctgactgctgggctgggtgagtaccctctggccagggctggtccacatgttccctccgtggtgtcagctgagtatagctcagttttgctttccgctgtgacatagcagcactgagttcaatgcaaagcctcacagtcatggcattctccctctctcaagtgtatatacagattctctgtgccatgtagccactgccaggggatgggggaagggtggcatcagcaactcaagactgtccttctcaccctcctcagtgcctctctcaggaatttgaagtcaaaaccaggcactgtgagtgctcacctgatttttggttcctatgaaagtgctccttttgagtagatagttgtcaaacttggtgttcttgtgtaggggtggggatgtttggtggagtcctttattctgccatcttgccctgcccctagggtaaagaagttaattttttggccgggtgccgtggctcacgcctgtaatcccagcactttgggaggccgaggcaggcagatcacgaggtcatgagatcgagaccatcctggctaacacggtgaaaccccgtctctactaaaaatacaaaaaaaaattagccaagtgtggtggcgggcgcctgtagtcccacctacttgggaggctgaggcaggagaatggcatgaacccgggaggcagagcttgcagtgagcagagattgcgccactgcactccagcctgggcgacagagcaagactctgtctc

SEQ ID NO: 36732 - DNA, 23188 bp, Homo sapiens
tattgtaatagagggtgggcctgactcctaatgggaggcccaggtctgcggctggactggacacaagcaggtgtgtgtgtgtgtgtgtgcatgtgtgtgtgtggccagtggcagcaccagtaagtgccaaggataccagaaccactggggcagctggaataacaagcccaagtatgggggtccccagtgctgggcacatcccaggtatctccctccccacccattgccacaggacacctctggggactgggtgcctcacgccccttctgtcttgactgccctccatgccctgccccacaaacgctctgataacagtctgtccctgtctctctcctgctgctcctatggaagcgaagttttccgctcctgcagaaagcaaagttacggtaggaaactggctcctgctctagccccccgcatccccccctttcccacccggccccggcctctcctcaccctgcctcagctgcacccgatgccttgcagctggtttggggtagaggacaggctggccccgcggttggtcgagtgccctggcagtacgactctgaggtgactcctctttgttcctggggtactggaacccagactttagagccttggaacctaggacctgatgattttggggctgcacaggggcttaagctttcactgacaaggggaggagggagaagggaggaggctctgataatccattaagatattggcaggcggggagggggtggcagtttggagggccctacggaggtaaacgtgagtaaccaggggcccagagatggagccagggcactggcatgggaggggttatcctgagcagcccaggctgggcaggggatgtggggagcaaaagagaggaggtgctggcagccctgccagtgataagatggagcctgctgttggcagggaggcagaaggcaatagggaagagttggaggcagagggaggagggccctgcccacacagaccccttcttctccagactcagagacggctgaggatgacatcagcgatgtgcagggaacccagcgcctggagcttcgggatgacggggccttcagcacccccacgggtgagctcctggggtgtacaaagagcaggcaggcgggttttccataaggggtgcctcagtctcacggtgctcctttctctagggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtgtaagtaacggccttacctgggcctgaactgccccatctcaccacgctgtcctgcgctgccctcactgctcagtcagcctccacccatcaccctgccccatccatctctctgtgcatttcttcaccccctgctgccactccatcttcccacactgctccctcctcctcctgagccatcaccgcccacatccccctgctcccacctgtcctggctcaccatgccatctccatggtctcctggaccctgctgtcccttccttgtctcctccaagatctccagtttctcaggggccctcttttgcctcacccatttgggctccagttgtccccaggatccctcccccgacccgggggcccccttggtgcctgctgtctcagcagctgctgccttttcatctctctgcacattcctgttcccatgtgggcctttttctgggaggaacagaacctttccacacggcagctcccgggagagcaggagagagcaggggaacaagccagcaagcaggagagagaagagagtgaggtggccaggggcagatggggcaaggggcctgtgaaagcaggaggccatgggctgggggtggcagggggctgggaaagggaggggctggaaatggggccaggccagagggagagggcgggagtgatggtggcagggggcttgcaatgatttctctcatgggaaacccctaagtccctgagggtgggattcaaggttgtcccaggagggggtgtgaggagcggaggtgttggaggcactggagccatttttggagatttggggctcgcagatacaggagggagtgctatagtggaagaggggagtggctgagaatagagggactagggcatttggggagctgaggggggcctggtttgtgatgggtatgggtgtgggggcagctaccaccgtgcaggagaaagaaggggcctggtgggggaggctgctttgagggtggttagagcagggctagcggtgggcaggggagagggccagggctgggccacggccagggggaggctcccttggcttatcttcttggccttacccggtgttcctgtgccctggacttgcctttcccttcctgcctttctttaccaggccccagccagagcctggagttgctatggcaacttcggaggaacccatttccttagtgatgtctatggtacagagactggcctggagctcagagctgccggcaagaggcctcctctgctgtcctcaatttctctccaggcctcacccacttcccagaggctcttccctggggactctgcggcccttcccccagagaagacacttcctccctgcaggtggctggctggggtttctgtctctcaggccactctgcattgccaccaccccttttagccccagtcagaggtgggtctgtcatgtgggtggctgactcaggtaggctaaaacatccttaactcgggacccctagaactgctcatggctggcaccctactacttgtcctcccttctgtgcccctggaaacccagacactttggaggaaataagggctcaggattctgactgcctgggtttcaatcctagcaccaatcatttcccagctgtgtcaccttggtaaggcatttaatcttttttatgcctcagtttcttcatctgtaaatgggggtgatcacagttcttacctcacagggctgttgtgagtattaaatgactcaatgcattttaagcacttggtacaagcctggcactcaggaaatattcaatgagccattttacagatttttattaagctctctctgatgtgtcaggtatgataatacatttaattccttttttttttttttttgcttatctttatgtgtgatgtgccccctcacccaccccctcctccccgcaagggtccagatggggaaaactgagacccagctcttgggcaccaaagctctgttaagtgaaagggatactctggggtgaccggctccttccctcctccttttctcccacactccctattcaggcccacttagtagctatttctgagctgagttatttcagagcatatccctgtgggggggggccttctgtacttctcaggggggatttctaaggactcaaggtagctttgccaggggaagcacaagtcaaaggcctatcggggggcagactgagcaaggagagtaggagcctgggcatcccgttgccacctgctgtgtcccatcagtgctcggggtggcggcaggtataggctcaggtctacacagcagctagggaatcctagggatggggcactgccccccaaaaggcttgtgcctggtccaggaggctgttgcttggcttccagggaccactaggaaggggtgtgccctgctgatgatgggcaggggtgtgggggccagctgggggctggaatgagtgggtggctgcattcctgagaacgcccctccccaccccaccctcttgtcttccctccccacttcatcctttgggtcctaagcctcattcttttctctccctcatgctcagttctgtttccgctgtttctcggcttccagggctggggggaggaggctggcccgagtcctggggctgagtctgtaccaagacccagccattagcccaatcttgtggttccagagccgccggcctctccccagcacctgctctggctgtgcgctcctcgtgggggtgggggtggggggcaggaggatctggcccatgtcacccccaagcctgcccagcatgcccaccacccaattcctgtcacaagctaagggtctaggagaggaggccccctgaatcctctacccttctccatcttggttctgcagcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaaggcccgcagcaggaggttaggcgtcgggaccaattcccgctgacccggagcagagccatccaggagtgcaggagccctgtgccgccccccgccgccgatcccccagaggccaggacgaaagcaccccccggtcggaagcgggagcccccggcgcaggccgtgcgcttcctgccctgggccacgccgggcctggagggcgctgctgtaccccagaccttggagaagaacagggcggggcctgaggcagagaagaggcttcgcagagggccggaggaggacggtccctgggggccctgggaccgccgaggggcccgcagccagggcaaaggtcgccgggcccggcccacctcccctgagctcggtaaggcctcagggagggctgacaaggtgcctgaacccccgtcggggggcgtttgtggagagcaagactgctcagcaggagccggggggtcgggggtttcgcctggggctgctagccagctgcaagggtgggtttgccaaagaaggcacagacacaggctcgactttgagtgaaggattgtcaaagtccttgtgctaggactgctactggtgaggcagagcgtgagtgttgtgatggaggctaggtgaggctgagatgtgagctaagactggtgcccagatgcccgccatagctcccctgggtccagtggcctgctaggctgttggatcaagaaccactactggggggatgcactggtgggaacctaaggacccccctccatacccccaatccctctgttggggagagatggtagatggtctgaaataattttcaaatccctgttacagacacgctttgtgccagataactctttactctgcctctcccacccgggcaccatcccctgacccatgtgtggccacccagcctgcccttctagcctcctcacctcaggcttacaccccgcatggctgagctcactgtggtccctacacaatgcctgcctgtgtgttgtctcccaaccttcccatggatgatgaccaacaccaccaacaggagaatggctctgcaccccacccctcatcctgcacatcaactcgaggcccactcctggagagaggcagaggaaggcgtccttgacccacttccactgctcctccagaatagatgcctctacctgctgctcctgggagaccctgccaggatctctttcattgcacttaccatactgtatttttcttcatcaaaattattttgcatttaagtattaccaccttagaatctttagagataattaggcccctgtccatcatcctcctggacaccattattgcaaacacacaactatgtgccagcattgtgttaactaggcccttacagatgttatttcatttcagcctatatgtcagtttcagagggtcttttcccctccatcttacagataacaaaactgaggctcagagaggctaatttgcccaaggttttgtagctaggaaacagcagaattgggattttcactgcttttttggctatgtacattgtcctttatctagcttatggaatgtcagagttggagaatgcccagagacccatgacagtggagtttgtcatctctctgtatgtatgagcttcctgtaagcagggaccactggtccttcctctagtgttcttggtacccatacagtactcagtatgccgggagtacagggtcactatttggtgaacggatgaaatcaaatctgatcttcgtaggcctctcagactgcctaccattcactcttttgaatctgacggcttcacacatttgacaattcacctcgtgttgctctgtgacaccgctgttattgcttaagtcttgggttgcttttagcttgttctttgtctgtttgaaagcttgtgcccctccaggtgccttgcatggggcctggtacgccatacatgatggctgacgtgttaaagacatacacagtgcagtcctgtctttctccagaagccaacgctctaattgtggatgaagttgaggaacggccacactaacatggagtcaaggctgccctgacctgtttcgagaatgctccttctgacttccttttttccctaaggacattcaggaggcagaccctcttctccccaagtccctgctttctagaagcccctctgtctgggtttggctttctaggatgcaggccaccaggactctctctcccgctgtcatccctgcagggatcatggccccttaccccgttattcctgtgtccggcagagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaaggtgagctccagcactgggccaaggtgcggtcgaggttgggagggggtgtgtgagaagggaaggggaggttcccccggactcctccaagggaggggtgggaaagaggggaattatcccctccacgggggctgccctgacttgggtgtgtgttcagggacatttctcaggacccccgagagaagggagggcaacctgagcttcccaaaatgagggcggactcttccagattccctggggtgctgagaggagaggtttggtctcctgtgtggtgtgtggggtaggagtagagattctcagtgggcgcctgtgggccgtggcgagccgggtccctgtgcctccccacagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtagggagcccatcaaccctggggctgggtgggggcaagccgtgactctcccctggcccaggccccagtccacctcccttcccactctcagccttgagcttgggcaccccgccagcatacttagtccatgcagtcccttctgggtgtcggcagctttggtgaaagcgttttaaatggccctggcctcagggcaggggccaaatccccaaggcgcacagaaggctggccaattcatgaagtcagtgaaatttgtgtttagccatcctctaaatgccatcctcccatggcatttccctgaacagggtcctgtggggaaagcaaattgtccttgagtttccgagaagaagaatctctccgctcacagggtttaagagccaccacaagccttctgaagtcatttcccctgtaagacagtcccccctcccagtaaaaagagatgctttcgagtgccacaagccacttcccccctacttttcttgaacccaaagttgtaaaaagggtacagccaagagcacttcttgggctggcagtgccgaggctgccttgttttctatttttgtgaaagcccttacttggtgtcagactactttctttgggattcagcccagtttctttctggttcagctggatcagtgtcggtgtacatggccagttcagctcattcagcttgcggggcctgacaatgcactgaccccgggcctggggttcggggaggtgaggatggtcagggggtattacagaaggaaaacacactcaaccctcaagggggttcccactgggtgaccagacctggatcagaggacctaggttgggggacagtgcggagcagatggatctagtgccgaggacatccgagccgttgcttagtgttctgggatgcctgcgctgagagacgttggtgccctgaaggaggctgggattttagaccggcacggggaaggcgggacatgccaagagggggaacagcacatggtgttctgtcccttccttccatgaagtgctgcaggagacaagatggcagagcctgtgtgcccatcccagggcctcagcacctgagcagtgagggagttcttgatgcatctgatcatagtctcgtgctccagtagagcctttggttgcacggtctggcttgtgccactgcaggtcttcatcctccttagctgcatatccctcccggggcccattttccaggctttctcctcctcctacccctcctaccccgctgaatcatgcccgtccctccaccacatgcttctgtccttccatcacctccgggatctggcttctgactcagctcccagctcccctgagggggcccaggcctggctccaggaccccagtcaatacctggcttgggctgaaatttggcgaggggtgggatgggggtgccccgatactggctcagggccatttgggagccttttatggttggaaaggcagcttggggcgaggcagttgtcagcccttgactgagagttctgtatttgcggcatagaacctcctgagcttcagtttcctcatttgtaaaccggagataatgacaccgtcctcacggatgaaagcgaatgtgtgaacgagctttatgaactgtaaagctgtagacaaatgttagttgttagcgttattaacgggtgctgttgtgtagaagagctcaggtttctacaaggatctgggaagtgccttatccttctctgtccctttcttcagcccatctgtgccttagggactccacctctccccttggaaggcccatatcctgcagaccctctgtatttcccagcccctgtgtcctcagctcatcacagcatctcggcacctctgccctggggagccagaaagccttcattgcattagtctgttgcatcaggcattacagcaagacagccacctccttaagtcaggctggctcgggggccccagggcctggggggcaggcatgtgggtccagacttggctctggctgttgtggagcaagctgactttcttaccctacaaggcactgtttagtccagagtggctggatgggggccagtggacttgagagcagcaaaagtgggtggaacctggggatggcacagacatctggcaaggggtggtcccaggcctggagtctgcaggcagtgaggggtggggccaggggagggagtccagcagtttgcccgtaggcctggtggggagcaggtagagggaggcagtgggcagtgtattgtgggaagaggcctgcgtgcagccaccgccctctcttgctccttcccctccccctcttgctcttcatgctgcccctgcccagtgctatggtaaccagggctggctgcccagttccctcttggggtccaccccaacagggcctgcttttgaggacccacagatctcaattcctggttgggagccatggtaaccagggaatggataactagagaatgcggccccatggaccatggtttaggggcagggtctgtgcggaaaggagctggtcctcaccagctcccctggtccctcccaccctttccaccccactgaatcattctgttgagaccacagccattctcccaaagcggatgtgtggatgggggcaggtggcttgggagtgtgagaagtgtgcttaaccaaagcattccccaccgctgcccacatccatcacacaagtatttattgagtgccaaccaggtgccaagtgctacagctctctaaacagtttcttctgtttggacagtgtcatagactttcccaagccctttcacgtctcttccctggcgataacattgtgccatacatatcccttggagggacgtgtggcaggtggggacattcccattttatggatgagaagacaaaaatgtgaattgaaaagtgaggtagagctagcaccaggccagcagcctttatttagcacttgccatctgcctagggatgttttcagcaacaactgatttagggtgatggaaataactgcccatgaagcaaataaacttagtgtggggtgcaaataaaagtaacatgactgggctgagtgtggtgaatcacacttgtaatcccagcactttgggaggctgaggtgggtggatcacctgaggtcaggagttcgagaccagcctggccaacatggcaaaaccttgtctctactaaaaatacaaaaattagccaggcgtggtggcatatgcctataatcccagctactctgggggctgaaacaggagaatcacttgaacccaggaggccgaggttgcagtaagccgagatcgtgccactgcactccagcctgggtgataaagtgagactctgtctcaaaataaataaataaataaataaataaaaaatacatgaccaggtagcacttattgagtgcttcatatataccaggccctgtgttgattggattattttgtttaatccagccttatgaggtaggttctattattatgcctatgttacgaatgaggaaactgagacttggaaaactttagccaattgctctctggacacagtggctgacacctgtaatcccagcagttttgtctggagcagcattgatcaatagacatttctgtgatgatggagatgctctatatgtgtgtggtccagtatggtagccctagctacatgtggttagtgagcacttgaaatgcagctgcggtgactgaggaactgcattttaaatttaatttcattttaataactgcttttaaatagtctcaggtggctagtggctgccttcttgggatggtcagctctaggagcttagggccagctggaggctggagctatgatttgaaaccctgtctcggtctctcaagcctacactcctaaccatgacactatcccacccccctttcctgttgctctgaagaagttcgaggttgaggtagaactgagctcatgagctcactgggagggcactggtgatgccctctgtgggtgggtccgactgggggctttctcttcttcctctattgactccccacctccagcacagctgtggtccttctgtttccttgcatgcctgatgtgagcacacccagcttccccaccgtgcgccccgagaggaggccctctgggtgctgggcaggaggaagtgggagtatgggaggccccatgggcctgggcctcatcctccccacctccagtccttccctcaactacaggtctcctatatttgagcccaggattcttgcattttccagccaagaccttggcctcttcattgtaccttagctggtcatggttttcttggctgtaaagtgaggatcttcacaccagccaggccacctacttggtgagattcctgagggtctgtgaggagggcaagttggacacttgggacagaggatatatagctcatcgaagcccattctggtcccactcatagaatcaacatgaccacagcagaaaataggttgtttattgggggccatgaaaacaaaaacaaggaagaaaaccttagcatccatgtcagtccctgtcttctcttgcccctggtctctggccacctgtggcatagttgcagattctcccttgtgatggcagtggctgccgttggggaggatgccacatggcccccatcgtcagtcctcgatgggggtttggacaacaccagacaaagcagtgtggcatggtccccttgcccaaactcagcccttcctctaccctcctgtctgccagaaacaggcctgcctgacaggtggcctccccgaagctggtacctagaacgggggccatcactcacagcctgtcagaagaattgagagctcatttactgttgttgcagccacttttcctcacctggagcaaactaacatagtcatatataagaaattcatcatgaccgggtgcggtggctcacgcctgtaatcccagcactttgggaggccaagcagggtggatcatgaggtcaggagtatgagaccagcctgaccaacatagtgaaaccctgtctctaccaaaaatacaaaaaattagccgggtgtggtgatggacgtctctaattccagctacttgggaggctgagacaggagaatcacttgaatctgggaggcagaggtctcagtgagctgagatcataacattgcactccggcctgggcgacagtgcgagactctgtctcaaaaaaaaaaaaaaaagaaaagaaaaagaaaaaaaagaaaagaaaaaagaaaaattaatcacttctggggctaggtcaggctgaccatgtgaaatgatctgttggcttgtacattttgaactaagcctgaaacattctcagtccaaggggaaacattcatgtcagcaccctgtggaaatgcccacctcctggccagccgtgtcctccctttccctgacttttccgcagtggggttaccacagcagacatttcaagaactgcctgtggaggacctactgaaacagcacatgtggagggccagctgggaagggccaagccacaggcaaatgcttgctaacctgcagcctatcactcccttcctcaagaatcataaggaggaaaaaccgtttatggactgggtgccgtggctcacacctgtaatcctagcactttgggaggccaaggcaggtggaacacttgagaccaggagtttgagaccagcctggccaacataatgaaaccccgtctctactaagaatacaaaaattagccaggtgtggttgtgggagcctgtaatcccagctactgagggaggccgagccaggagaatcgcttgaacttcggaggtggaggttgcagtgagctgagattacaccagtgctttccagcctggatgacagactgagactgtctcaaaacaaaagcaaaaacaaacaaacaaaagaattgtaaagagtccgccttgcctacagagtaaaggctgcacacctttgtgtggcctctaccatctgcacccatagggcaaaaggagccagaggcctgaggctggccctcgggtggcagtgggaggcacctgcttgaacagtggatgctccactccttacttctttacccagtttatagacagacagttgagctatagtcctctgcacacatggcttttgcttcaaacttttccgcatgcactttcctctgcctggaatacttttccctttttcctgcaaactgcaattccaatactgcctcttccttcagttctctctttttccctgggccaaaagtcatctcccgccttctatactcccacgccccttacctgctgctctcttgctacctcatacttcctgcttgctcttgtagtcacttgtgtatctggtttgtcttccccaccacccagaaggctcctgaggacatgaccatgtctttgccactccttagcactggcagctgtgcctgggggccctcctggacagttaggggctgtgtggactgcagagctgtatgtgaggtggcagtgagtaggcagagagccccatgacttttcaagcccttgagcaacgtgggtgacacacagaggtgaggctaggcatgacacccagccacaagggtcatgaggctctgcctatgaggggagcttggcaaagagaccatggagcggtggtcctcagagtgaggcccccagaccagcagcatcagcatcacctgagtatgtgttagaaatgcagtttctttttttttttttcccaataagcgttttgcactcttaagaaatgcagattattggccccagccccgacctactgaatcggaaattccgtgggtggggcccagcactctatggtctaaggagccctccaggtgattccgatgcacagaaaaccttgagaaccactgccatagagttagagattgtgcccaagatgggagaccaggtcatgccaggggaagcacatgggctgtgtagccaaacctcctaggttcaaagctctgctctgaggttgaatggcccagtgaagggggcttagtgataccacctcttagggctgtcctcctcccataaagatcagcagtggtccctaagctttcatgtgcctaagagtcatctggggtgctttttaaaatgcagtttcctgacatctcatttcagaaaatctaattctgcaggctggagtaaggttgaggaatctatattttaaataagcccgaggtggtcctgatgtgagtaggtcaagtaacattctgagaagccctgaagcaaagggctgtgtgcgacaccttttatgtactagataattcgcagtggtggctgcaactctgtctattgtgagaacacatcaggggacgctgaaacagttggggtcggtggatgtgctggtctgaggagagggagttccctgtgtgcttcctaacgccagtattttcatcaaatgagtttgacctgagagtgatgttgaaagggcagacatgagcatggggtcagcgtgggggattgggagccagtgtgaaggggcggtacttccgtggtgggttgttcggggccattgagtgtatgtgcctattaggtttaggggggcacctgccccctccttcctggctggtgtaactgtgtttgccacagtgagagttgggcttgtgggtgcagcagggctgggatgtcagggactggttccaaagatggtttttgctatgtggccagggaaaaaactaggtggcaccggattctggtatggagcctcaggaatcctcgatcagcttccttggtcactcacttttggaggtatggaggggcagaggctactgccttgtctggaagaggcctgggctgctctgacagtctgtctctccaaggggcttgaggatgggggtctgcttcatggctagatgccctccagcatgctgttcccctgggcaccaccaggggtctctgaggctccctgcaaaccttgaccatctggccttcagctctgcttccgttcccagtccctgggcccgtgagcctcctcagtactgtccagcctggaggtgaccctggggcaggactccaggctccatagaggggtaggaccgcccacctgcggagccatgcctgtgatctcagcatcaaatgccttaagcaccaaatgccattctgacttccctccccaaccctacctcaagacagccagcctgaaccgtgggcccctcctctgcccggcccccagccctccttccttactggccatgctgggaaacacaggtcatggcttgggaatgtggccccgggttgcggggtgaggtgataggaagagggagaaggacatgtgacccctgctcaacagcccccttctctcaggttctgtgtccaaaccctttccccatcccagatacaaatgggttctcatgataaggggccatttgggggaggcagcccccgctgtcctctttagcggggctaaggtgggtggcgggcaagttgccaacaggtgccctggcggtttgggtaggaaggctggatgtgggcttaggccctgtggtggctgctggccagaccttccatggcagggatgagggggcagaggtgggattctgggccccctcagattcttcccccacctctgtgaaggagggcaaagatcttgacagttctccgattttcggggccaaagaaaacaggtatgccctggctctgtagtatttgaggctcgttagcgcattccccggtcagggatcttggtggttccgtcagagcaaggggcaacacagggaacatttcccacgggcaccttctttggtggacgtgtcagaacaaatgggtcagggcaagtgtccctattggcacagcgcagtgccacccctcccctgtcttgctcggggacggaggccccacaccttgagtcaaggcaccgcagagcgggctttgctcttgtcagggtctgaagctgtaaggagaagaaaggcagatcccgcggcttgggagtgagcagagtggctaaatccagacggccgcgctccgccctccctcccctctcccctctcctccccctccacaccagggcccaggctgcctgtggtctcggcaggcaccaccttcctagccagctgcctgccggcctgccatccaacctcctccttcccctcctcaggcgccttcccctcccccagggccttctccgtgcagggcctcagctgggtcagccgagtgagtggggctgggcaggctggacaggctgggctcctgctccctggggagccacgctggggtgggcagtgggcaggcagcaggagggcctggtgccagggcagagccttcaggacaggcacaggctggggtctgtgtgcagagcctcggggtgagttggggtacagccctgctgggggcttggggtggggggaccctggggagaacctagggggctgtggcagtttcatgtctgtatttggcagtcggataggagccagctcagcgagactgggaccctggccagttgcaggggagggcgtcagggccctggggacacccctcccccaaggctgactctggtgcccccctcctcttcccccaggctgagctgccctttttggtggatgactccagctctgctttcctatccctcgagcgtttgggggtgcaagctgtagggctgtggccaacaggtgcccctggggtttgcacggcaggaagctgagaagggaaagggggaggggcaggctagatagtgccgcctcattggccctggaccgaggtcgggatgtgacttgtctgcggtgtgtgttcctctgcaccaggcccagctcacccaagaaatgggcgtcctagccatgctgctccagggttccatagacctgcttcccctgcttttggagcctgcagttggtagtttaggtctctagtccatgtcaggaatgtgggtgccctgctccagtggaattctcccaccaggcccaggagtggcccctctgctgcccgaaccctttgccccaggcctttccctatggtgtcccctcctgggaggatcagcagggtcggtgttggcagagccagtggcagaggaggttccaggggctcagggaggggaagaagctgggcgaggtcgcaggagcctgggggtgaagtcagggcagggccggcctgcggggagctgccgcaactcctgggctctgggcgacattccagccagctctcccaggctctctgctcgccttcctccctggtagctatctctgtctctctccaggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtcagacccctgaggctggggcctagcctcctgtgtgcccccgttcctttgggtgcccccttgttcttggggccatgcctaggcaacatcaagacctggaactttgctcccattcaaaccctcttacccagagccagtctcagcctggctgtggaagagtcctccgtctcagattccacagcccccaggacccaaggctctgccctgtcttcccctgacactttggggtacccccttcaggtctcacttatggaccagtcagtaagagaaggccaagatgtcatcatgagcatccgcgtgcagggggagcccaagcctgtggtctcctggtgagtagccgcactttccaccacccaccagcgactctatgccaggcctggctctgggaggtctggctttgggtggaaggaaatggaatcttggtgggcttccccatgatctgcctcaggggcctcatctcagggacagcagtgtactccccccggcaccctgtcccttgccccatgttccaggcttatttagggcttccccttctggggaggggtttgggtctcatgtctgtccatttgggataaatgactgggtgcggtggctcacgcctgtaatcccagcattttgagaggtgaggcgaatggatcacttgaggccaggagtttgagaccagcctggccagcatggcgaagccctgtctctactaaaaatacaaaaaaattagccagatgtggtggtgcatgcttgtaatcccagctacttgggaggctgaggcaagaagattacttgaccctgggaggtggaagctgtagtgagctgagatcacaccattgcactccagcctgggtgacagagtgagaccctgtctcaaaaataaaaatacccccttcccaaaattagcaaggagcaagacatttcagaggccaaggaaggaggattgcttgagccaaggagttgaagaccagcttgggcaacatagtgagactctgtctctacaaaaactttttttaaattagctggacgtggtagtacatgcctgtagacccagctacttatgagggtgaggaggaggatcactggagcccaggagtttgaggttgcagtgagctatgatcataccactgcactccagcctggacaatatagcaagaccctattgctgaaaaaaaaaagacatgcaacaatttgtttctgagctgccagcagccccgagttaaatgtgggtctaagcagaggggcctcgctcatcccaggtgcctggaagatggattactcagcttgctaattttttatggtttgaattctgtttttcatttttaattgattgtctggtccccactgtgattttttttttttttttttttttttttttttttttttttagctggagtttcactctttgtcgcccaggctggagtgcagtggtgcgatctgggctcactgcaacctccgcctcctgggttcaagggattctcctgcctcagcctcctgagtagctgggattacaggcatgtgccaccacacccagctaattttgtattttttgtagaggcagggtttctggtcaggctggtctcgaactcctgacctcaggtgatccacccacctcggcctcccaaagtgctgggattacaggcatgaaccaccgtgcccagcccccactgtgatttttttttttaacattgtaagttttttcatatcccttttgggaagtgggaaagctatctgtccattataaataaataaaaataagacatggggaagtttaagaattattaagagctaaatagggtcaggcatgagggctcaatgtctgtaatcccagcactttgggaagccaagagaggaggatcatttgagcccagaagttcaagaccagcgtggacaacatggtgaaaccctgtatctacaaaaaatacaaaaattagctgggcatggtggcgtgtgcctgtagtcccagctactcaggaggctgagatggggagatcgcttgagcctggggaggtagaagctgcagtgagctgtgattgtgccactgcactccagcctgggtgacagagggaaaccctgtttaaaaaaaaaaaaaaaagacaagaaaaaagagctaaatagcacggctccactctgaatgcagcagggttccgagaagggagagctgcaggcagttagaagtgacctggaagctcctagaggtgggtgggatggcagagtgggggtaaaaacctagccctggaaaccagggatgcccacggtcagtgggacagatctggggactgggcaaactgcacagggaaggagaggcctgcacagtgctgcagccccagttcctgtgcacgcacatcaggcccctgggccctgggactgagttcttgcccctctgacaggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggtgagtacctgatttctccatgaatgcccacctggccctggccccttccttcccccactgtctgctctcacacagcctcagttagaggatgccaccactgaaagggccttaaggggcccctagtccagctgcttatattattgttgagtgaaccaaagcccagagacaggaagtgacctgcccaaagctgcacagcacattgttccgtgctcagcttactacacaacaccaccttccctgttgctccatcacggagccctggcggcagccagagaccctgcacctgccactggccaagctctctctacactcttctgagcctttgtcaccctgctctgcccaggaccctccctcatccccctccccctctcctctcgcccctttgcccaccctcccatcccattgctgtgcagaagctactgtgaggtagcggtggggagagtctggtggctggacccgttcggaggggcccttggggtggcttaggcttggagcatcacagggaccctagggtgccagggtgagcacagctgtgacgtgtgaagaggcctgggcccccagagcctggggcatatgtgcaggggccctctcaggcagcagaaatgccaggccctggctagggggccctcgagggccatgggttttcctccccaaaggccacaaccgtttatcttgccttccacctcacccttcgcctcaatggctcctcgcttcctctcctcgcttctcactcagcccccagcccctgaccttccccaaggctcagagctcagaccctgacagtcatggtccctctgctggcccccctgcctcagttcccctcctctgtgcctgccgttcctgtagttgccacttccttggtctccagattcttcagccctcctccccggcctgctttctctccagggcctggctctgcctcgcttctctgtattaacccatgtcttggtgcttctttctcttggggattccttccgacacccccaggctttggggtgctcctgatcccatgaatgcctggttgcccggggtctctgcctgcccaggaaccccgaggaaccagtctctggctagctgccggccctcgcagcccagagctgtccttgggggagccaagagtggcagtgctgccctgacggtgtgagaggcagccctctatgcagaagggccctagccaggtctgcgtgcctgtgcgtgcatgtgtgcgtgtgcgtgcgcatgcgtgcgtgtatgtgcatgcatgtgtgtgcatgtgtgtgcgtgtgtgcgtgcgtgtgcatgtgtgcgtatgggtgtgtgcatgcgtgtgtgtgtgcgcgcgtgtgcgtgcacgtgtgcgtgcatgtgtgcgtgtgcatgcgtgtgtgtgcatgtgtgtgtgtgcgcgtgcgtgcgcgtatgctgcactaacctgccgcttgctgactgaggtttttgtctgtacacaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacct

SEQ ID NO: 36733 - DNA, 82271 bp, Homo sapiens
ccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataaggtgagcgccccccggcgccgagctgagcccgctccgtgtgcgcctgggtcgcgcgccgcccgcgcgcccgagcccgaccagggcggccccggggccgcgcgccgggccaggaggctgggactttgggggtcttcccggcgcggccacccgggacccgggctgctggggtggtgagcccggcgccggccgctcacaggtggccacccccgcccgggcccccccatcccatgcgcgccgcggcccggtcagtccccagccccaggcccggggagcactccccgctccgacggccctgctcggcccccgcgcgctcgccttggcgtcggcgggaacggagccgcgcgccgggccccggaagccctcggaccggtcggggtcgtagcacacccgggcagggccggggcggcgggggcggcgggcccaggggttgcggcggccaggacggcatgggggctgtctgaaggccgcggtcggcgcggtggcaccgtggggctcctccaggcgcggttgcgcgagcctcgggcacttcattctcaacaggctttcccttcccacaactcctgcccggcgcccatgctggggcctaaggtgggaggtcggagcgcgggcaggctggatgggtggacggataatctatcatcttatgtaaccgcggagagagaagactaattgtgtaggaggctgacgtgcctgcctttgcttcagatgtgttaagagtggcatccacgttctcgtctgcgaaatgacaggttcacatccaagggccgcagagcaccgctggaagcctcccctgccgccccctccccagtcgtttttgtggctgggataccgacaaacaggcccttggttttctctttcttcagcatccgttctcggtccagacccccacgcctgagcccggcagctgccggggagcattttctcagaggagaaacccctgctctgggtgtccctgggtcctgggcgatctcttacagatgtgctttgtttcaaaactgtctgcaggttcagtgacaggctgggcgatgagtggagtgggtatttacccggcagtcgctggttcatgtttcctaaccggcttgcaccctgcccggcagagtaactgtttctgattgtggtaggcggccaaggcgtgcctggccaggggcctgggaagccctcttagctctcaggcttgggagagccagatggaggcttcaggggtggcccctctggttccagctggagtgcagggggccgattgcacttgaatacagctttcaataaagcttgtgaagttggggccgcgtcagtctggaaggtttctgaaggcgggtgtgcggtcgactagatgagtcctaaagccacgtcggagccactgggaaacaggattcagggtgacctgaggagtcggcttgggaaaggcacaggccctggggttgttaggtttggtttcacagagtctgtggcatacggttctggccttgttgctctgtggaagcacatgttgtcaagggagggaggtttattaaattattagtcattagctccattacgacttgtttgtgattgcagagggtggaagagaagtaccagcggaacctttttcctattttttctccttctgcgctgaaaccagaaagcaggaactttcgtggtgagagttggcagggggtgagtacatggagtggttttgctctgggggaccgaccccgtgatcgtccttaataaaactctcctaaccgggcagtaggccttcacctaggtgaagctgtaatttatctgcaggtctaagtgaaatctgctggcaggaaaactcttaggactgagtgtttggggactttgagcccctgtggacgcagaccagctggtctggagcacgtgaaacacacaggttctgcgttttgtcttccacgggtgggttaattggtgattttcccaagtgaagatgtggcggttgatgatttgatttagcacggcaggacgcggtgggccgcaggtgtctgaagggtcgatccactctggaaaggctttgccctggtgacaggcttgcgctgctgctgctgcacacaggcggggttggttttgtaggtaggtggctcctgctgccactccgggagcctgactgctgagtctttgagacctttttgtgctttgtcactggggagctcaaggtgccttggtagtgccggtactggttgggcagcttttggcaatgtcagccaggcagaaactcagcccacatggagacatagtcaggagaccgctgaggccaccggtgtgcactcctgggccggtccagccggtccaggcagtgctgagctctgtcctctcctgggacggtgctgcctctggcatcccttcccggggccgctcctgtgcctgggttggcggcttgcagagccctggcagtgcctcttggaacggctgtgctgtggcctgcttagtgtcacccgcgatgcggctcagctgtttggtttggtttggacattgcatcgccttaactgcagttctgagtggtgtttgccttggcaaaggaggacgcttgtccttggccttggtgattaaaaatgcgagaataaaaagtgcagttttgattttcttccccgtaagaatccgtaacgcagactttgacctcttttctggtggctccattcccttgggagctgtgtcctcggggaatttcatggaagatgaaggggaggggagtggaacggcttcccggtgtttgccgagaacataatctcagaccttctgggggcactgcgtgggctgggccctgcaggtgttgggagggcaaggcgcggaagaccccttcctccacaggagcccgggcccagcgcttgctcaggttgccctgggtagtggcccagatggagggatggagtgctggaatctgcctcccccggtggcctttggaattaaggctactgaagctgcagccctcttggggaagccccgtgcatccctgtgtgctgaggggctggctccctggctggctgtgtctcctggaatgccaggagaatgtcaggtgggtgttttcctcaaggtctcgtgtccgcagagaagccctggctcccaggtgacccatgacctggagtgtggcggctccaccaccttctctgggcatagtgccattggcccacagcctgtcctagaatatgtgaggttgagagagcatctggggaggaggaggagtccctgttgcagacgtggccatggccttccttgtgccgaggctcttggccctggctggtcactctagcagctggtggggaagccagcctggcggggccgcagccgtgcttcgaggagacgggtgccacagggttcctggagccaggagccagttgggtttgccgcctctggtgtgattggtaagggctggcgccaggtggtgggcgtcatgtgctgggtggcagggagcacactgccggcttttctgctccgtgcccggctgcccgggcctggctgttcctctctgccacatccagcttcttcctggggtgtgcagagctcaccatcccctccatttggagacggtggggggtggtctctgacaggcacctcctgctgacaggcacctcctggcattggagtcgccttcctgggtggggggggcagcagacccggcacctgaggaggagagaaatcacagtgctggacccagctccgtgcgcgtgtacatgtgtatgtgtgtccgtgtgtgcacacgtgcatgcagtgctttgtgtttaaggatacttcctggggtggcccccatgggcaccatcttgccgcagggtggctgggtctgctgtcactgagtagacctggcctgcattttctctacatgtgcatgtctgtgttacccgccctcgccaccgccagcctttagcagggggcacgtctcccaggagcagtgctgatgtggtccccttggtggggtggccagggcacaaagaccggctgccgtgtcatgctgccctctgggctgcccagcctgtgtgggctttggccccaggcactgtcctgccggttgttggctccagggtgtacaacccttctgctggtgcttgctcagcgtcccatgcctgctggctccaggtggcgtccagcgttcgcttggtgtcccatgcctgctgtgccgttggtggctgcatgaagtccgtgtctaccgatggatgtggccaggcgttctgggatgtggcgcttgtggagttgtgggctgcttgggggagagtgtcctgcccgtgcctgctgtccccacagccttgccttgagcaagtattcttcgttggggagattggttggctcgtggtactgcccgagtggacctgaggttcaggattaaagtgaaggctggtgctgccctgggctttcaggggccaccgttagatgggagggcagtgggtgggggctgctgggagctgtgttcctgttgctgccttgtcttcgactgaagcttccaaaggtggagacctgagggccaagacctgtctgctggctacaggcaccatgggctgaactgtccaggataggtggtcttgcaggggagggctggtgtgtgacctggccattgaataggaggggcctgtcctccttccgagctccaggaggcagactggccgggaggctgaagcccggttcacccttctccccagttcacaggtctgggccctggtcaggggagcaaccccagcgtcactgcaggagtggcaggtggtgagcagagctggacatcaccacttgtctccacccagccttgcatggccctctctgccagctgccctgggctagtgttgcctgtgggtgccaccatgggtggggacactcgccaccgtctgtggaggcggggtgccactgactgctggttgaggctggctcctgtccttccttacattgagccagagtctgccctgtgttgccttcccagccaccttgtctggtgactttctttgaggccccaggatagggaagcatctttgtggctgcacagagcccgtggtcccctggaagctctgcacttgggcggccggcgccgtcagccgccccccacagcctgcgctaagatccctagtaattacaggcaggcggggatggtgctggcaccggcctccaacgcacttccacctcccccgagcgctgattcattcctggcccctggctgtgcctgtacagctgcacaatgacttgaggggcctcaacccagaggcagaaagggaggccgagaagggacccgtttggctctgtgactgcaagggcttgatctgtcctgcccacggattcctcctttgggcatggaacggcggccagcctgtgaggggcccatcggtatttgggaatgaacacatcttgtttctggattctggagcattcatgcttgaatcactgtcccgcctttgctgagggtttgctccccgggcggtggcctgggccctctgagagctccctggaggtggtggcagctcacaccacatgcagttggaatccctgtttcccagggctgtgggcagtgcaggctgaggaggtggccctggtgtggggctggcctaggcaggctgagggctatttctcctactgtggcccaggggctcttggtgttggtcctgcaacaaggggaccagaaagcccagggagcaagagtggaggaggctgtggagatggtggggaggtagggcctgagcccatgctgtgctgaggagtcccctctagggggcaggaggctggggatctgcctctggcgggggcccgtttctgcctgtcaggcacagtggcgcccccagcacctccctcaagttaacccccatctgcccctggtctttttgactcacgctatagagccttgtctgctggctcttggtttggtcacccctgagctttggaaaatgctgcctggtccttgggcttcctgccaggcctgccgggaggagtcttgcctggccagtcccctggccatatgaccttggccaaatcttgctccctgggcagtgggtacagcgggcaggatgctcccagggtccctggaggctctggggcctgtcccaggtcaggtggcaccagccttggtatcctcagtgctctagtcctcactctgatgggcaggggtgggatgcacgcggcaccatgagatctgatgtcctgggccatgaggtgctggggaccccttgttgggggaaaggctgtcagttacaacagggtgcttttgctcttgcttagagtttttattttatacttactggaacagttgtcttataattgggtagtgttttttcgttttttgtttgttttttgttttttctgttttgtttttgttttgtttttggagacggagttttgctcttgttgcccaggctggagtgcagtggcgtgatctcggctcactgcaacctccgcctcccgggttcaggtgattctcctgccccagcctcccaagtagctgggattacaggcatgcgccaccacgcctggctaattttatatttagtagaggtgggatttttccatgttcgtcaggctggtctcgaactcccaacctcaggtgatccacccacctcgggctcccaaagtgctgggattacaggcatgagccactgcgcctggccctgtttgggtagatttttcaataatcatatattgaattcatgtgaagtaaattggtagggttttcttaaaacttatttttcatgaagagtttgacttctgagtcacatttcagctctgggctgtcagtgtgcttgtccactgggcacctgcccctgagccgtcaggggtgccaatgccagaacacctcctgagtatgtctctgagattttcttccaagcccctgctcttccatttttgttactggcacttttttttttcttttcttttttcttttttttttttttttggagacagagtcttgctttgtttcccagcccggaaggcaatggtgtgatctcacctcaactgcagcctgaaactcctaggcttatacagtcctcctgcctcagccacctgagtagctaggaccacaggcgtgccccacctgtgtgcctggctaatttttttttttattttaatttttggtagagatgaggtcttgctatgttgcccaggctggtcttgaactcctaggctcaagcagtcctcccaccttggcctcccaaagtgctgggattacatgtgtgagcaaacgcaccctggtgctttcttgatcagcaggttttcagacaacggccaggcctcctgttccttcttcggatggtccttatgtgttttgtacactgagctgtccaggcgtgcccctgcctggttgtggcaggggacagtcagcaggtgggccatgccaggtgaccgcctgcttgtcatggctgccccagtgggagtcgcaggacgtgaatggtggaatgcgctggggtagcacaggtgcctgtgccggaaaacagcgacatcttgacattagaatgggggtggggatggtggtgggggagagggtgtcccctagccgcaggagctggaatctgtccagtagagggtttgtctcacccagagccaagcttggtctgggtggatgctgctagtggcgggcagagtggccttgctgcttccaggcggggcttttattttaatttaatttaatttaatttatttaagacagagtcttgttctgtcacccaggctggagtgcagtggtgtgaccttggcttactgcagcctctgcctcctgggctcaagcaattccaagaagctgggattacaggtgtgcgccaccacactggctaattttagtatttttagtagagatggggtttcaccatgttgcccaggctggtctttaacacctggggtcaaatgatcctcccacctcggcctcccagagtgctgggattacaggcgtgagccactgcatccggtctaggtggggcttttaaaccagtgggtgtggtggaggccgagatgccaccacctgaaatgaagtggacctgggtccccccatacccgtttttccagccccctcttccgtggccgactatgtctgccagaggaggcctgtgtccatctccatttgccccaccacggaaagcccgtcctcacgcagtccaggcatggatggagcatcagcctccacctgtcctgctcctgggctgagactccagggcctcggtggccccaggccgtggagcagagctgtgggctgcggtccgaccggtggcaggagtcccatctagggatgtggctgtgaagctggggtgctggggcctgggcggtgtcactgctgtctcatgctctggctctggggacggctgggcccacagcgtcctggcacccgggaggccctgtcactgctcacactggagcgtcctggcacccgggaggccctgccactgtgcacaccggacactgcgctggacattctctgtgctcagcctcgttactgttgcttcgtgtgcgggtcctgggtgtccctgcctgacaggggatcctcggttcagggagaagtgtgtccccgcccgtaagctggagtggctgagctcattgaaactgcagagccaactccagggccctctggctctccagccgcgcgtctgtccttccgttcgggagttcgaggagttcaggaaggcgttctcgccgcggggtctctgttttctcattaattcagtgagacgatagcgtatttcctggcacagagagtactgggtaagtggtggccacgatcgctagcttgtgggacagaaagttcttcagagatcagaggtcagtggtccagagcaggaaagccccgccccgaagctgcttgccactgtctgctttcctgggatcctgtgttcctgagtgtggccacagcccccgggctggcacctcccacctgcctgacctgaggttggcgggaggtggggccgtacaggcattcctaagctgcctccctgcttgctcagccacggttgctcctccagccgtgagcccagcccgaaagaccggccagtgccttcacagggaggggatggatggggcagcggcctcggggattcttgcaggccaggcggtgaccagacttgggtctgcgattggcggtaatgagtgacctagtgaccgggcctttccacgttggagggggaccaacacggcgccacagactggtgtgcccacaggacggccgtggcacctggctcgtccctatgttatctgtgccctctttcttgtaaggcgctggtcctatgggattagggcccgccctagtgaccccagttacttttatcgccttcctaaagaccctgtttccaaacacagttgcactgcgcgatgccggggcttagaacttcaacacgtgcatcttgggaggggacacagttcagccgtgacacccagcggaccccacccgtgacggagtgcagtagctgctggaggggccgagtctcccatgttgcctggaggtgaccacctgtctgtcttcaggctgattgtattacgagcctatgatggttttcccttccaacctcagtcagatcgcagcccgcagtttatgacaacaggaaggtttccatggggacagctgattctattggacgagcagtcagctggcaaggcgccagctcagtgctggccacaggcgaaaggcagccggaatgcaccgtcccgtgtgggccggacaccccgtgaggctgagcagttgctaagttctgtgacccgggccagggtggctggacattggaaggtgtgtgtaaggggctctgtccccattgaagctgggataggcaggatgtgcctctcggacaggaaggaagtggccagactgcttggtgctgtgtttggactttgctgggctgcggctcctcctgcgtgggccgggtcatggtgtcctgcgtgcaaggccccacgtgtggcttttgcccttgtggacctctgctccttgggacctcgttcaggagggctcagacttggggcccctgagagttgaggacgccaggggaaagctcgcagagggcgtgcaggtgtccaaggcccatggaaagggagatgctgctgcaaccctgaaagggaagcagggccccaggctggggctgggggcccaggggaatggccgtgtggcccttcccacaggcggagggcagaagcgcctggctcaggagctgaccttagtgttggcatttgtccctgttgtttttagctgcagcattcatggtccctgtcctgggacctcccaggagcctggcgggtagggcaggcagcatgagggaaggagtccctgcacctcgggcccctcctggcgggaggccacctgctcctggtcatatctgggcaccgtgccaaagacacaaggaatcactttattatgatgtggatggcttttctgtgggtgctcctggaggctgagaactggagctaccaccttaggggacatcccagcccctcacgctgatcccaccatgacccatggccaggctgcccagggccctgcaggagtccctggtatgcgtgggacctgggtgtctcccttcggtcttccaggaggggctggggtgtgccctccatctgtctgatctgagtggctctgggggagtctgggtcagccaggccacgccgaagctgcccttggagaagcctagtggcccctcctgaccccccggggaagggtgggggaccagccccctctgttgtggaacaggctggcctcttcctgcctccagagaggtgcctgcttcctgacacccagagccctctgcggggtctcatggcctgggggggctcatggtgggggcccctggcacggcagaggggtttggccacccagttttcttctcccctcggctgtggggaccctattaatactcacagggaggcagagctgccggctcctgcacgcccagctgcagggggtaaggaggaggatggtgtctctgcctggtttgtcaccgtcccccttgggatcccgttctgcaggctccagcccaccttcaggcccccgtcctaaccctgcgcgccgtttcctcccagaaacttccatgcatcccctcgtttcctaaatccgtgtacatgtgtttgtagtttgtctccgactcaaaccaagtaagatgcagttcaagatctgcctcctccaggcagccctcccagctgtgctcctggagttggttttcttccttcaggaaggatcctccaggacagatgtccaagtgtttagaggggacaggactgtccacaccactccagccaggcttccttcacacccccacagcccccactcctcttgccctgtgagccagctcccaggctctggagctcatcggtgctcctgtgtgtggggtcagcagtggcccgccctggaggacgctgccaccttcccgatgctctctgcccacagaagtcccccaacccccctggcagccaagggaactgagcctgtggcccccggacagcaagctctgaggtgtcctcccgcgaggacactgtccactgctgcagggcccctcctgtacctccctagtccatgctgtacatgtggccgggggtttccaggcttggctctgtcccgtgcgcccttccctggagcctggcatcctaggcagagtcccgtcaagtctacgtggaccagagtcgtgggtgctgtgaggtccgtgtctgtgtgtggggtcctcatgctgtggctgtggtggcacagcgggctgggggaagcccctctggcactgccggccccgcagctgccaccggcttctgcctgtcgcgacagaggtggaagtgagggcggtggtccagtgggcaacagcggcctggcccctcaggagctgtgctggtccgtgggcgagggagtgggtgggcagggcccctcccctcaacagtcagccaccctgggcattggccctcctgggagaggccaggtggatcgagtcaccctttttcctgatattactggaatgtggcctttgggagcatgtcaggtgcaacaccaggaccaattgggagagagggaccgggctggctgtgtggtcagcagggttgaagccaggactctgggctccaccaagagctgacaggctggcccctgccttcctgagcctcactttcatcttgtccagtgtaagatgggacagtgactctcatggaggggctgggtgaggattagggtgatgagggtctaaggcagccggagagggtcctagcatcgactctttctctgtttgttcttctgagtagatagaaaacacggctcagcctggccacacacagacacatgtagcacacacacaggtccacgtgtgtccagcacacgcatgagtgcacatgcacaggtaaacacgttcatgcccacagcacacacatgggtccagctcatgcccacagcacacacgggtccacgtgtgtccagcacacgtgtgagtgtacacgcacaggtaaacacgcagctcatgctcatagcacacacacaggtccatctcatgcccacagcacacgcacgggtccacatgcgtccagcacatgtgtgagtgtgcatgcacaagtaaacatgcagctcatgcccacagcacacacacaggcccagctcatgcccacagcacacacaggggtccacatgcatctagcacactcgtgagtgtacatgcacaggtaaacgcatgcagcacatggccgcagcacacacacggatatatgtgcatgcatgggtccatatgcacgcaggccctaggggtgtggccatacgcgcccaccctggcatctgccttgaggggctggagggaggtgggggacactctctgtcagcagagagactgcttttgtttgtggccatcctgccaggaaagcgctggagaggcggccagcgtcacaggaaggagagccaagggataaacagaattcctggccgggagcagtggctctcgcctgtaatcccagcactttgggaggctgaggcgggcggatcgcttgaggtcgggagttcgagactagcctggccaacatggtgaaaccccgtctctactgaaatacaaaaattagctgggtgtggtggtgcacacctgtaatcccagctgctcaggaggctgaggcaggagaatcacttgctgagaatgcaccactgcactccagcctgggcgacagagcaagactctgtctcaaaaaaaaaaaaaaaaaaaaaaaagaattcctgagcagacggaaggtggaccccagcacggcccaggagtgggcaggagagcaaagtcctttggcagaggtcctttctgtaaatgtactggccactctccctttgttccccaagttgggaggaggtggagatgacgggggttttgctgctgccttgtgcccacactggccaggccggcccgtagcactgaatcataatggccatcagtctccaggctggccagcagtgtccagcagctcgccagccaaaagggctccctgggctcatcaatgttctctgacggccacctctgcaactgatggacacggccctcccatttgtaccttcagaaatgcatagctggggtccctgggggctgtagtagggacagctagggtccctgctgtggtcaaggcctggattccatgcgactccagggccactgggacatccgtctctgtggacgtcccagcaggagggcagccaagcgtgcgggcatccctgggcagggacccctcctctcccggcacttcgcggcatgcgtcctatgaggggaagccttccatggcgtgtgtgggagcccctcgtgggccggaccgccttcatgggcaggacccccttcataggcaggccggcccaggaccccccctggggtgggaaaggtgttccctggtcaatagtgaatgaacaaacgaggaactggaagtccgtgccggcccgggaacgcggcccagggagccagtgcgtggtcgccgggggcacagcagagctctgcacgcgccgggctgcgtttgtactgcacaggtcctggagtttgaggagtgtggtggttgctcatggtgtaggatttctgtcctggcaggggggcatggggtcacagaacgtgggcccctggggagctctctctgtgcctgtggccccccaggagtctctcagttttgctgtggtcttgaggatggcacagcgtgtccctgagcgccctcagtgtggacagctgggcttcaaactcacttcagagccgccgtgtgggggtggcgcctctgagggcttgaggttattttcttgtgcggtttctctctcctggcctaggtttttctgggttttttgcacctcttggtgttgataagaaacaagctcccttccccttttaaagcccacagactttcccgatctcctccccatcccctgccccagcactgtcagggcgtctgggcgtctgagctcagctccttcctggtggcatcctgcaaaaagatacactcgctcagtgactcggaaaagccacgtcggtgtggctgagaacagagttctttccacctggggccgctgctgttggttttcattccggaagagctggagctgcctgtcactggctcccctgcccccacctggggacccccaggcactgcaaagtgcctgttggctatgggcccccggaccaggaccttggcctgattaggggagccggaggtggaagtggaggcgggactggagtgtatgccccacagtgggctctcctcaggctggggacttccacacgggcccactgggtcaggatggcccgtgcctgtgttctaggataatgggatggactggttcggaggctcagagagacgcctgaccagacgcctgactggagatggtctcccagcagaggggctgggctcttcaggggccactgggctcctcccgtggttcctgggagagggaggaacccggaggaggggtgggtggcacctacagtgcgtgcctgaggcagggctccacagaaggcctctctgctggcccagcggctggatgcagatgcagaaggaggaactggcccttccgcccgcccgggaaggggagtccccccttacaatgttggctcagtgggatcgatgcctctgccattgccttcgggccaggacagcagcacttgcgtgtcccggccgccgcccctctcttgcagatggaggcagggccgtgcccaggtgtcctggtggctgttccctgcccgctgtctcctgcattccttccgtgtgagctcagctgctgcactaaggaagcgaaaccttggtgctgccccgtgcgtcatgcggtaggcatggccgccgtgctgacccgccgtggttggccctgggtggctcctggcctgtttctcctgctgctcaggatgttagtggagctcacagggctcaggttgagcctcttccacccgggggcctgtgggggtcatggtcctggagccaagcgcgtggggctcttgtgagcaaggggtctgctctggcacgcccacctccgtggtagtgttttcatacctgtgtcacacagggtgagaaacatgcttgatgctgcagctcagcacacacacgcacacaaatgtgcacatgcacacgtggacacacatgcacacatgcatgtgtgtatgcacacatgggcacagatgtgcatgcagacatgagcacacgcacaccagaacactagagtcggccgcatcctcctcacttggctgatgcccccttctgcttgatttcatcacaagaaacgcgcatccggcagcatttcccgaccgccttcaccgccagtcccggtctgcatggtcagtttgaaccaggctgccgagagcgcaccaggtcccagcattctcctctctgctggtaactcttcaggcattgtctctggctcacgttctcctgggcgccagacctatctcaccccactcccggtgtggcctccctgccccggctcccaggcactcctgggagttaaagtgtccaggctcctggttcattgctgagtgtttagctcagtgctaacgctgctgtgctccagcatccccgtccctttaggacagaggcctgcgtggtacgtgcctctctgctccagcatccccgtccctttagatcagaggcctgcgtagcacatgcctctcttcccctctgacatcccagagcctctgatgggtctcccagcatacgccagggcccttggctaaaatctagtctcctctgagcagccagagggatcttctcttttgtttgttttgtttttttgtatttatgtatttttttgagacagagtctcactctgttgccaggctggagtgcagtggcgcaatctcagctcaccacaatttccgcctcccaggttcaagcgattctcctgcctcaggctcccaagtagctgggattacaggcgtctgccaccaagcccggctttttgtatttttagtagaaatggggtttcaccacgttggccaggatggtctccatctgacctcgtgatccgcctgccttggcctcccaaagcgttgggattacgagcgtgagccaccgtgtccggcctgttttattttttttagagacagggtctcactctgtcacccaggctggagtacaatggcacaatcacagttcactgcagctttgaccttccaggcttaagcaatcctcccacctcagcctcctgagtagctgggactacaggcatgcaccaccacacccagctaatttttaaatttttagtagagatggggtcttaccacgttgcccaggccggtcttgaacgcttgggctcaagtgatcttcccgcctctgcctcccaaaatgctgggattatacgtgcgagccaccgcatctgacccagcggaatctcttaaatgtagctggcccatcgttctgctcagaccctccttagcttcatgcagccgggcctcaggggctatcccattagcacatccacctcttcctcttcctgcctcccctgggccccttccaccctcacgccgggtcctgctttcccaggaactcaccatgggccctgcctcggggcctttgccctgccctggtctgcccactgctctctggcatggaaagtgcttccctgcctgccttccacgtctcgctgagcacgcctatcccacttctgcggaagcgctggccctcctagtcctgccttccctcgggagatgttggctctgtgcgagcagggctttgcggctgggtcgatgctgcatcccccacccccgtgcacgtggcctctgggctagcacgcaaaggcgccctcacccttgctgcgtcctggaaggaaggagcacctgccctggaacttggccgggtggcgttaccaccggagggtccagtataggcaggactgaggtgtacccggcctgctgtgagccccggcgtagtgcagaactcggggcctcgtttcccaagaacacacaccctggccatacctcagggcaggggatggaacactcgtcaaatagcgggttttctggaggcaggtcccgtggtggggagtggcttccttgtccctaaatgccctttctatctgttctcttggcttcggaggctgaggccaggtgctgggagagggggtgggggatgcagttgcccttccctccccactctctagcccacaggttggggctgggtgggttggggccccacagcctcctgcttgtctgcgacagggctgggcggcttcccttcctgtgatcctcaggaaagatcaggatcacatcataacaaatgaccggaagacacgggaggtggctgagctgggggtttctgctggagctgctccctgggcccttgctggcaggggctggctgttgacagtcagtgtatgttatgccggtagaattctcatttggctgttgtttgtgtgtgcctgtttttatcccttgtaattaaaacatttatttggccttcgcagtgaaaatctaatttcttgagtctaagaactgctgatcttggcaccgagatgcccgtccgtcgggcaaacagacccagagccgttggattattcatagcacggcatctgcagatcaggctgcagtggtgctaatcagagctgaggtttggtaattgatgtgttgagcaggattttagtgggaggggggtgccggcgtcgttgagcgattgtgtatggccggtggggggcccttctgggctgactcagccgcgccaatgggaacggcacctcggcagcggcgcgtctgagcgccagttgtattctgcctgctgcaccatgcaaatgcgctccttcagcccgcagacactcctctgcggccgggtttcttcttaccccctttgcacaggtgtgaaaaccgaggctcaggaaggtcattttcccaaggacattgatcaggggcatggctgggatttgaacttgggaagcccaccttgagcatttgtggtgtcgacccccaggaggggtgcctgctctgggttttctcctctgtgttcggacccttcggagtcaccagggtgacctctgccagtaatgctgtttcttctctgctttcttccagaccatcatggagcagttcaaccctagcctccggaacttcatcgccatggggaagaattacgagaaggcactggcaggtggaactgcgcccgggccccgtggggtgggagctgcctcctgagctggtagaactgcgcccgggccccgtggggtgggagctgcctcctgagctggtagaactgtgcccgggccccgtggggtgggagctgcctcctgagctggtagaactgtgcccgggccccgtggggtgggagctgcctcctgagctggtagaactgtgcccgggccccttggggtgggagctgcctcctgagctggtagaactgtgccctggccccaagggtgggagctgcctcctgagctggtagaactgtgcccgggccccgtggggtgggagctgcctcctgagctggtagaactgtgccctggccccaagggtgggagctgcctcctgagctggtagaactgtgcccggaccccgtggggtgggagctgcctcctgagctggtagaactgtgcccgggccccgtggggtgggagctgcctcctgagctggtagaactgtgcccgggccccttggggtgggagctgcctcctgagctggtagaactgtgccctggccccaagggtgggagctgcctcctgagctggtagaactgtgcccgggccccgtggggtgggagctgcctcctgagctggcagatggacttgggcacagcctgtggggcctggtcaggagcgaaaggaggtcttctgttccagcaacaaagctggacagcggctctgagtgaaggtgtagcccatgcattctggactgggtctgctgtcactgtggcagcacgcccctgcctgtgcgggctgctcttgtcctgtggcatctagagacgggaggggtgcggatgtcagtccctcaggatcatgtagaaactgtgggatcagggctgggatgaagctgttggtaactgcagcagcttcgggtttgagaaatgagcgaacgccctgcagctccttctcacaaagagccgggacagagggtgtgggggactggtggctgcagggacattccattcttcccactgtctccctgagacgcttcccatcgcccccaccccacccaggcactccactgcggggccttgggtgcacctgggtctttccgtcctggtggggagtggcttccttgtcgccagatgcccttctcacctgccctgttggccccgcaggtgcccttggctgagtcctgccatggatggggacttgctattcttggacagtgacccccggtctccctgtaccctctaccgtgtctgtccctgtaactgcagcatcttcatgggcagagtccacatccccagcagggaggagatcgtgtgttttccgggacacgtgctgcgtctctgccggcgcccccggctcctccaccgcttcctggtgttgcggcacccatgggttgggtggagttggttgtccagttttggtgccaggttagaggtgtcaaggacggggcaggagttggtcagccctcgttccttttttaccacctttactccgttgtcacctggggagaaagcactccaaccgagcacctggcagaaggcctgtccctggcactgccctccttctcagctccccaggtggaccagttgtgcccgcctgccacatctagttgggggtggccttcatgtttccttgtgggcatgaatgggacagggagctcccttgggccacctcctgtttgcacccggcaccctgcaggggcccccatggctgccccagcagcagccttgtttctctccaccctgcccctcctctacatccctgggcccggggttgcacccgagggacctgctcatcaaaattgtcttaaagagctgtccttcctccagcgaaagtctgcagggtgttttgtttttttttgagacggagtctcactctgttgcccaggccagactgcagtggcgctatcttggctccctgcaaactctgcctcccgggttcacgccattctcctgcctcagcctcccgagtagctgggaccacaggtgcctgccaccacgcccggctaattttttgtatttttagtagagacggggtttcactgtgttagccaggatggtctcgatctcctgacctcgtgatccgcccgcctcagcctcccaaagtgcctaggattacaggggtgagccaccgcgcccggccgtctgcagggttttcatgacagtggagatgcttgggctgtggcagtgacccccgtcccccagccaggagcttcttggatgaggtagtggaggtcggcagcagagcctgtggcagctctgagggtcggcgtggcctcctggtggaagttgcacctggtttgcttccctatggtgcaccccagttgttgggcagcttcatgggggtcccagggagagctgcctttgcctctggcctgaaatgttgacgctggagagaggctcccgaatcagagtaggaaggctgaggcccggctcgaggtgggtgcagagggcttccaactgtggtgaccccatgatctctaggcacagcacacgatgtccagattctccgggcccagctaagttccgtgccctgtgaatgagaccagttgttcatctcttcctggctgggtctgaatcttggccattacaatgagaatccagagtccagatgatcccacccctggagatgggggctggtcttgcacattgcagactgacgatggcttcctttttccagagccactcgtctgtgggacacttggtgacctcatctacggtagagtcttccgtagccctcacgtggctctccgaggtgtgggtttcttccccgtcgtccgcacacggggaagtggtgtggatgccgctttcagtgggttgcggtgggggccggggcctgtgttcccctcctctgggtgagcaggcacttcggccctttgatgccaccaaggcgtgggttccgttcgggcctttccgctcctgtttggttcctcatgagggtggcggggctgagtgtggagacttggagctttacttcctgctcctgcttttcttgatggcctggtgggaatgagctcggccgtccaggcagcaccgccaccttagccgcagccagccgccctggagtctcacttctgctgttgcgtttttctgctgttgcgtttttctgctgttgcgtttttctgctgttgcgtttttctgctgttgcgtttttctgctgttgcgtttttctgctgttgcgtttttctgctgttgcgtttttctgctgttgcgtttttcttttgttcgaggcagcacacccgtcccaggcacaggccttcattcctctgtggacgtggtcttgtgccgcagaacaaattgtgcgcttaattgaaaagtatataaataaaatctgataaagtgcccagttataggcccctaagtgggttctgtagaaaacggattagaaattgtaattacactgctctccggggccctgccccgccctttctgcggcctggaggtcagggcggggctccctgtcaggtggaggagtttgccaggcactccctggagtccctgaggaggaagcccaggctcttccaggagcctgctccacccctgtggctgtggaggagttcagcaggcccggagcccttcacacccacttctgattagatcagactctgcctctgagatgctgggaggcccctcaggcggcggcaataccaagtaatgcctttagcctcctttgatcagctgtgacgggcgtcctggtctgagactgtgaagcaattggaaatagttctcccactccaggctcagcttggggatctgtggggaaatggcttcctactgcccagctctgcagtttccttgcccagggttggttctttgtctcatgaaatacagttagtacaacactccctccccccggccctgcctggtagcacgtgatagggatcagctctctgcaatttgacttgaatagctcaggacctgaactggtacgttgtgttcttacgagtcaagggagctctcatgattggggtgaaacaagaatatcaacaagagatgggttctgtccaacccagaaatcacagcgagtcgagtattctcccagcttgtctgggcaggagacagggttgggcctgtgcgtgccaagactgccgtgtttttgctgggggtcttgtctgtccctcgtggaggaaataactgctcccttttcttctctctcaggtgtgacgtatgcagccaaaggctactttgacgccctggtgaagatgggggagctggccagcgagagccagggctccaaagaactcggtgagaccccccccccccccccgcctggtagtcgcctgatgccctcaggcagctctggggccctgtcctgtgtccagccgctttttgatttgggatcaggttttgcctgtcaaataggaaaatattttaatgacagtcaccctgggagctgccttgtggggcacaccctgctgaaagtgggtgctgggtccccgtcccctgaggcgtgcagcctggggtgaggacagcaggcaaacccacgtttaaaagtgttcccggcaaattggagcggctgacatgggggtctgtgtgcttggatgatgggattagatggcgtgggaattcattcctggtattaaaatgagtgaaaaaggatgcaagcccacgtgtggtgtggccctgaggaagacaccccagcagcgtgagtgggtggatttcctggagggcaggttatgttattgatgctttgtctgtgtttagcaaattttctgtgatcgctcctgtgacgtctatgtcaagggacacagggtgaaacctggaaattcagggcccacgtggtggtgctgcaggcgtggcttagacggagtccatgcttccacagtcccctcacctagcagggtggtgctgaggtttcctctgcccgcctgggagaccccgggccggctgcctgtgctcacttgctgctcccagagcgagctgtggccggcagagcggcccttgacgcacaaggaagcctgagtcgctggagaaaccacttggattcctcttccctctggtcacggaggacaggctgcgctcactcttgaccgtctccccgtggccgccaatctgggaggtggtctgcaggtctggagaccctcggatggggaagagtcactgtgactggccctgttcccttctttctacttttcttctcggggactgaaagcccccttgactgacagaggccctggctgagtcggcaggcggtgggctggggggtcgtgggttgctctgtgtcacttccagctcccagaagaggctccgtctccctaatgctgaggctctggggctgggaccccaggaacccagctttgcctgtccaggccccgttctctccagttcactcacgacgtcctgcgccgggaggcagacctgccggccgcacttcgcagccccctgcggaccctcatcggagccccccccccacgcccccacaggctgctgccttgggcaggcccgctggcgtgtttgctgcaggtctggtgatgcccgggcggctggagtttctcgaggcaccgctgtgctgacagactggggaggagaggaggaggcactctgggcggggtccccgggcctccgcagactcagcctggaggatgacgtgtgagatgcatggtgttagggtgacggaggctgagactccagtgcaaccaacagcagcctgccttggagctcctgggccctgaccgggtcttcagggtttggagaagggcagaagcagtgggtgtctgtgaaaggggcattttctttttcattagagacagggtcttgctctgtcgcccaggctggaatgcagaactatcgtggctcactgtggccttgaactcatgggctcaagtgatcctcctgcctcagcctccctagtagctgggaccacaggcgtgcgccaccacgcccagctgattttttatttttaattttttgtagagaaaaggtcttactgtgttgcccaggctggtcttgagctcctgggctcaagtgatcttcccaccttagcctcctagactgctgggattataggcgtgagccaccacgcctggctgaaagaggcattgtcttaccataattaaccaggtgttgaggagatgaggtagaggaccaggtgtcttcgccccttggtcgcatgagggtctgcccgtggggaactccaggctcttgtggcccacagtgaggggtgggtgggtccgaaatgggtgggattccagaacttcctgttggcggagtccctggtggttgactgcaagaaggcgctgagcccacatgggcacaaggaggaggagggaagcttcagaagagagggagacgtgagggctcttacttggatcagggagcgtctgtttacctgtggccttttggaatctctccccgggctcctcctggagcgtggagccccgctgtgtgcatctgcagagggccagccacatgtcagccttgctctgggagtcaggttttcttcccggtaacagcttgattgacagaattcacatgccatacagttaccccattagagtgtacagttctgtggcttagtgtatttacagtgtgcaaccattgccccatctaactccaaagcatttttatcaccccaaagcgtttttagcaccccaaaaagaaatcccataccccttaagcagtccctccctcatccccacgctcccagcccctggcagccacaccactgtgtctgtctctccggactggcccattctagacatttcatataaatggagtcatacggtgtgtgaccttctgtgtctgacccttttccctgagcacatgtttaccgtccctctgtgctatagcccgtgtcagggcttcattcctgtttgtggctgaacgatgatccattgcacaggcagacccatttcatttatctggggttgctgtcaccttccggcagctgtgagcctgttttcatctctcctgggcatgcaccgaaactggaattgccgggtcagatggctgggagttgagtttttatgaaagcaacacatccttgtttcaaacaaagtcagccacttcccaccctcctagtgtggccaagtcctactgcacagaggcggctccctcggctgcgtgtctaagagggcaggtttatgccattcctcctcctcctcctctacctccaacagggccgggcgcggtggctcacacctgtaatcctagcacgttgggaggctgaggcaggtggattgcctgaggtcaggagttcgagaccagcctgggcaacatggtgaaacccccatctctactaaaatacaaaaaattagccgggcgtggtggcatgcgcctgtaatcccagctactagggaggctgagacaggagaatcgcttgaacctgggaggcggaggttgcagtgagccgagatggtgccattgcgctccagcctgggagacagagcgagactccgtctcaaaaaaaagtttagacatcatcgaaaggattcttattacggaagatgtggacttagcctttttatgctgtcccttgccccacccagtataattatcacagtatttgtttaaactcatgtacggtgttatctgatgatataaattcttttcatggctaaggcagacggtgtattatgatgactgtttgtacaacttcatcgaggtgtctgagtgtccagtgtgatgagttttgacgtgtgtacacctgtgaagctgtggccacaatcacaatggtgaacttgtccgtctctcgaagagtcctcgggccctccctccccatctccaggcaaccactgatccgctttctgtcactgtaatttagcatgcatttgctggagttttacatacatggaaccatacggcgtgtcttctttttttgtccagcttcctcgggtgtgcgtggttattctgagctgccttcctgctgcgcgcgtcaggaatttgttgcatttcgtcgcttgcagggtcctgttgtgcggaggtgccacagtttggccgtaccctcatctgttgatggacacctgggtgtttttagcttggggcgttcctaaattttcatttccttaattaactgatgttgtggagcatctttttgtgtttttgttcaccactgatctctcttggtgaagtgtgtgttcgaatcttccccctttgtttcacttggcttttgtcttcttaagttacgagagtcctctgtatactctagatggaagtcccttgccaggaatctattttgcacatatttgctttcagtctggtgggcctttcctttttgtaatagtggttttagttttttttgagaccgaatctcactctgtcacccaggctggagtgcaggggtgcaatctcggctcactgccaccttcacctcccaggttcatgcgagtctcctgcctcagcctcccaagtagctggcattataggcaccggccaccacacccgcctaatttttgtatttgtatatttttagtggagatggggtttcaccatgttgtccaggctgctctcaaactcctgctctcaagtgatctgcctgcctcggcctcccagagtgctgagattacaggcatgagccatcgcacccagatctgtaatagtgtttttagaacaaaagtatttaattttaatgtagttcaatggactgattttttttttttttggtattacagttttttggtattatagctcatggatttttgttattatgactctgtggtatttattatgacgcctttgcttttctggagttaataatggtctcgcgtcttggttcgcttcattttcaatgcgccatcacgaatttctccccacagcctcagctgcacccttgcactggctttgctgttggctgggaggtcagtctctgtttcttctccttttggagcctccctgctccctcgtgggctgctcggccgtgcagagtcagcttctcctcctcccgggtcagagccccgtgttttctgggtcctgtgtctttactgttcctgtattactcccaccatttggggaattgtctttttctttccttttttttttttttttcggttaggtttctgagtgggtgaacggggaatgtgtttgagccagtacgtgtctgccattgtctctgctggtggcttagctggtttggagtttgcaggtggaagatgctctgtgttcagagtctgagggcctcacaccgtcgtcttccagctcccaccgctgctgtgttcagggccaccttggtgctgattttatgtgagtgttacttcccccccgcccccccgccgcccccaccagctctggagatgtttgtgctggggtgttaggaatttcctgccgatatctttcctgtggtggcaggtcctgagaggcttgtgaacagcatcactccatgattgagagtggtgtgcagcctccagggcccacaggagcggggacctgagcgaggaggactgcaggggttaagaggaggggtgaaggagaggggcaaagggtgtgtccaaaggtgtgaggtggacagaaacaagaggcttttgcagaaatgtgaaaggtctggagcgtatgagggggtgaggctgggaggggaggcagggctttgaggagcccagggccttgtagagattccaggcttggtgccacaggaagatggatttgtgcaacctgcctttctcactgtgtcttagggtccatctgtcatctgtgttcttgccacacgcggatgccttcgttttcactgctgtagaatattccataaacgtgtaacagtttctctgtcctcctcggtgagcagttgagttacccctggtgagtttttctggatgagctcgaggcccaaggggccctgaggctgagctctcctgcgggatgaattccacaaggccccgtggggttgtgcggcagccacttgggcagtaagtgaaggaggcgttcgtctcactccccaggccgggggctcagcagttgccctgggagttttgctttctgtgtttgcaggctgtgttattaagtgcgtgtgtgtgggtgtgccttcctgagctgagccctattatcgcaaggtggcttgctctggccctgaacagtcttatttttggttcgtttggttgggtgttgagtttgtttcctgttcttcctcttcagccccggggacgttgctcatttctggtcaccttctcctccagctgtccttgctgccccaggatgggaggatggaaggtgctgtccctgctctctgggaatgagccaggccctcagtgggtggagcccctcccaggaaggcagagccctggtctgtgctggggtggaggtgctcagctcagaccagccccttgcttggccgggaggtggttttcagtgatttggtcctgacacccggccgagcagggccccagcctgtcctctctctgctggcctcccacccgggcccctctgggtgtggccttgtggccatatggggccagggttgccaggcaagcagtggtgccaaccctggctgcccttcttcctcctcttctcattccttccccactttcattcttcgcaccttttctttcccatgtggcacctgctctactcacagggcagtctgcctttagtcctgtgggtctctctgtacctgcacctctggccctgtagtgcccacagccggggaggtggcctcgggctatgtagccctcacggggaggtcctgtcttcagccccgtcaggatgacgaggattcggctgcactgactcccggctaatcactgtggatgatgctgcccgctccccctttccctgcagagccctgagctctgttcttcctgggaagagtgagggtcctggcagcaccccctcactgtagccaagcgtgctgctccaagtgagccccaggtctccggagccgggagccagccttggcctgcgtgagctttcatgcttctgaaccagagcctggcccaggggtgaaagcccagagagtctttttttgctttaaatgagcagctggggctgcccctttgttctctctcctggagtgaggagtggctgggtcagagccggcctttggtgatgtgggtctttctgtacctgtggctctggccgtctggcacacagctggggaggcagcctcgggctttgtggcctgcagacctcacagacggaagggcctcccgtcttcagtcagagactgttttttccctgcagtgaaagagtttctgcagttaactctcagggctttgctttgatatggcaagcgcttagtcagggaatggagtggcagctccaagttccggaagcttctcacagcccttctaatcccctagccggcagccacccacacttggctgtctgctggctgactggttttccaatccccgccatggtgtttctcccttccagctccggcaggcgtgattccggggcacacccactgctctcaaagcccctgagccagtgcctgggttagacttttcccaggggcgtctgctcctcatcctcttgggctttgtgcttgggttgactggcagctcggggagactggagtggccggctggatctgagtcctgtaggccagtcctggcatgtgtagacactcagtgtccctgtggcccaggagcaagcctggcaggtgacccgagggagggcgggcccagcctggtcacagaagcagtgctgtgcccgtcccggccccctgcaggggtccagggtcctgagctgagagcctcaggaatctggggaatttgctaagatgtgtgagtggctcctcctctgttttgggcacctccctggaggctggcaccaccaggggctggtgtggagacccaagggtggagggcagggcaggtgctcaccatgccgctgggccgtgtgggtgcctgggtggacgtggcactggttctttgtgcgggtggaggacagctgtccagtctgcctcaccgacagctgtggtttgcagtgtcctgtgactgcactcctgagcacacccctccacccccttgctgctgacagctgcctatggcccaggccctctcgctcccccacccgaggctgggcgcacagagctgggctgagcctgggtctatgctggccaacgggagaggcagatgggaggagcaggccagagtcccagtgacctggggtcctggtacaacgtgtacacctgggcaggtggctctagcactgtgtgccagaaccgtctgtatgaaaagagggtcacgtagctgccctttggcctggctgtgcagggaggctaaggtctaatcaccctgtagagagttgtcggctcttcaggacggtgccctgtcttcagtgaggggggctgtcattgcagtgagcggggccgcagccctccccagcagagagcactgcacttcctttgtgtggtcagacccgcatgtccagcctgtctatctggggccctgagcctgttgtgtttcttgtccaactgctctgtggccctgccacggaacacctgagccaggctgttttgctcagccctttcccatctctggaggcctctggtgtgtttttgtcctttgaagaggccgctgtgtacccgctggtgcccacagcatgcttgtttgtgatcacagggcgtgtgtgtacctgctgggcgcactgggcctgtcctctgccagctgcccggcatccccaggtgcccgggagagtggcaggagctccctgttgggccagcctcagaatgaggatgttagctggcagggggcattgtccctgcctgaaactgtgggctggattttggtcactgagtcactgaattaaggtgtggcctggaaacttcccatagctgttggctgcagtgcacgcctcgttgtccagagtgaggcaggtgttctgaatgcccacctgggagagctggggcctggggcccccacaggtcaggtggtgcccctcctgtccccgcaggtgtcggcctccctcttagaggcactgagtggctccctccgtgtgtgcggcatctctgcgtctctgaaacgtggggccctgtgcagaagggaaggtccttggtcatgtgaaccccaaggggacttcggggctgtccccagtggctcccgttggccaaagtggctcggaagcaccatctcatgtcactcacctggtagggcctcctgctctctgtgaggccaggctgtgtcacggcccctctgggctcaggcggctccatgcacagtgcacccaggggcccatgtgtcccagcctcctcctgcaggtggaggccgcagcctccctttgggccagtgactgtgacagcagtgtatgggcatgacacctgctttcaggccctcacggcagggccttgccttgtaggctgccaagtcttcctgacagacaccatttgaaggccttaattagatcaaccttacatccccgagggggcctgacacggaggtccctggttggtcccggacctccagcacagcggcgcctgcagatgagagggaagcgagatgcccctggcccaagcccagcctgggggcttcccttccagagcccaaccgcttgctccgacctgcctgtacctcccttcccccccacactattcctccctccctacagtaggactccggcaggggtgctccagagacagccacctgaagaagccaccaggatgcttgggaaggacgctgccctgggccctgcctcccgccccatggggatctttcaggcccccaccgcctgttcgcagaggcgcgtgctcctgctgaactctgtggggaccctccagcacctgagcaggggaagggggcgggggggcctcatggtgggcgggtggagggccttgttcccctctggctgtggctggggatggcccagccctgcccgcctgccaacagctttgcggtgcaggctgagctctgcagggagattagcagccgtcctgattggattggccgtgttgcagccgcggcagccaagtgtgggcccctggtctggctgctcgtggtttgatcctgagccgtttcctgctggtgatcagtagctccgagcgtcacccacagaggggctgctggagtctcactcagcaagaggctctgaggcccggccaggtgtcctctgccggcgttgctgctgctccctttggcccagcatcgcagcggggaggcaccctccctgagcgctcacgccacagcgtcaggcctcagccggccagagcagggaggacagctggtctctcccctgagatgccggggctgcctgtcccccggttggggcacagctgatggcacctgccgtccctcggtactgtcaccagtgctccctagggagggaaagagaggagccgctcagccttcctcctcaagccaggagctgctgaggtgctggctgcctccgatgtggccccacacagtgttggccgcaggccgaggggcctgggggcacaggtgccggctcaggagcctctgtgggcaggtgtctgcatctctggggtcctgggggacgtgggtcccatgcactttgggtggtgccagttggcagaagggtgggcacgtcaggcctggcagacactggtcgcagccacgcagggagatgacggccggtgctctcagggcggcctctgctcctgtttgcatcttgtagggtttggagcgagtcagtggctgagaaactctctcccaggagcaatgttccctcctggtcaataatcagtgagcacagataggcgaggctggttaggagcagaccacgcccatggcaggggtctccccctcgggcacgcgtgaggaactggaggtctgaatggcttctgtcccctgcagagcagctgtctgagggggtctgtccccggaggccaggaccctggtcagtgccatccgggtcacgggtgttcttttggccccagctgtaggagggcagcgatgcagggcccaaaccagaagccgctcctgaatccctgaccccaggatcagtgtgaaacaaagcccacgacccaaggaccccgcagtcagcagccgcacagacggagccagcactggagcccgtctcaggtggctccgctcttgtgtcccctgtccccgcttccctgccctggggagggtgcccccaagcctggtactgcagagaaggccacctcggtggctccttggttgtgacatgaagtcctgcgggagggcctggggggactccggtcccagggaggtgtctttctcaggatggggggccatatctggttgccagtgtctctgtccagccttgcgttcctggctgtgggaggtgccagtgggttcccttgcccacagtgtctgtgaccgttgtcccagacatgctcctgtgtgcccgctgccgagctccagctgctccaggctcctccactccccagtcacacatttgacgacttgtctggcactgggccccgtagaaacagacaggacagggtctcagcagccccaggggtgatcccggtggcaggggctgggcttagaaggatgcgctgggtcctccggctgtccccactgtgcttgtttgtttaaacgtctgaagggcaaacggcagagcatcaacttctggtagctccgaatggtgggtccacgggcattcgtgacggtctcctaggtacagtttatacattggaagcatttttgtaattgttaccagcagtcacatgcaggcggtcacatcactgcagggccaactggactgtgtcccgggcagagactgaacacgtgcacacacccagccagagcacgcacgcgggcacagatagtcctggatccaagtaccgaggggcggcgctcatgccatctccatggagtgctggaggggtgacagggagagtggcccctggcaaggtggtcagagaggctggggagtggtccacggggcggccggtctgaactgcccacctggcttctcggcggcccccgctcatgccatgggactctgggcagctggggtccagggctggcttcaaggacgcctgctgggagttctcgagtctgttccctgcctctgcagtagccccttccttttcgggaggtgtagtctgcgaggcccctggaaaagcctggcggggggcgtggttctccatccatggcagctccctctgcccactcgggggactctcccccgccaggactgtccactcacgagctcagtctggccagtacgttcctaggcaaggttcagttcgcctcccagccttcctcggtggacacctctggtctcgccggtcacgtgggagccatgcccagggcaccttgggaggatgctgtgccgtgggacctgaacaggcagcagaggtgaccagggtctttggagatgcacttgttgtacccaggaagattggagggttttttgttttcttggttttttgttgttgttgttgtcttttccccctttttggagacagagtctcactctgtcactcaggctagagtgtggtggcgcagtcatacatagctcattgcagcctcctgggctcaagcgatcctcccacctcagcttctgagtagccaggactacaggtgtgtgctgtcacgcctgtatactttctaaactttttgtagagacaagagcttgctttgttgcccaggctggtctcgaactcctggactcaagtgatcctcctatctcggcctcccaaagtgctgggattacaggcgcgagccaccgtgcctggccagaggttggtcttgcaaggcaaatttgcccatgaagaaaggaacaggccctgctccaagctgtggcctgggtctgccctccacactgagcggacgtccaggcagccttcgggctgggtattgaatgtgctctgccgggcaaccttggtcacttgtggccaaaagggaggtggaaatgtggaaagaaacccctctgccccgtcagaccttaaacctccttgcggacactgggcaaaggaagaggcaaaaggtgctttggagggaggagagaggcacagggagggttgctgcagaggggttcctagtggacgcgggggcaggagaaggccctggcgtgcctgtcccgctgcagctgtgggagctgggcttggccaggtcgctcaacccgtggggagaaggtgtcgggttagctcagcccccgcagagcctcatctccacccctgtgtgtcacgtaggggccctctgcagcctccactccagccaccccgggtggatggccgctgacccgggagcccccgtctgcctgggacgctgggagtgtgtgagcagatttggtgccagaggcccgggcaggcctgagggtccttgatcccagcgtgatggtgcgttgctggtccagggcccatccttggagccggcgggttggagtggtggctcaggacagtgggggtggatgacagaaggcagcctcggcctctgctctccctccacccccatgtccaagatctgaatgctgacccagccttgacaccaaggtggctctttggacttgcttggtttcagaactgtgtgtggggaagcagcgtcagctaccgtcatcaccatggcaacacagacattgattttttttttttcccccattggttacccgctggccacattccatttttgccttttttgtaggtgggagaagaactctgcttctcccaaggagaagctggtggctggagggcagcagagagaaggggcgggattgggagtcacccccgaggtggcgtccttgggctttgggtcagcactggatctggtcccctggcccctgtgggggctctgatagcaagatgtcctgtcagccccctggccatctgtccttccccgtgatgagggcgctctgttcgagccctgcccaggtgggtggtgatgagctctcgaggtgcctttgggctctggaagccaccaggataattgagagttgtggatagctacttcagaaggctctggaaggtgatgcatgctcacagccagcttggagcagctgacctctcgcacagagcccctcttccaccagcagagaaaggagaagagttccagtgcctccggaagcaacagaaatatccaggaaacgagtgtttctgtgccctcagtgtccactggccaaaaagagcaccctgaccactcggtagcagcgcccgtccgtccctgagcctctgtttgagggactcacgtccagctcccggcagactcagcgcgggggtcggatgccttctccgcaccatcccgcaccgccacgagctgctgtggctcacattctgccatccgagctctgtccaggaggcagccgagaattggagcagttcccacgccaagtagggccttgtgggtggccggtcccctcctccagcgtggcacggaggcgccggagcatgcaggtctatgcctctgcagagtctggggcatcttgttccatttccttgctgcctctcctctcgtccgtgatcatccccccctccccctctgcttccggcctccccggccttcccagtctcttgggccatcatcgtggttgtgttggtcctgttgctcctccttcgagcgcccacgtagggctggggttccctgcgggctgtgggtgccgtgccctccccggctggctccagccctcagaagcttggggagggtgggctgggccatctgcattccacctgcccaagggctgccactcccttttcccagatggctggagtgccccagggcagcgttgggagacctgcgcaggccccacctcagtccacaacaatgttccttgattccctccggcttcctgctccttcacctcctcctgcgcagcccggcctgacccatgtaatcagggaacaggaggggctctcctcagtgtccctatgtccatgccttgtggccacctgagcacttctcagggtccagtggaaaactctcctgccctgtttgacgcccacactcgtcagtttcaccttggtgccaagagcagacgatctgctccaggccccacttgggccacagcctcacagccgtctccacgtccccacccgaacctggcatttcctgaattcctggcccctgtccgagaaggaggctaaccctcctgggagagctctggcaggtgctgacccaagtccgtggggtcttcaacctttgcagacacctgcgcccagaggccacgcctcccactctgagcacaggcgggcggacgctgtctggcaggctctgcctttctttcatttttcctgacctcttcgcccagcgtcctctgcttggaggtgggtgtatgagaaggggccattggtgtcagagtggggctgtctgctgagcaggtgaacacacccccagtccttgctctggggccgggctgtcccgtgggcctcacggacctcattgtctgtggtcatgagcctgcatcttactgatttaatcccgggtgccgggtacaaacatgcacgcttccctgatgagaaaatggcatctggcctggagccccttcccacagccctgggtattgggtgcctgtcacctccaggatgacccccagccagcagacaggtagcaggtggagggtacctgctctggggccctggtggccccagtgggttgaagctctcttcgtaggtggcgtggggccttctgtccccatgaccctccagcggcccctccccatgccagggctcagcacccctgctcctcagagatcgaagcctccttctcggaccttccccaccactgtggtcccagcttcctgtgcagtctcttggttacccaggagttcagaacttttaccacctggggtgcctttcagatactcggacctcttggtttgtaggagtaccaggccggggtggggaggtggaggctgtgctgctcccctcaccctgggctcagccagggccgccagccttcttcctgggagcagtcaccaagctggtctcgggccgtgctttggtagaaatgatcttttaactgactaagcagagtgttaactgaaatcatcatgaaatgctgtttatgctccatttgggattcggagtcaagcatttggggaccctcgggcagggtctgagctgctgtttgccctcgcagatgaggacgacgatctgcacagatctgcctccaaccctgggctgagagcatccgaggcccaggctcttccctcccccagtctttttcactgtctctgagattcacgctctctctcaggttcttgtcactcgcagactataagaacacgttgtattttctggagtaaaaaaaggcacaaatctttaaaatgtcactgttgtgaaagccgaagtgtgaggggctcttctaggttaaaggactaaagatgcccagcgccccagaggaagggtgagagtcctctgggagctggcaggcgccagttccttgtcgctcacggttaagcccgtgtatcacttatttgtctcaagtgcttatggagcagtcttccaataggtggaatgctgatttgttttcctaaaatgagagagactaaagccacgtgccaacgcaacacagcgggacccttgatgagaacctggatcagggaggagcttgtcaatggcatcgtcgggccattcaggagcatggtgtgtgctgttgatgagaggaggatgcgtctgtggtaaccttcctgtgtgtcacaatggaggcgtgatgaggcagagaaggtccttgctcttaggacacagctgcagtattgggggcaggggcagcatcacattgtctgatgtctgcagttgagtctcaaggggctgaaaaaagtgcctgtgtgtctgtgtgcatgcatggatacgtgtgagtgccggtgtgtgtgcatgcacggatacgtgtgagtgtgcgtgcactggtacatgtgtcactgtgtgtgcgtgcacggatacgtgagtgctggtgtgcgtgcatggatgcgtgtgagtacgtgtgtgtatgcacaaatacatgtgagtgccagtgtgtgtgcatgcacggatacatgtgaatgcctgtgtctgtgcgtgcatggatgcgtacgagttgcctgtgtgtgtgcacgtgcacagatgtgtgagtgcctgttcgtgtgcgtgcatggatgtgtgagtgcctgtgtgtgcgtgcacggatgcgtgagtgcctgtgtgcgtgcacggatgcgttgagtgcctctgtgtctgcgtgcacggatgcgtatgagtgcctgtgtgtgtgcatgcacggatgcgtgtctgtgcgtctgtgtgcgtgcacagatgcgtgtgagtgcctgtgtgtgtgcacggatgcataagtgcctgtgtgtctgtgtgcatgtacggatgcgtgtgagtgcatgtgggtgtacctatacatcacagaaagagtggtgaagcgattgtggcaaagcacaccgccagggaacctcggcgaagtgaatgggtgtttgctctgctatccctgcaacttctctccaggttggaaaggttgggctgggaagagaataatgtagttctgttttctaaaccacagggaagaatgggcttggcaaagccatgactgacagtgctttctgtctccttcaccttcccactgtgttgagccagagccattcgtgggaacccctgggtgtggttgtgaagccagcctcggctcagctcacccacagagctgtctccagccacatttgcattccggctgtgcccacatttggcattgggggaaacttcctggtgcctgtgatttcaagccggcggccaggtctgcgcctgtgctgggtctggggcatcttgtggcacttccttgctgccctctctcttccgggaccatcctcacctccctccccatcccttcccctgtgcttctggtctccccagccctcccagtctcctgggctcagcagatgaccacccagggcatccccggtttggcctcaatctttgaatcgtgtgaagcgatcggaaggagctcggccgtcgcctcaagtgggccgccttccggtgggctcccttcctgtgggccgcttgcatgccgtgctgtcttcagggatgagcagttaatccttctcgttcatctgctcactagacgcggctgtgtcagagcagtgcctgcctccttgtggccctaaccttgtggggtgctcctttgagagcgtcctgagtgaccctctccaaggaccctacctccacctgtccaccagccctccttgcctttaaccctttcagtgctacgcgtatcaccacactccctctgtgcccttctcccccaggtaggggccacttagaacactatggcagcctttggtgggcctcaagtcctgctcctcccctccgtgggcacattggggcccccagtactgcccagcctttgcactggccagccacaggctccatatgaggccagctgggcactgccatctctgtcctggcacggaggttctgccagggtctgtgtatacttttttgggtctgctgggaattttttttttttttttgtagtggtgatgaataaaatgcataacgcagagaagcagaagtgcctgcacccgggtgttccctcttgctagtaatcctgaggtttggtagaagccagctcctgctggggtcaggggcagtgaggcaggggctccccagagtacagcctgagaggcctggctgcttggctggggggagtgccgagtctcaggtcctgccgggaggcacagtccttccagaatcaatccctgttaccatctgcagcttaactcattttaagcttaaccatctgcagcttaactcattcttgctttatcttccctgtggaccaggtctagcctggggcagacaggagatggcagatggacacctgggaggggctcactgagctccgcctctccatcaacggaggccccgtctaggttgtggaggatgcttgagagagccctgatgttctgacctcccaaaaggtcaagggtgctggcagccggtgagacgccgcagtttgctctgctccccggggctgtgcttgccaggagacatttcggctataagcaggcgagaatacctccagaacacacatcaggaagacagatggtgtgcaggtggggctcagggctgtcatcccctgaagctgcttctgaaagagctgttcttgcagcagcactgttacaaaaggccacatgggaaacagcccgcacctctcagtggatgccggcagaaacgcctcgtgtatccatagggtgaagttgtattcaaccacaaaggacaggctgggtgtggctcatacctgtaatcccagcactttgggagtccacttgatcccaggagttcaagaccagcctgggcaacatagtgagaccccatgtctacaaaagtatcttaaaaatgatctgggcatggtggcacacccctgtagtcccagctcctcgagaggctggggccggaggatccctcgaacccaggagttggaggcagcagtgagccatgattgtggcacttcactccagcctggtgacagagtgagacccctggctctaaaaagacaagaaggagactctgaggcaggctgcaccatggatggagcttgaagacattgtgcccagggagaaaagccaaatgtagagggtcatgtgtgattgcagtgattgaagtgttgggaataggccgctccacagagatgccgtgagactggttcccggagctagggggcaactcctggtgggcgtgggtttctcttcggggtgatgaaagtgtccgggcagtcagctagctcaactggtgagcgcatgatgctgacgatgccacagttgtggactcgatccccacaccggccacagtcccaatttcttagccgggcatggcagctcacgcctgtaatcccagcactttgggaggacggggtgggtggatcacctgaggtcaggagtttgagaccagcctggccaacacggtgaaacccccgtccctgctaaaaatacaaaaattagctgggcgtggtggcgcacatctgcagtcccagctactcgggaggctgaggcaggataatcacttgaacccgggaggcggaggttgcagtgagccgagatagtgccactgtacttcagcctgggtgacagagactctgtctcaaaaaaaaaaaaaagtaaaaatggtgaattttatgttatgtgaatttttctcaattttaaaaaaagagcctaatgctgggaggacggatgcttgggcttcccgcccgtcctgaggctggtggtgctgagtatgcgggtggctgtgggagcgggtgccgtctcaggtgcgagccagacaccgtgggtgcgggtgcaggtgtgggtaccgttttgggtgggagccgggcgctgtgggtgcaggttccacctcggagctgggtgctgtgggcacaggtgcgggtgccatcttgggtgggagccaggcactgtgggtgccagtgccatcttagatctgggcactctgggtgcaggtgccatctcggagctggatgctgtgggtgcgggtgccgtattgggtgggagccggacgctgtgggtgcaggttccacctcggagctgggtgctgtgggcacaggtgcgggtgccatcttgggtgggagccaggcactgtgggtgccagtgccatcttagatctgggcactctgggtgccggtgcgggtgtcgtcttgggtgggagccgggcactgtgggtgcaggtgccatctcggagctggatgctgtgggtgcgggtgccgtattgggtgggagccggatgctgtgggtgcaggttccacctcggagctgggtgctgtgggtacgggtgccgtattgggtgggagccaggcgctgtgggtgcaggttccacctcggagctggatgcagtgggtgcgggtgccgtattgggtgggagccgggcgctgtgggtgcaggttccacctcggagctgggtgctgtgggtgcgggtgccgtattgggtgggagccgggcgctgtgggtgcaggtgccatctcggagctgggtgctatgggtgcgggtgccgtattgggtgggagccgggcgctgtgggtgcaggtgccatctcggagctgggtgctgtggtgcgggtgccgtattgggtgggagccgggcgctgtgggtgcaggtgccatctccgagctgggtgctgtgggtgcgggtgccgtattgggtgggagccgggctctgtgggtgcaggtgccatctccgagctgggtgctgtgggtgcgggtgctgtctcgggtgggagctgggcgtgtttgcggctgttggtgtcatctcgggtgggagctgggcgtctgccttcctgtactgcagcctccgctcctctctggctgtgctctctgctgctccaggctggcagcagatcttgaggatgcagcctctggaagctctcagggctcctgagttttggggtgtttgacctccagcctgctcagccccgagtcacctttgagctgtgggggtgtcaggtctctcccctgcaaagtggggtgatagtcccatgctggttggggtaagacctggggggagtgagaccaggctcagcctgcaggagagatggagggcagttgtggggtctcaccgatctctgctgggattccagaaaggagctggggactcagcagatggaaagggccctctccgccaggtgctgcgcccaagcagaaccaacccgaggacagaaagatgctggccgggcatgcctggggcctgggttcctcagcctcacctgactcaggtgctgttttccttgctggggagcaggggcccagccggggtcttgaggcagccctgtccccatcagctgcgctcagacctgtccacaggaggctgggctccctggtcacaggcagtcccgtggagcgggtttcactcttagcctggcgaccgccccgtctgaggtggaggtagagctggtggggtgaggcccacggtgaccccagtgtggaccggctgctgcttcactcatcacggtgcattggtaggtggttgaaaagagagaggcctcgttttcaggatgactgtgtagacacatcacccgtgacacccatgtgtgccccctttctagccctccgatgctcctcctcctcctcactccccagcatccctaggcagccctgggctggtggggtgagctgcccagagttggctgacccatcagcctgggtgcaacgctgctgcactcccacacctacatcctgaggcgtggccacctgctttccatcacccccaacaccccagatccccggatccttctgatggcgacggctctgccggtctgttctggctcatgtgctgtgtgccctggcccgctggcactcagcttacatttgaacctcgtctttagagttaaggtcccacctgtgctgtggaccagacgtgggcctcccagtgagtggggggcatctgataggtgaggctgcttaggaagcctggcacaccctgtccctcagcagggtgggcctgggtaagtctgcccgccgcatgggagggagtgtggagagatgaagagatgagggagcccgagaacgcatggcctcacgtctcaccccaagggaggctctcaacggctgtggagccctcgctactccgtcttcaggcccctgaaggacacaggcaaccgcggacaagacttagttgctcagcggaactcactgcccctaccggtgcctctcactgctgatcttagggtcttggcattccttaggggcctggtgctccatgtgccccgtccttccagctggcacctcgggggttaagcgctggtggctgcacacactcatgctcccggctggggcgcctgcggcaccctgggggttaagtgctggtggccggacacattcacactccatgcccacgtggtttcctgcagctgcctgtaaggtgcagtttaaaaattcaaggcatgggatgattttgtgcagccgccgctcgaagctcagggcgggcacacgcctggtctgtgcagctttgcctggacctcccctgtgtgtgcgccagccgcacattgtggggctgggggctcgggctggcggggatgctggggtgcacatttgagtgctgcagctgcacgggcgggtggtgatgaccgtcacctggccagaaccccctgagaagctccacatactctttttctttttggattcagcagtccctttttcaaaggatttgttgttggctgttgtcttccagatgttcctcttgactccattgtgtgtagccttttaggggaacacgtgcttgttatctggtcttgacattcacttataatttggggctgcagaatgtggcgggaaccaggcacggtgctgcatgcctttgctcccagctacttgggaggctgaggtgggaggatcacagaaacctaggagttggagaccagcctgggtgacatagtgagaccccatctcaaaaaataaaaaaaatgggatatggcaagagccgtgaagagttcagctgagttgtcttgggccttttgcttcacctctttgtgaacttgctggcccccacgccaggatagggggccggcgacctcgcaaaggctgggtgcgtgtggacactccggggctgagggagcactggccagggcacaggcttgggtgggttccccctctcaggccagaccttgtgcctgttgtcacctgccaccccaactcggctgaagccagttcccagtgtccaaggggcccgagagctgggaggtggatccaggatcctcagtcacaggaacaccatgaaaaccgcaggacagttccctggaggcttcctgagcccagaggtcgtggtgtccatcctgggaatttataggatgccaaagaacgccgagaagcacgaggagccctggagctgcctcccccggggtcccaccgtctcaggcttcctgatcctgctcctcagcacagggcagtctgcccccggcctgaagcttcctgcgtctgctgtccttggctcgtaggatggtgtcctgccaggctggcagcatcttggccacccagggtggatggtggaggggccacgtggctgtgggcctgtgccagccctagctggggttccctctcttgtggggtctgtgctgctggccgtgctcccgtctcctcccctgccctgggcagcgcctgctcacgtccaagtggcttcccttcagccaggctcctttataccaaattctgtcctctttgtccttgatcccttccctgcacaccttgaaccctaggtcgagtgagcctggggtagggcccatgtcctctcctgccgaggctggtaaaccttagacttgcccccaccccacccgtctgtgtggtttgccgctgatccccagaggtctcgacttcatcccgaccgtgagaggccaccgcagtggtgcagctccctcctgaccgcagtgcagccccagggggccatcgctgggccctgccccactccacagggccacacagcagggaccaggcagtcacacccatggttggagccggtggaagtgatttccaggcaggggcaggcccctgggccagggctggggctggcatccgtggaggtactgggtgtgccagggcgcgtcttaggtggtttgtgtgtggcagggcctgggctctggggtctgtgtctgcctgtcctgctccctcctggccccggggccagcgtggtcctggagactgatccagcatgacctacctgtcgtccccgtgagccctgtggttgtggccagagtgggtagcggcatccagggcggctgtgagagtggagggagactcgggtcacggccaggcacacacagccacacacacatgctcacccgcataagcacacccgtgtacggttcacgcttgtgcgtgcccactcacataggtagacatgcacgcacatatgtgctcatgcccgcacacatatgtgatacctccccggggtctgcagtgctgctttcctcacgctgaatccctcttcacggtggccaggcccaggcatgtcatcttcgcaggcagagggtgagcaactgtgtgccaggcagcccttccgtatcttcccagaaagggaagccaagcccggggctctgtgcgtcccccacccctgccctgcggtggatgggatcctgccagccctgggcactgttctctggagaagcagccaggcctagcactacttttagcgggacacgtgtcacaggagccaggtgactgtcacctctgggtcccctcaggggtgcatgaatccctttcctcttctccctccacagaaatctgtgcccctgacacggagcgttcggctttgggaacaggcctagcagttgccagcatgagggcgggaatgacttgggagtctgggtggccaggaggtgcctgagatgcctgggatagctcgagaggcagccctgtgtgtgctgacccgggaggagggcatggctgtgaggtggaggctggcacaggcggttgggccctggctttgcggccactcaccagccgctgacgtggcctactctgtctgctcatctgggcggccttgtgggttgtgctgattaaagggaggtacatctgtgaagcacctggccctggtcagtgctcagagggtctgtggtcatggtgagaagaaccccgcagctcctggaagggcgagaggacccggagaggcttcctctgccagactcagctgtgctttgaggaggggaagtgacccaaggccagcccagccgtggtcctgggaggcagcatcgcccggttagggcttcctgcgtgtcaccgggggccttgctctggtttctggctgaacttgttgggcactgggcgatcctagtgggggttctgctcgctggagcgagaggaccctctggggcgtgggaccggcggtggcctggacgtcagcagaggaggaaagtcctgcttcaggcagccattcagggagggacaggaatcacccgagagtgacctgccagcagcaggggcggccctcctgctctgtttgtgtccgcagcacgtggtcagtgcctggcactggaaacagtagctcagcaaatatttgtccgtcaaaggagtacgggggccggaccacccagttccggcccctcctctgcagaccaggaaatggagccatttgccgcaggggtgggtctctcgtaccaactccagggttagcgggaggacagccctgaggggctgtggcatgcttctgtcccatgtggtgctgatggggggtgggtctcgggctctgctgatgagtatcagggctgggtcctggaacccaggctggctgcactctgggggcgcttctggggacggctagccagccccctgggctgatggtgtggtcgcacctgctggccttggcggtcatgtctcaaatgggatcacagctccgagggagctttggcagaggaaggtgggaaacatctgggtgaaaaggaagtgggccgtgctcctgtgtcttcgaggcctcggcccctcagctcctctctctgtgcccctctctttggtggaagcaggtagggatgcagcaatgtggtgaggcccttacagagtgggggactcagacccacatcagggtagcccagacacctgcgcccctggggctgcccccccgcaggtggacttgagccgggtctcgttgatgtccaggctgcaaaaggcctctgacggcgcttaccctgtgccgccacgattttgatttcttaatctgcattttgcacacgggccgaggagacatcagtgtccccaagcgctgcccgtgtgtccccagggccctcagcgatggcaaggcgagcccaggccagcgtgcaccagggtggctgcctggtgagcctatcccatggggccaggtctcctcagaccaccgcgctcctctggggctcaaagcggagatgttgggtgaaggtctcagaggtgctgtgggtctgcagcctgggtagtgaggtgtcttggagtcagagaggcttgtgaccagcgtgtgcccatgggtgtcccccagaggaggtttgtgcgctgtggtgtggggtcagcagactgtccacctggcctgaggtaggaggttcggagctcttgggtctctgcgaacgacagccggatgcgtatgaggacgcgtgtttgcgctcactgtcactcactgtcacgcctggggtgaagcacacacgggctcttcctgtctctcgcctttgcagagactcaagttccctcccaaagatgccaggcgtgctgtgcatttgaggtctggagtcccttctcattctagaattttctgtttccttttggtgtcccctctccgccctcccttctggccctgacaccccgggggccctgctgcctgtggtcacagggcttccctgggtggctgtcagcccagagtgggatgacggtggtgactgcgagcacctgactccctccccttccttctgctgttctgcttcccaggagacgttctcttccagatggctgaagtccacaggcagatccagaatcagctggaagaaatggtgagtccacccccagcgtggccctgcgaggaggggcaggtgcgacgggagagctggcgccacaccttggccgtgtgtccacttgggaacagtcccagttgtccagccacactcggaggcagggagggaccctggctcagcacacaagccacactcgaaggaggacgtcggagaaaagggcacaggccagaccgcggccgcatgtttcactggctgcagtggcagccatgacacgctgggctccagggagagtcctgatcgcagccccagccagaccccactcctggggttcacaaggttgcaaggcacacttcccctggcctctccgactgtaggcagaggcagaccccacacaaccagagcacgttgctggcggctggtttgcagcatcctgtctaaagccaggggtctgaccctggtgtcagttcaggcccatgggccctgcgacctctcagcctgtgtcgcagtgatccccagcatgggacagcagaggaaggaggggatggccgtttgtttcccttgtggctgtttggaggcgagattgtccgacgttccagactcctgttcagcactcgctcctggctccagagggtgcacacgggcatgcggggccacagctcatcagtcagggggagggggcccctcctgcacagccgggacacccggtgtctcgtgcccatccgctctagccctgccctgcctcctgttccgggtccatgtgttggagctgacggctgatgtgttttctctccatgtccagctgaagtcttttcacaacgagctgcttacgcagctggagcagaaggtggagctggactccaggtatctgagtgtaagtgcaccctggccgtgcctgctgggccctgtgcctgggctccggctctcccaaatgcctgccactccttcctcggcctgaaggcttcccacttccccgagctccccgtccacatgggccccagctctgactttattgtccatttgggaccgagtgcccctggtgtgccccaaatgcaacctgtgggtgaatccgttgcctctgacgccccacatgcctggttccatgccccggctttggccacttgcggtgaagctggtgcctgactctgctgccggggagtgcaggagctccttctctggcctctgcagttccctgggctctcggcccgtcctgccccaccgccactcctgtccgctggcaggaaggcttggggctgaggcactgcttgagggtttgagggtcacctctggctctcagtggtgggcgggaggggtgggcctcggccactttttccaagtgtgattttcatcttgggcgaccagagagctgctatggggttgggtggggtcgggctgaggcttcatttgggctctccccaactctgatttgcagctgagcatgcacggccagagagcgagccaggaagggagtggcagggctggcaaggggaccccgttgcgttgggctcatgggcctcggttttgctgccagtggtccgcgctgcgttgggttcatgggccttggttttgtgttttattgtttgaatctcaggctgcgctgaagaaataccagactgagcaaaggagcaaaggcgacgccctggacaagtgtcaggctgagctgaagaagcttcggaagaagagccagggcagcaagaatcctcagaagtactcggacaaggagctgcaggtaggcccgccacccccgctgtggtgcctctcctgccaccttgggactgctcacccctcggcccccctcgtccacagggagtggacagcagccccccaggtgcgatcagacagaggcaggctgtgtgtccctggtagacctcgggagcggtgggcctgacgcccccaggccggtgggatggtcggctcacctgtggggctctgtcctgctcttgcagcctcccagggtcactgaaaggttcttggctgaaggagcagaaacctaaatggagtcctcccctctgttctccccatccctgcccgggagtccggtcccagtttgttcctctaagcggtcgtggcctccgcctgcagggctggccactcgagggaaggtggtacttcaggttcctcgagggagcggcttcggtgttgtttctctcaccgtcccgccggcgtcaccggtgctgcgtgctgagtgggctgggacgtaggaaggcctggccgatgacaggcacggcctgatgtgtgtacaccagaacctggatggtggctgacacaggccagacccagaaacccctcgcccacttgctggggtcatagtgatacagaagagaaagaaacacaaaacaagatgcccagtcgtgtgtaaaggaaacatcaggaaaacccctggccagtcacccaggtagaagcttctgggctgcaccctggggtgggcaaggtgtggctgtgggtgaagcccgggcctccaggccgcacccttcctgctggcagtcaggttttcaagccttggcaagccccgcacacacctgcccgtgtgcgtgtgtctgcgtgtgtgtgtgcgaccgtctccttggtgccggatgtgggtgctcatgagtggctgtggcctcgccctgggactgggaggccggttcctgctcagagcctgtgcccccgctccctgcttaactgcagggaagccaagcaggtctgcccacaccctgcagaccaagccagaagatttccagtgtggggtcgcctggtggagctggatcggccccaaaggagaggacgggactaggccaggggcagatgagaaggataagtgagagtctgtggaaacagccatacgggggagctgggggtccctcgggtgcccgctgctgtttgcagcctcccactcaggcatgcttggtgcacagttgcagggacgcaactcaggccgttctctagggtgccctgccctctccagccacctcttcccgtgtccccagcctttgttttgatcctgtttttcactccaggtaagctgtgatgggtcttttgatcctttccgttttgcactccgggtaagctgccatcatgggtctttctatgatgggcccatcatggtggccttagtattcctgcctgaggctgctgcagcgagccgtcctcaagctgtttctgtgaacagaacctgagcagtgggcatggggagttgaggaggagaaataggtatatgttggtagacactgtgtctgtttttcttcttcctcccaccgtggaacgttttgctactttgctttctgaagacaagcagcggacggcacccctgcggcctggagggccatagccgcctccgagcaggtcaggacagtgcaggtgtgagccagccctgagcaccgaggccaggtgtgagagcttgtcttaagggggactttcctgggaatgtccccagcttggtgttctggggatggggatactgaggccagttcactgagggctcagctgcctgctgggggtccaggagcttgagctcccttctgccctcgaggctctgtgggtttttgctaacagcgtttttgagatataattcacatcaccagcagttcaccatttcacgggcacagtccagtggttatgagtgtttgcagctgtgtgtccatcactcagtccgttttagagcatttttcaatcagcagtcactcctgggcccctggccccaccagtcaccagcctgccattggcctccgtagacttgcctgttatggacattctgcgtagctggaatcccacagtgtccggcctttggtgcctggtggctcacgtggcacggagggttcttaaagctcatcgtgccgtagcctgcgccagcctcctcccctcttactgtcgggggtcagcctttcttccttttcatggctaaatcgtgttccatcgtgtgggtaccggaggctccatcctgctcagggccagggccgtctccctggcacggccggtactgccctgtggctgagctcgctgggagctggagatcgcggcggggtagcatagggccggacaaaggcagaggctgggggctgtcggagccactccccctccctcctgcaggctggagccagaggcctgaggcccccacgcagtcactgtggccctgccgcaccagctccctggttttcaggtgccctgcctcccactgccaggcctcttcaggagggccctgaccgcacacctggcctctgcctgccctccgcgctgctctgccgtgggccccgggtggtgggatttactcccgaggctgtgtgtgcacagctagctcctcaagcccatcccacacaggggttttggaagaccttctccttgctgatggctggtctgtctgtttgctgcatgtcctggcacttttgaggtctgttgggggaccatgttggtgcctcaggggccctggaggcaggtcccatctgttcttctcatgggggctgtgagccacctccagtgcctcggtggacccttcgttgactggcccaagggtcacctgattcgcagccacagggggctggacctggcggtgactcgaggggccttggccctgcctcagtgctgtggtccacggtctgggcaaggggccgctgctgggtgccccaggggctgactgaaccatttggcaacagaactaaggtggctggtggctgggcccgtcctggggccccttgagtgccctttcgtggtaagccaggtgacccagttttgggagtaagccacagcacctgtttcccaacggctgccacagtcgtcacaaagcccccctcgtccgcaggagggcaggcggagggggagagggagggggtcgtggccttacaggctgtctgcgtcctgatgggccagaccccggagcccggcagggtcaggaatgagggcagcattcccatctgtggctgctagttgccgaggcaaatggtccccctagcacctgtgagtgggtctgggcggggaccatgtgggcggagagggcaggcagggccccgaagcgcatggtaggtggaggttgcagtgggtgtgaggtgagggtggcccagcagcccccttggaaaggcctctgccacccggtacagagacgcttggcgagcctcatcttctcggcctcccagggcccctcctgggagatgtgtggtgctggtctttcttcccaggtcccaggggccctgctgtggctccccagccctggctgagcagcctcctttctctagaacttgcagctgctcctccccactcaccaggggacctgtgggtggccccaggctggactgtccccacctgggcacagcctcaaggccctggtgtcaggcttaggcttggatctggctctgtcccttatgggtcatgtggccgcagcaagccccagagcttctctgagcctcagtttccccatttgtgagggggaatatcctggctttctccctcttctgagcactgacgggaagggctgtagagccaggatgagccgacatcaaccttctcacggtgcctgcgtgggggctctcctggacggacctccgcctctgctcctccccatccgcctccttcctctgtcaatgggagacggggcttcaactcttaaccacacaggtgttttatttttgtggtttttcccaagtcaccgagtttcttcaggaagggctaggtctcatttctcctgcgtcccacttggtgccaagcacaagctggtcacgcagcagatagctagtaagtgctaagtggtttcgaaacaacattttggggtgggaaacagagggagccacaccccggtgtgctttctgctccccagtggcctggaagcccaggaggccaggcctcggagccgtcagcatccccagccccacatcggagtttgagggggtggggcacttggtatgtggctgcgtacgcgccccccgagctgcggggaggctgcggccaccatcctggggtgagtgccatgtggctgcctggctgggatgtgctgccggcctcgctgctccaggccccttgccccacccagggctgttcctgctggttcccattgcctttgcaaacccggccagcgggctctgtgggacttctactttagggtgtggccgctgggggcccagctgttgcatgtcctctccacttctgaagagaggaagcaccctgggctggggaactgggctggctggccccgcctactcatgtgcagccccgcccctccagtgcattccaccccgcccccacttgtgtggacccgcccccacttgtgtgccccgacttgtgtggtgcaggaggccctgcccttgcttgtgtggccccaccccttggtgcaggaggccccgtccctccagtgcaccccacccccatttatgtggccccaccccaccccaccccaccccacaggcctcctagctgtccctaactcctggcttgcctcgcggggtctactgtcctggggcctaggttgtcagcgaagtcctgctggttgcagggaaagggcctgctggaagtactcttgggggaagcagagacctcttcaccggcctctccattcctaaagcggttggttgcttcccagctgttctacagaccagcccagcagctgcaccctatgctgggggcagcccgggggtgtctacgcagagagtatagttcacggtgcccccttgagatccctgcctcggtccctggacctgcctgcccccagctcttctagctgtctccagtgtatgccctgtggggtcactggcgaccatagcagttgtccccaatcctgaagaccctgagagaggcaggtgtgcccacacgtcgttggagtgcagggcaggagtctggcccattcgggctcctggggctgctttcttgagcgggcaggagggggctgccggactgccggaagtggaagtgaccccacgcaagggtggcctgaagccagtgtccagccaggggcgtgagtagcagagaagcagatgcctccctgcggttcccaagctgcccctgccacagaggcctttcccttggagaccctttagtgcctctggggtctctggccctgcatgtccctcacctggcagcctagagctggccggggcctggctggtggtgcagccatgtgggtggtgcatgcaggtggaggctgttcaggcagctccacgggctggacgggcgcccccatctacagggccccccacctcagctgccgctgatgaaggggaggtggtggctggtgcctgactctggtctttgggggtgtagcatgctgtgtcattgtcagatgtgggttccctcagcgacccaagagctgggtgtctcgaagtgattgccggggtctccagtgggctcagaaacctggcgccagctgcaccccacctgagctgcatgtatgcggagcaccaggctcctgggagctgtgaggctgctgggcagcgaggctgggcccatggcacgtgtgaggggcggcttcatgctccagggtgcctacgaggccgaggcccccgatgcgcactgcccgcctccactgccgggctcattgtgtggcagcggccaggccttcagcctgagctgaaacagggacacaccacaccaggccctgggggcagaggtggggctgcagggaggggtgggcgtgaggttggccaggccctgccccagagaggcaggcagagtggatttctctgtctgcctgccagggtgcccttgagcggggctgggcccgggggcctcctgttgttcaagaactgcttgtaattgagatggtgttttgggatttccatgaaaagaagtaattttagttataggtcagggcactggggctaggaagcatttggggtgtttgttaactaggacgggagagctttacgtaaggggcccggcccggagcaccgccctgacggccttgggcagcggcaccttcactccccaggaccgtggtcgttgccacatttgctgggccaggtgctgacagacgtgcccgtctgcctggagggaatgttctccacaccacgcggggcacggtggacatgctggggcaggggacaccttctctgtgggtttatcagtgtgtccgcggggcgtggtcacagcctggtccagctcctccttagaacagaggggtgtggctgtgtccacagggcccggaatggggctgagagcagagcccagcctgtgcccaccgctcgggggcagggagcagggcccgggggacgtgtccacatgccccatcctgcatctggaacccagggtgggaggcgagtggcccacccactccctgggctgggctgggctgggctgggctgggctgggctgggctgggctgggctgtgggcacgaggacctgagtgtgaggagggagccccggcccgctggatgcaacttgtccttcctaacccatgtgcactgagggtggggcagccgggcccctgctcagaatcgcactgggcatgggctcgacttgctggccctgggacgaccctgctcagccagctctggaggcttcctcagcggcctgaaactcctgctgcagaggagggtagcattgccctgtccactcaccacctcctggggcttttctggacagagatgcccggggctacaaggagagccagggtttctgctgggttaccttcccctgttccctttctgagatgatgggggaggagggaggtgaggcaggtgcagccctcgctggccggtcgtgagtgaggagggagagatggccccgcatccctggggatgctgcctcccagagaccatgggggctccgtagcaccggcaggatcatcgtgggggtcctgggaagcggcactggtgctctgctcactgtaatgcagggggctggtggggggcattggtgcccccaggatcccccctccggctgccccccatctctgggtgtgcgaggcctatagcctggattgaggtctgagaaaggggagagatgcgtgctatttaaagggtgtataattaacacagcagagacaaagcaccctcgttcagatcttcagagaagataatagcagggccggtgatcgccagcgtggagtctggcgacgtgcggggggtgtgaagcccatcctcgttttcacaaagctcttcaggctaaggctgtctgtggacaacccctcccccccaccacccccgtgaggacagccgtgtggccatgtttctctggagtaacatctctgaggggtcctgaccaggaaaaacaggagtgtgaggagccaggagccacggagccctctcagggcttctgcatccgcagctgacacagggaccctcagtgtccccggggccagggcagccaggggtcgggcactctgcttccccaagcctcagggctgggccactcgaacatcttagcccccacttctcctgcatcttgccaaccctttgctggctcttggggacagcttggtctgtgatcctctagcctgtttgtgtgtctagcccactggtgtggacagaagcgacctgctgtctcctgtgcccgtgggcatgtgctcaccagactgtccatcccaataccaagctgtgggtctgttgggacctgttgttcctgggcaccccttgccaatctgctgaaagctctgggcctttttcccaggaaaatggggaccgtcagggctcatggatccctgatcctgccaaagtggcactgttcccttcctgaggatcttcctgtaatgccttccttggggagcggaatgaccagctcttccacctgccaccggggccagagggtgcggcttaccctctgctcagcccagcccgggtcttgctcagagcacgtgtgttcagcgtgagatttaagggtcctcccatctccttttaaccacctgccatgctgccctccctcctctgcctgggtaccgtgcccatcagcctgggaggcctggtcagtgggttttagagcagccactggctgcagcctgcaggtggccagtgaccatgtgctacttggggcacctgattctcaccccacacaccacagctgaccggtccgcagccgcatcctttcgagtaagtgttacccatggtgacagctgaaggccaagaattacgttctcattcatatgctgcaggggacctggggggttaaagaacgtgggaaagctgcagcagccgtggcggatgaggtaaaccaaagccgccttggttttttctggaatgcccctcccccactctgagtcaccgcatgctgcggagaggagagatgtgttctgatcacttttgtcttctctgatcacggggctgttcagcccagggtgactaagtgggagcattctgtgggtcttaaatgctttcagctgggtgtttccatagtgctgtcgccatggcacccagctaagcacgcagccggtggctcagcggcgggcggggactggagggggccagccactgggactgcctgcccatggggcaggctcagggccgttgtaaatggccgggctgccaggtaggaggtacagaccaggccgtgctctgtcccctgcactttccacacagctcggacgtgccccgtataggtcatccccgtccaacagcaggtcacagttggccgggccctgcagtgctggccgccacctcctctcctccccgtccccgcaccggccccttgtgtggtgaagctcctgcctggcctagatttccaggatctgccctgtacagtcgtggcctctctgtatgaggagtcagtgtcctggaacagcaggtgaggagaggcagctgtcattcctagacagagtggcagccgcatgtcatgcgctgactcaggctctgccatagccagatgctcatgtgggggctccaaggcaggaggtgtcagctccccccgtccttcgggggctggccatccctgccttgctgctctgggaacatctctcctccctgtccccaggatctggaggggccccgccagagcaccgtgcagccgtactttctgtctctcccccgacttcccctgggtttctcttgtgacctgtgtgccactcccagccatttacggggctcctttgagtaagtggaagacttaaaaataaaacaccaactctcttcccggccagggaggctgccgtaccctgctaatgaggccagtacccctcgctgtactctcccctggggaactgagcatgagcgtgagaaagtaccgtagcctaaaaacccagaaaccgcctgtagggtgggcaaccggagcagctccaggggccttagtttggaaggtgccgttctcagggtgaggagacccagggggccctgcagcctagtttacactgctgtcctggggtgaccactccaagcagcaccttctcttcccccgagtcctattcagacagcaaccagtgtggaggccgtggctctgggcagccccctgggcctgccttttctcagtgcctcagtttcttttgccaggcgttggatctcctgctgagtgctctctggccctgagctctctgcccaccatgctttccgggccggccaccgctggaaaagtccccagggagggcacagaatcctcatgatggggtgcgttgggggtttctccatggaacctcacacacattcctgaggctgccccacttaagggattctgggcaccgaatagctccctccaaagcaggcacccccatcacaggccactcagagcctggaggcgcaccccagcatccctggcagttccctgcgggaggagcggggcaggaccctgcaggcggccttggaacaggcctgggtgttggtctgagtggtgttgcaggggcatgggtgggtgctcatctccaggcccctccttgtgcacaagcccacttgtttctcggagcacaccctccccacccagtccctttgatcctgaaggtcaggaaaggagtccagcagccaggctgaggctggagcacagcgggctcaggtgtcctcctccatggctgcagtatgtggcgtcctggccacggccatcatgccctccccaggccccagggtacccctgaatctggctgtcgcactctaccccttcctggagaaggagcctcagaggtcactggaggttcttgggagcaggagcaggaagccctggtaggtgcatgttgcataaccagaggaaaagtacttcgcgctccagctgtggaggaggaggaggtggaggagaaagtagaggaggagaagaaggagaaaggagaggaggaggaggaggaggcagcggcagtgggggtggcggcagaggcctcagcatggagcagagcttgctggaaagtctgcttaaggttgccttgcagggcctctcacctgtgatcaaacttctcacttcctaaatgccatctcaggtcccctttaggtgaccctgtggccaggccctacagcgcctctggagggtcaaggcctactggggataggagtagcaagcccgttgttttgaggggcaggtggggtttagtgtgggaaagcagggtgggctgcaagggcaggggagcgccgggctccgtgttgggggatgtggctgggcaggctctggccttggggacagcatggtctgctcacactggccagcaggcagagccagtgcccggtggtagtgctgggaccgacccacaccctgccaggctggttctcacccctgtagtggaggcttgcgggggtaggcagccagggaacaggctgctccgctcccctccccgccgcccacccggcccggcactgcccacccacgctgagtcagagctgtaggcggggcggccgcgaggctgagtcaggcaggggaggccgcccccttgcggaggccgcatcttcttaagagccgattctgaactgaccactccttgacgggcaatcccggtggacggggggtctgagtcctgctgtggagggtctgcctgaggccggtaggggctcagcccaaggtaggtaggcacaggaggagaggcgagacagaggagagctggaaagaccttcctggcagaggagaagctggctccctgctgaagcagctagcctcctgcggcctcccaggaggggcctgggtgtgtccctggggacagggtctgtgcctcgggtgctcctcccttgccctcaccagccacccacagcctcatcagcgttttgggatggaaagtttccagcctacaaaaccggagagcccttgacatccagggtcccagtcgagccctcccactgtcgggctggggttctggaatcgggaaccccgggtgccgggtgtcagctgtgccatagggctgtggtgtcacgcgctaccccagacctcaggcacatgatccccaggccagctggggtcatggaggggccagcggggggtggggaggcatgctcctcccagagggacagaggcagagagccctggggtttggaactgtcacttccacctacagccctgttggtcaggtgagtcatacaacaagccctgcacccatgggcaggctgggaggcgcctctgcccaggatgggagcacagtccggggcctgggaggcagcggccgccctcagcttcttcgccactctctcccccaaactccccctctccagtttcctcccgaggctcacgttggagaggcctgggctcagctacagtttcttggtctggctttgcttgcactacttcttttaaagttttttttttttaaattgtgataaaatacacgtaactaatacagttgaccacggtaaccatctttaagtgcacagttcagcggcattagcgcattcatggggttgtgcgatcaccaccaccatccatctccagaactttccatcttcccaaactaaagctcttagtaccctccgtcctggtgtgttcagaatcggtagctggatctggaagctctgtcaggttgagactcagttttccttttggggaaatcattttggctggagcagcttctgtcgtctttgctggaaccctttctgggccgactgtgtgtccaccaagaagcacagagtggccaagacgtgacagccgccatggtcagagccagggccacagacgcaagggctgccgagcggctgaccgccgggtcagggtggggaccgcctgctggctgccctggttctagggtctggcttgactacctgtctttcctgtgcccaagagcacctgccagggctgagggttttccaaagcttccgcgtttgtctgggacacattctccccgtccccccatccccccatccccccatccccccatccccccatcccacggggacacccgggtgggcactcaggcagctccaaggtggaagggcagcaatcaggcctacttctcattcctggttccgtgctggcccctcacctgggcacaccctgttccgaaaggcgtgacctgtggatctgatcttgctgtccccgtggacgctggtcttgctttctgggctcccagtctccgctcggtgacctcttgtctgatcctccccacgaacttccttctcacgttctcccttggtgcacgcttatccggaaaccaggcagccaggtgtcttagcgtcccgctccccgtcattcagagccggagccgggtgggagaggagatgaggtgcgcccggagtcccctctgcagcagagggcttccctggggtccttggccactgtcctgggctccagctctcctgcctttcgtgctggggctgagatggctgagatggctgagatggaggggccctggaggcagaggcacaggtgagagtgctccaggcaacagggggaaggaccaagaagctgtcctggggcccatggagctggggcgcatccacacccaggcttctgtgccttggccacagggaggtgcacgcgaccccaccccacagcaggagccctgagatgaggctggccccctgccagagcctcctgctggaggcaggaccctccactcacccagagtggtcccggggcagggaagccttctggggatgtggccatcgggcatctcctgagtggtcccggggtagctgaagcctcctgggggcgtggttgtctcctgagtggccgcagatgctgttttgtttccagctgctctgcatgaatgagacgtgtcctttgactgagtccgtggggctgccccaaaccggtcctgacaggcgtccttccatcgctggctgagcctttctccctttccctccacagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaaggtgaggcggctgggggctgcgctgtgccggcgctgggccttgctggcagaaatgacccaggcccctgccccagccccagccccgtgaacacaccggggcagtgtccaggctcgaactctcgtttatttcgggttttcttgggggtgaagttctgggagaattaccaggtcacagggtgcaggcattttgaagactcacattagaaattgccacctgcaaccagggagagtctgatgggctttcaaggccttctagaacattcttctagaatgttcttggctcttctgccacagccatgtcctgggcaggtgcaggctgacgccaggcaggggacggtcatgctccgtgctgggtgccggagtcccggtgggacacctggtgggtggcctctgtgtcctcacttgctcttcctgtggcccctctatccacagtcctggggtacagcctctgggctcatggctctgctcacccgaggcactgaggacccccagccccaagcctgggtccccagccacccaagaccactgtgccactgggcccctaggccacccaagacaaccatgacactggccccaggtccagcagctgccatagctcggctgtcgtacgtggacctgccacccctcacccaacccaaacctgccctatctctttgcttcctgggtagccaggggccctgcctggctctcaggtggcctccccagtccctccctcactgctccagagtggcctccctgggactcaaacctggtcacagggtcctcccctggctcccaggctcttggtgacctgtgcctctaccacctctgcctgcacccctgagccactgtggtcccaggtggggccttgggtggtggccacatgctgctgccctcgtgacctctgagagacccctctgcccgtcatctgttgagggcccctccttgggccggtagactcttggccctgtgtttcccgctaggcgtcccccggcacagtcctgcggccctgtgtctcccgctaggtgtcccccggcacagtcctgcggccctgtgtctcccgctaggcgtcccccagcacagtcctgcagccctgtgtttccggcatccccagccttgtcgttccttgtgggggaatcccgccctgggatccgccatgtcccaggaccaagcctggccctgctgaaccaggagcgagttcctcagggacgggctgcagcagccccctccatggatatcctgagccccgatgtgagcaaggggatcccctcctaggaggctgacttagcccccagagcaggcaaggcccagaggccagactccccaccgggaacaggcagggccagcaggcccctgttcacccatagtccatgggtaggagttgggatgggatcacatgtgtcccctggaacattctggaacatttcaagagtttcgaagatgtagttccggagccaagcccaccagggaggccctggtcatgtctttctaaaataaagggttgcagggatccacgggctataccttgacacttgttccccccacccaccacactctcatgtacgtgcgcgtgcgtgcacacacacacacacgcacgtgatacagaaccagtgctccagtccccacagcctggggacagccaggagacaagtgctcttccctccctggagaggcccctcctgccggcctgggcctgctgggcactgtgggcaggtgcaggcaaggacagcagcagcacctttgacccctggaggcagcctcgctgctgaaggactcagcggtgacaggctgtgctgccacagctgccaggcagggagcgctgtggagcgcaggcctcccgcctgctagacccaggacagtggcgggcgtctgcgccctctggcgggggccaggccccatgacggggccagggagtgagagcggggctgtcagtggctggggtgctgcctgcagggatggagggcggggaagccaggctgcttgccgcaggtctcccaggaggggttgcgggatgtgcctgcggtggcagcagctgacctcctgggctcgtgggcccccgggcgtgtgtggaagaggcctgtgtcccacagacccacttagagacgagcctctgggctgggggccagggtgtgagggcagcctcccagggcagttcgtagtagctccctggtgcttgggtttgggcctgcctcggggctctcagggtgcgggggtgacgctggctcgtggccgctgtgtcagggccgtgccgctgcgaggtcggtgtccctcggccgtctgccctagtgctggtccctgctggcctctccgcgccacccaagactcactcctctaccactgatctcagccagggctcggcagacgttctgaagggccacaaagtttgtgcttttggctctgtgggccgtgccgtctccagctctgttactgcaatgtgagggcagccatgaatgaatgattcacaaatcgatgcacagctgtgttgcaataaaactttatttacaaaacaggaagccagccctcgggctgtggtttgctgacccctggtctgagccagcagcagaggggtaggggtggcatggggaggacttgctcagaatggctgtcgtccaacatcctccgtgggtccccagcgtgggtgcccagccacatgtagaagggaacggggatgagttggggggagcagtgaaagccggagaggcccccagaggtgccagagacatagcagttctggcccacagcttaagggtctgggggtcccgggaatccaggccctgcagcctgcttaggccaaatggccaggaggggcaggggttacttgattagctcccaggacccaggcccggccggctcccagtcccagaacctttctccatgcctgtggcttcctcctcctttgtccccactgtgctcagctggtctgtgtccagcaggccgcagagtacgcccgagggagcgcgggctcttgggcccaagggcagtggttggagcagtgagcctcagtgtgtctgacggggctgccttcctgccctcggcagccaggcctgacccccactgggcagcaccaccccctcccccggccatctggggcgccttcctggcactttggggtttgcccaccggagtttgaccttgtgcgtccctgtccgttcctccttcctccaggccctgatgggccccgcgggcgttgagcctgggtttgctctcatccctggaggtcccccgactgcatggcttgtggtccatccccggccctttaccggcagccgcttctgtgggttggggtcagaggctcacgggtggcctgtctcgccgagaggtaccacctggtgaagagcagcctccagccccagagagtgctcagggagggccctcagcgctgtgcctggctgcaggagactgagccggccctgacccctcccttcctgctgcttccacttcagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtgggggtgagtctgtggcctctggaaagcttcacgggtgtgggtgggagggcagcttgttgtcagggcggggggccgccagggtgcagagtccaggggcccctgctgagggggcggagggttctctttccccctggtcttgcccggggtgggctccagcaacagcctgctctgcctgcttccctgcagcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccagtaagggctccgctggggtgttgggctggggtccctggacgtgcctcctcagaccctacagtcatgccacaaccctcaataggggcctgggagaccctgaggctcacaattatgtgaccgtgtgtacctacatgcatgtggtacacacacgtgtgcctgcccagcatccagctccctcttgtcaagcctctggtgctcagtgggggcatgagtggggtacagggttaggctcatgcaggcagcagccacttgggagcaggtagctgctgctgcggagagcttagccagcccacttacccacctggggcacaggcggctgtgctctcagcacctcaaccagactccctgggctttgctgccccgccagccaggggcagtccccttacctgtcccttgtcccagcagccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgtgagtgtttctcgggggcgggctccaggcagccgctgccttcagcaagtgtgtggggcagcgacactcaagtgcactgagaccttgtgtttagagtggctgtgcaggttgcgggtcctcgccgtagaagacctgggcagtgagagcaagcgtgacctggggtcttcgccaccaacaggcgtcttctcccctggcaggggtcttcgccccaaccacctccctgcaggggtcttcccctacaggagggatctccccccaacagcagggatctccccccaacggcagggatctcccccaatggcaggtatctcccccaatggcaggggtctttccccatggcaggggtctccccccaatggctcgggtctccccccagcggcaggggtctccccccagtggcaggggtctgccccatggcaggggtctttccccacggcaggggtctccccccaatggcaggggtctccccccaatggctcgggtctcccccacatggctgttgtcttcccccatggctggggtctttcaccacagagtctagtgaccaccttgctccatcgcctccctgtgccactcagattgccgcagggtgtggcatcccacacgtgtacacactcagcacgtccagccgaagccctgtggtgggcatcagtttcccacagttcgcaggtgcagagcagggcttggccatcctgagaccgcaggctttctgtggctttcagctcttccacatgccagacgggctctccagtttggagttctagaagtcacctatggagtcagatgggccacacctcctcagtttactgaatgctgttgcagagaggctgggccagggtgccaccctcgctggacctgggggctgcattcccagggctgtgtttgtgcgggtgtgtctcttggcaagatgggaaaaggccctgacatttgtgccttcctaagcttggccttgcagccatcactctgaggagggggccgagggcagggggtctcccaggaggctgctccatctttcttccagtggccactccaatcttggtgccatccgtggcttagcgtgacactggggctgcgaggcaggagcaactgctctgcccgggctctggggccttgcagttgggtctggtggggccggcagctcccaccaggttgaggacagcccgggccaccttgcccttgaggctgagcacacagtgggagcgggctgcggtctttgtctccctggagcactgtctctgttgctccagagacagccgcgcagccatgctggggagctagagggacttgtgcatggatggtggtcggtgggggatggggagcctctgggctgagcgtggctcttacctggggcctctcttccaggcggggctggtttcccttctcctacacccgggtcttggacagcgatggcagtgacaggctgcacatgaggtgagctctgggcccaacgggagtgtaagatccccagctcgggagaggggctgtgatgacaccaggtccctgggcttggattgctcggctgggcttccggctccttgtctgctaccgcagggccatccccagtggccctgagagctggacgcttgaggccttcagggtggaggcatggtggtgccctgtgcagtggggcccgagagccctggggacaccagagcaggcagcaggtgctatgggggcagctcctgggggccaggtgtgcaaggacctggctgtcccaggtcctccaggttctcccagccttcagagaatcgcagctgaaagcggggtacatggctactgggagggtcaggggttgctgtggcagcccagcccctctggagtcctcccggcttagcttcatggccaggaggaggaagggaggccagactggcccggcccatggtccccagggctgccgccttggcctgagagcagcctccccgcatgtggcgtgggctaggtgagggcgggcagtccagggagccacagggttgtggggtgttgggggcatccggcctgctgggccgcctctgagtccctgtccctacagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccaggtcagtgggcggggccggggctgggaggggcccgcaggtggaacagtgggctcagcctgcagtcccccgttggagcctccgctgaggggcggggcgcctgggggtctgggtctttggacagccctggggtgaaggctgcatgatttgggaatgtgtacacacccctgcttcggcctcaggctgcccgcctcgccgcagcaggctccctgtgtcggcatgctggggctggggtcagcctgtccctcatggtgccctcagccagccacgggcaactcactgctctgtccaagggggcagcgtctgggctgggaagtggctggcctagaggtgggcctggacgccgccgccttttgggagagccaggggggcaggatctcttccgtgagaaccacggggctccctcagtcacatccatgagatgggagtgcttgctgctcagccctggcatgtggctggaccccttccagtcagtgtgaccctggatttgggccatctggtgccgggaggccagaggtggaggatcagggcctgggtcctaggccctggtgtgggttctcggaaacccgggatcatggcggtcctggtatctaggctggggcagggtgtgagcgtgcatctcaacttgccgggttccagcccgctccgtccagggaggctcctggggttggagagttggagacccctgtctgtctggggctcctcagccagaggtccagtttgtgggatattggctgggctagcagctttgttcccggggccggtctccagggctgggcctcaggcagtgagtagagagaagaagagaacccacctttttccgagataacaggtagcctgggtgactactcagctattgacccacaagtgaggagtccctagattgacagcctgagctgaggccgcaggaggcaacctggagaggtttgggctctgggccgtgggtgttccacaggtcagcctctggggtgggctcagtgctgggagagccaaggaggggtctgcatctgccctaggccgcgggccaggccatgctggcagatgaagggcacagccagccccagcgccacacctgggcgctcctcccaggcagtgtcaccctcccaggggccgggatggtacatgtgacaagtttccaggaaactgcagctggggtctgggtctggtcctgggtcctacaagcaggcggaggagtcccaggggcccgcccaggcatgggtgaggtgctgcaggtgccctgcgggggcctcggctccctgggggcaggaggaggggtctcaggcggccagtcttgcatctgtttgggagtgtgcaacaagcacacaaattgaggtggccgctggctggaggaggtatcccctttaatttgggcagtcattactttaccactgggaccagggctccaggcaggtctctgagtgctgcagccaggagatggggagccttccaaaggaacacggtttgaaccttgtccaggcaggatcaccatttgtgggtgtgtacaggcagcgggtgggggtgaccacaggccccgtcacccggcctgacatgtttctgcctctgcccccagggcctggatgactatggagcgcggtccatgagcaggtaaggggactttcagacctgtctttgggaccgtgggtgggtgtgaagaggccgggtggggcaggtccctctgctaggacctggggccacctcttttcctttagggcccagcctggcccttcacccctgtcagagccggggatgtcccttagggcgtcctgctttctccgagtgacacgggaacccccctgggccctgcccctctttcatcgcatctggccggccccatccatccctgtcaggcaaggttggggagggtagctgaggctggcatccatggctggggctgcagcctcctctgccccaatctgtgctccgcccttgtcctgggtcttcctggagggtcaggaggccaacgggagctgctgaaaggggcattgctcggtgctggcggactcgccgcctgtggctgggcagcgtcgtgcagccaggcagccgtcctgtgctttgtttcacagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaaaaaaaaaagaaaaaaagaaaaacaggaaaaaggactttttttttcctgaaaaacaaaaaccgatctgcatggactccggtgtgcgctgttatctcgcatccgacttccccggtgcgatggcctctgtccggacagggaaggtgctggggtccctggccgccccggcccctgtggaggggtgcacagagaaagggggctcgtgccaagctcgaggggcctcctgaggaagccggccgctcctgtgagggaggccgggcccgggcacctgagggcttctccctctggacactgcgggccaggtgtacatagagcagcgcggcacagtggcctcacctcccgtcgggcactggcgggagcaaggtcgggggcaggcgctgcccagctggccgcacacggacattccaaagacctccagagaccaccccacccccacattcctttgaccagccttgtgagggcatcgatgctgccccgggctacctggctgctctgggcagggtgtgcgggccgggcccggctgggggagggcagctctgggcacgccgcacccacgccccccacctgggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagctcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgcacgagttgggtatggacctccttccggttcccggcgtgcgtctttgccgtgggggccccgccttgtgcccacctctgccaggtattttctcggcactcagtcgcctgctagataacctgggcttgcacacggtgctggccccagtgacagtcgctcactctgcccgggctctgcggggggccgtctgcagctgaggcaggctcctggctccctccaggcccgcaagtgaggcaggctccgcaggcgccgtccagggagagccagagccccagctgtgtgccgactccgagtgctccagggttctaggtctcctggcagctcgcccgtggtcccccctcctctgcacccccgagtcctcagaccccatgctgcctccaactgagccttgtgtttccttgcagcgccgatgtggaagtggccagattctgagccgcctgactagagttagtaagttgcctggcgttctcgtgcagtcactggcctctccagtggttctccacgggccctctggcctcagtcacgcagcctgggtggggagggcccggctgcatggcggggccaggggtccactgagcctgcctctcactctgggtgctgggccttctctactgggtcccctccttgggttcatggtatctttctcccctcccggaagcttgtgggctctggctggctgtgcccggggctcctctcactgctgggtgtggctctggccctgaccttctgtgtggtcctctcctgccctgctgggcgcttcaattatagtcaaagggtgaccccggcaagcagctgcagcccgggcctttcccgcctgactcgcagcgccagcttgggctccttcgggtgtgtgtgcctttggggctgacagccttgtggggactggaggtcagggtcctggggagaaccctggggagctccataggcactggagccaggtgttgggcccactggggaccgggctgtgctgttagtctgaccttgcctcttctgtcccccaagccccacaacgtggacccaagacactggctccatccctagtgtggatctgcagacctggagggctgctgggtccaggtttgagctgacgctcactccggggaccacagggccattatgggtccaattccagtgggactctggagtccgggtctgagtccatttcctcacgggttgagtgggccactcccctggtgcctggtgtatatttgggatgtgccagggtgtccaggagcaggccctctgccctcatagggggcccttgcccacaccttccaatcgcctacacctgtgtctgggcgggtcctgcttcccaccacccttccatccccaagttgctaggagggcggctctgcaaagccagtgcctgcatccttcacaaaggacgttggtccctgtgtctccctggtggtcacagcaggcatcctggcccacgggcagccaggccacaggcagatcatggatctgtcttctttcactgcctttctgttgttgattttcggcaacaaattctggaagattaggtagaaaaatgctcctgaactttggggactggatggagatgctctgggttggccctggccaccaccttgccttccgcctccatcttcctcccttccgagacgctgtttctgggaggcctccagacccccccactcccccaggtccctctgagctgagggggctgaactgcccttacctggtgaggcttggaaggggtgaaggctcaaagatgaggctggcacagcctctgtcagggaccacgtcccttggagggcagagaccctgggtagcagtgccggtggggcagtggtgctcagccccagcaccactccacagtgccaggggccagtttcccggccacgcagtctgcctggtctgacaactcagctgggattgggggtgtcgaaagccacttgcagttggccaagagactccccaatcccattgccaccctgtcatgccccagctttgggccctgggaagggggccttggaatgagagtggaggggcgagcgtccctggccgctgtccatactcgtcagcggaggcccaagcgcccacgctggacccgattccagaagggcccaccttctgaagacacgaagaaacagctgacgcgagaagacagaaaacaggtgctgtccgcccggctctgggtctggagtcacccaactggtcgaaatgcatttgtgacggctccgtttcttctcggaatccttctgcttcacattcaagtcattggtgaagctgccgcttggccgagcgccgtggcccacacctgtaatcccagcacttagggaggctgaggcgagaggatctcttgagcccaggggttcgagatcagcctgggcaacctagggagacccccatcttgacaaaaaaaaaagttaaaaattagccaggcatggtggcacgcgtctgtagtcccagcttctcaggaggctgaggtgggaggattgcttgagcccagaggtggaggttgcagtgagctacaattgcaccactgcattccagcccggaagacagagcaagaccctgtctcaaaataataatacaatttaaaaattagaaaagccaccggtctcccctgcggccttgcttaggggcctctgaggggaggctctctgtgaggagacagagcccaggcctctgcattctgaggccagcgccctgcccgcccaacagctcccccacacatgacgcaggccctcctcagggtcctccgctcttggacacgtctggtgactttcctttgctggctggagaggtgctggtggtgtcattgggtagttcgtggcaatcgctgcccagggccatgtcctgcaggaggtggggcctggcacgtgtcctccggcagggaccaatgtctgtggctaacgtgtggtgaccttgcagtggccttgggctgcagactttgtcatattctattggctcagttaggcccccactcagcacagcgagctccccgccggcctcctgggcgcgtctttcccagacagctggggggtgggggccagggtggggaaatagggacgcccagcccctccttgtgggcctgctgtcccagccagccttgggctctggcctgcgctctccccatccccgccgacccccctgcccccgtcaggctgagattggacacagcatttgcagccccagccccagggtcctcagagccacccagtgtggatggttcagcacgctccacctggtcccactgttctgggagacaagaagagaaaaatgcaggttagagaacaggcctgcaccagtggagggcttcctacccctgcagctccccgtggggtccaggcaagcgatgtgcctttgccactgactttctgatgagaatcggctgtgattcggggcaggagtgagaaccacgcggctgcactgccctcggctgtggtctgggccagatctaggacccttctctgggaacccacttttttttttttttttttttttttgagacagggtcttactctgtcacccaggctggagtgcagtggtgggaacacagctcactactgcctcgccctcctgggttcaagcgatcctcccacttcagccccccatggagctgggaccacaggcatgcaccactctcccgcacctgcctaatttttttttttttttttttgtagagacgggtacgctttgctgcccaggctggtcttgaactccagggctcaagtggttcctcctgctttggcctctcagagtgctgggattctaggcaggagccactatgcccagccagccccatttctaatctccccagagctccctccggaccctgggcctgcggaggaactcgggccacagagcacttccttaggagtgggtctagcctggcaggcagacagggcatgggcagacatcagtgatggaggtggaatcctcaccagcgggcccctaggcagcccctacccaggccccaggaagggcaaagctgcaccgatcaaagctgaaaaaagccggggatccagcagaccctgaggctccagcacgttgagagtagatcaaaagatcctttcagcagggtgccaatgcttagacgccatctgggagtctgggagccttccgcagacctgtcagtctcttccacgtactttattctcttaaaaactcagtctgtagtgtttcaagttcttagaaaacacaaagtcctcaggaaagcttagggagctgcctctgccctgtgcctcttcctgggcagctggacggaaccctgcctgcccaccccagggtttgcttccggctgcctgtgcctcttcccgggtagctggacggagtctgcctgcccgtccccagggttgttcccggctgcccgggctcttgtggacccagctgtgccagaggtgattctgctccaggtaatggctccagagtccaagcacagctttgccagagcacagtcccgtccctgctgcgtcttcatgtccacgtgccatctgtgctgtcacccttggagctgcctgacatcccccatcctgtcctgtgctgtcccctccgggggtggggactccaaagagaaaggctcaggcatccctctcatccgtgctcatcttgttccatttcaacttcttgtcttgagtcgtatttgtgcatcagctgtggccccggggatatgggggagggcgcggcacccctcgggggacaggtggctgagcccacagcaggtgaaccactgtctggcccaggggatggccagctgctctgcagggcccatgggtgtccatctgcagccctgcgggagccgtgagcctaacctgccttctctggatgcccccatgccagggctgggctggacgctctgccacgctgtgtccctgggtgtgggcctggcctggtgggggagccaccaaactggtgtgtgcccggttcaggcctgtcttgaatccccagcctcagtggtgatgtccgcccctcactgggaggttgtggctggcctgccccgccccaccccgccctgccctgcccagcccacactgctgggagggtgatggatcggggtgggggcaccctgccttgtctagggcacatagtggacttgggggtcaggcagccttgcagacagcgcctggtcctccctgccccgcaaagcagcgtatattgtctgtgagctctgtgccctgagatcggaccgtaggcatccagcactggggaatccctggggcatcgggcagcccaggtggcacaattcacccatggcttccgccctaaaaattaaaaccacgtttttctctttcaggaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgcaccaggtgtgatctgtccgcccaagggccagaaggccgggagcacggggatgggagcgcccgcaccctggctggaagatgaacttcccgtaagcacgtaattccctgcaggtccggcagctacacctggagtgtggggcctggtccctccccatgcccctcggtggggctctcctgggcccctcactcccactggcaatgtcacaagggcctccccaggcccctcctgcctcgggcaggccccagccctcctccttacccaacctcccatccagaaccttgctgccagggcctcccagctcgctcctgcggccaaaggccagctgtcaggtgctatgcggggtcaccagcagagtgcccgctggcaggtgggggcttccccgcttccggggtctgccccaggactcctgggtggacctcccccccccacctccgctgactcctgcaggcactggggagctctgctggaattgggggttttaaaacttcattagcagatttgtgctcttccatactgtttgtttgtttgttaggtgaaatacagtgtggtgagctgcactggtgacaacagcccttacctggctggggaggtgtctccagcagagctcactcccgcctacagccactcacaccccggggacaggaagctgtagagttggcgggccaggagggcagttgagagctggccagcggagggtgcagggaagcccagctgtgctcaactctcctgcctccgccttccaccctgggcccagggacagacagacattgccctcagaagggcagggaggaggctgtcctggagaggcctgtaggtccattcttcacccgtccctaccaggccaactcggcctgcaggaagggagacctgcagggcgctacccctgcgcccccacacacagtagggccagaacaccatcccctccaccggggtgtgccgaggacagtggggaggagaggagaggggcagcttcctcctggccccaggaagggctggcatcgggttcctggcacagcccctcctgtccaggactttatcatcggcagacctcagaagacaacacacaaaggtttcttttgtcttagcttcatttctcttaaaaaacaaggaacaagaaaacattgcaccagcgttctaagcctcaaacaaaacacaaaacaaatccccctgcgaagcaacaataaactttacatctctttggcaacaat

SEQ ID NO: 36734 - DNA, 9859 bp, Homo sapiens
ttccactgaagtggccaagggagttgagctgagcagggggaggggaagatctacacccatcccccttcctctagccctccctgcgtttagattcagttgcaccttttattattttaactcttctccttaggacacgcagcccccaatttgtccctccggcctgggcggcccctggtcccgcgcgccagcatgggagagcgagggacctgcccgcggcccgccggcgtgtgcaaggaggtccagccgccgcgcccgctacccggagtctgtaagtttcaaagctgctccgggggagcggaggggggaggctgtccgtgttcccgtaaatgatttaaaatgcaaaacaccgcagaggcttgcagtgatggatggacttttcggggcacactccctactgcaacccgcaggctgttgtcttgggttttttcccccccgcaccttgtatatttgattccttcgttgtaaaaaaaaaaaaaaaaaaaagttttcaatttataatattatgatttccacaggaacctttttaactctttttagatgcaactcatacttctttcgcatttaaaataattcttataacttataaattctatagcacaccacttattataattttgtcagattacacgttatttagactgcgcaaggagtcatggcctttgcttacttctaaaaataacggaggaagaattttctctctttacttttaatattgctacatcatctaagtactttaataagtagatcgtgcacccaactggtcttaatcttcatgactgacgccacgtgctgtagccttgcactaatttacagacgcggttaatcgcagagaattatctttgagcctgctgtttaccggaaggctcctggttttgtttaactaaggctatgtccatatgtactcagaataagaaaaattgaaacagttctttttattaaaaccaagtaatttttctgagatcccagaactcaagcacaagctagattcatgtttgggttagtaaaaatcacatttttggttttgcatgtcacctcgcacatgtacagacatatccttgaatacaaggacccaagaggtgaggatagggtgggtttttaagtttttaataaatgtttccctcgtgcaggaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggtttggagtccactgtgtgtgtgactaatgtcaggtaagaatgtagtgggatgaggcaggggttgaaaacagtagagaaaaaatgtcaaaatgccctttctcttatcattctgttatttaattgaaagtgaaataaagggtttgttttagaatcttcagaaacaaaaaagcacaataaagaacaacacctaacacagtaagtattttttaaatgcagctttatggagaagagtctctgaaaacctgagcttcagtcctttggactagccttgaaaatgttataccagttatcaaaaaaaaattgtaattcaaaggattacacagagtgctttactccaaaagcgcacacattgagttcagtatgaaaaagctgttgtccatagtttcagtgcccacaggtaaatatctctgatcaacaaaaaatattgtgctagtggacatttttcttgactcttctaacccatgacattttcagaaataataagaaaaaaatgggaaggccctagggggagagtgtcctagattaaaaatctactaaaaaatgaaataaatatcatcccttctttatcgagattatcataacatagctgattgcttgcactggattcagaaattaaaagttatgctaagattcagaactagaaattgctaatttttaatgacaattagtccaaaattttatggaaggggttatatagaagcaatttaattttgtactcttctttcaaagtttaaatagaatagggacaagatagttcttagattacctaactttggcttctttctcatatcataagtatctcaaagacaggtaaattgatttcagtgattcacctctcttgctttcacatggtttaagaacatttagttgaggtgatttctttgtttttttcggggggaggtggaaagagataaattatatcaattaccaagatgttcactgtgaagcaaaagagtagtaataatactggaaaattttccaaaacatttttaaaagaacattttaaattcacataattcacaaagcaaagaaacttgaaaaagcattatgataccaggaaactgtaaagaatgggacctctagtgaccctgaaaccttattaagctagcatatcactgcagaaagtggaccccagactgtgaacttgtccacccttccatttgctaaggaactacaatgccagcctttcaaggaggaaggcagcattagtgcgcagagatcacacaccacagatttcagctcaaattctgagcagcaaaaactgtattgaattgatctattgcttttaatattgattagatattattttcttttttcaaacttctcacaaactgttgtctcaaagaaaatgcagctggaaaacatagatcatcagtataccagatataaagaaaacacaatacttaaaatatccgttaaaacgttcaatagatactctaagatcaaatatcattatctataatatatatctttaagaaacttactggcactgataattggtgaatcattttcatatcaaaataaagttttaatctaaattatatgatactgataaaaagagaaaaaagaaatggtaacagcaaaccttaaaaatcttcattctctcccaatgagaatgtaaaaggtgactaataataattctaattctttgcatttttccctttgtgaattcaatgtccaaccatatcactaaaattggaaacaacatttttcattgaatattcaccagtatttccaaataatgtttgaccattcttctcttagggtgactcattttctcctccatgtattttctcctgcaaggagtctctttgactccatttaatatgagtcaaaaaatagaccaatatatttcctctttctcgatattatccagcctacctctttctgtaacagaacaaagaaacagctaaacacttttatctcttgagattgtttagcatagcaagtgtcagtaaaaagctgggtcttgtaccatatgtaatatttagaattcataaacaatatacaaaatgtggctcatgaatagtctcttaaaccattaaaacaaactatttgggatatttatcattagactgctctctgaggtatggatacattatcagaaatcagtgttgtatccataccccttctctggggtccatttttattcttgccatgttttggggctataccagatatctttttgtgggtagttagtgcaataggcaattactgtagttttccatgaatcattttagcaacaaaagagaaaggcaactttcgcacttcacttaaaagctaatcaaaagaataatccatgtattcttgcttatccctcataattttctaccaaagtgcactgtacataccaagtactcaaatgtttaaacatttttctcacctgctgtctgtagcattaataaataggtaatactttgagagattgctaatgtgtaggcttgtcttctataaagttagagaagtttgaaattgtggttgggggcaaagatagaactaatattgtttctatgaagaagccacagcagtacttgttgtgaaattaagtgttataaattgatagtaacaaatgtggtgcttcccatatgggagtaaatcagaatcccctgagaacttttcaaaagcatcttacccagatccaacctcagcctaccaaatcaatgtctattcactaagatagggagtagatgtgcaatttgaaaaagcttcccaagaaaatcctacaacttcttggttccttccctctgcttctttcacaggattaggccaaagtgagaaaattcaagttagtataatattaattacaggtataccttagagatattgcagttttggttccagaccattgcaataaagcaaatatcaaaataaagacagttacacaaaccttttgtttcccagtgcatataaaacatttatattatattgtaatctagtaagtgtgtaataccattatggctgaaaaatatacatatctcaattcaaaaaatattttaatgctaaaaaatgctaatgttcatctgagccttctgcaagatgtggtctttttgctggtggaggggctagccttgatattgatggctgctgattgatctgggtagtggttgctcaaggttggggtggctgtggcaacttcttaaaatatgacaatgaagagtttgctgcaacaattgacttttcttttcacaaaagatttatctgtaatgtgtgatgctgtttgatagcattttacccacagtagaacttctttcaaaactggagctaatcttctcaaaacctgccactgctttatcaactaaatttatgtaatcttctgaattctttgttgtcatttcaacagtgttcacagcatcttcaccaagagtagattccatctcaagaaaccactttggttgcttgtccagaagaagcaactcctcattcatccaagttttatcatgagattgcagcaattcagtcacatcttcagaatgcccttgtaattctaattctcttgctatttctaccacatgtgcagtgactccctccactgaagtattgaacccctcaaactcattcatgagaattagaatgaacttcttcccaactcctgttaatgttaatattctgacctcctcccgtgaatcacaaatgttcttaatggcatctagaatggtgaatcctttccagatggttttaaatttactttgcccagctccatcacaggactcactatctatgtcagcaatagccttatgaaatgtaaatttcttaagtaataggccttaaaagtcgaaattactccctgactcatggctgtagaatggatgttgtgttaataagcataaaaacagcaatcaactccttctacatctccatcagagcacttgagtgactaggagcattgtcaatgggcaataatattttggaggaatctttttttctgagcagtaagtctcagcagtgggcttcaaatatttaataaatcatgctgcagacagatatgctgtcctctagcctttatagttctacttatagagcataggcagagtcaatttagcataatactttggggctctacgattttcagattgatcaatgaccattggcttcaacttgatgttaccagctgcattagttcctaacaagagttagcctgaactttgatgctttgaagccaagcattgacttctatctagttatgaaagtcctgggtaacatcttcttccaatagaaagctgtttcattttcaacactgaaaatctgttgtttagtgcagccacctttactaattttcttagctggatcttttggataacttgctgcagctcctccatcagtacttggtgcttcacctagcacttttctgttttgaaggtggcttcttttcttaagcctcctgaaccaatctcttctagctttaaacttttcttttgcagcttcctcacctctcatccttcatagaaatgaagagagttagggccttgctctaattcaggctttggcttaggggaatgttgtgacctagttggtcttttatccagaccactcaaattttctgcatctcagcaatgaggctattttgctgtcttatcatttgtgtcttcactggagtagcactttgaatttttttcaaaactttttctttccactgttcacaacttggctgtttggcacaacaggcctaaactttggcctatcgtggcttttgacttgccttcctcaccagcttaatcatttttgcttttgatttaaagtgagagacagcgaatatttcctttactcgaacacttagtgttctttgtagggctattaactgacctaatttcaatagtgctgtgtctcagggaataggaaatcctgatgaaaggggaagaaacaagggaacagctggtcagtggaggactcagaacacacacatttatcgattgtttgccatcttatatgggcatggctcatggtgccccaaactaggggttcccaatccttgggctgcagaccagtactagtctgtggcctgttagaaaccaggccacatagcaggaggtgagcagtgggggagcaaacattacctcctgagctctgcctcctgtcacatcagtgggggcattagattctcataggagtgtgaaccctacggtgaactgcgaaggtgagggatctaggctgcgggctccttgtaagaatctaattcctgatgatctgaggtggaacagtttcatctcgaaaccatttccccccacacacaccccccagtattgtcttctacaaaaccagtccctgttgccaaaaaggctggggactgctgccctaaacaattacaataatgacatcaaatatcactaatcacacatcatggtaactgatgtaataataatgaaaaagtttgaaattttgtgagaattaccaaaatgtgacacacagacacaaagtgagcacgttttgaaaaaattgtgataatagactggctggatgaaggttgccacagaccttcaatttataaaaatgcagtatctgcaaaatacattacagcagagaagaataaaataaggcatatctgtatgtgaccttgacacagtcatttactagtttctgcccctagttctccctttaatcatttcagtattctccagaacacctagagtagtgctccccaacctttttggagccagggactggttttgcggaacgccaatttttccactgatgggggtgggggatggggatggtgtggggataaaactgtcccacctcagatcatgaggcattagattctcataaggagggataacctatatctcccacatgtgcaattcacaataaggttcactataccatgagaatccagtgcctccactaacctgactggaggcagagctctggcggtaatgctggcttacccactactcacctcctgctgtgtggcctagttcctgacaagccatggaccagcactggtccctggcctggaggtggggggggggggggttggggacccctgacttaacaaaattagatcatcaataagacacttttctttccaaatggaaaacaactcccttctattaaaaatactagttgtttggaataatgtgttttatactagtttttttagcactgtgctatttctatatgagacacaaaataagtattagctaatgaatatgattttaaagattataaataataaattcactcagtactcagtaccttccatatgactcaagtctcctaaacatagatacgcaataaataataaacatctacctggtagaaagttttacaaagtaaactgtgcctttgtgaaagtgaagtatttcgcaaggtaaaatatgcatatatatgaaaatatattaatcttttacacaaattaggcccatcactatgtgacctatgaaacattaatagaatgttaatagaattaggccttagcttaagggaacttaattaatagaatgttaatctccagaagtctggaggtagatgcatgcaagagagagagagactgttctaaacacagtttagaattaggcattttacaagtttaagttggctagtctttctgcaagcatttaatagtctttggtggaagaaaatgaaaagctcagcttggcatatttcattattcaaaatgtgacctgatggtgttcttttctgatatcattcctcacaggtctttcacttctgcttttctcttctccattgaagttcaagttaccattgggtttggagggaggatgatgacagaggaatgccctttggccatcacggttttgattctccagaatattgtgggtttgatcatcaatgcagtcatgttaggctgcattttcatgaaaacagctcaggctcacagaagggcagaaactttgattttcagccgccatgctgtgattgccgtccgaaatggcaagctgtgcttcatgttccgagtgggtgacctgaggaaaagcatgatcattagtgcctctgtgcgcatccaggtggtcaagaaaacaactacacctgaaggggaggtggttcctattcaccaactggacattcctgttgataacccaatcgagagcaataacatttttctggtggcccctttgatcatctgccacgtgattgacaagcgcagtcccctgtatgacatctcagcaactgacctggccaaccaagacttggaggtcatagttattctggaaggagtggttgaaactactggcatcaccacacaagcacgaacctcctacattgctgaggagatccaatggggccaccgctttgtgtccattgtgactgaggaagaaggagtgtattctgtggattactccaaatttggcaacactgttaaagtagctgctccacggtgcagtgcccgagagctggatgagaaaccttccatccttattcagaccctccaaaagagtgaactgtctcatcaaaattctctgaggaagcgcaactccatgagaagaaacaattccatgaggaggaacaattctatccgaaggaacaattcttccctcatggtaccaaaggtgcaatttatgactccagaaggaaatcaaaacacatcggaatcatgacagcaagataaccccaagacagtcttttatcaagttttgacggtttatgctgggcactgccagactgaaccagagctggaacacaataatgtgtccttctacattttattacactaaatgatattcatattcaagcaacagcactttctgtagtaataaaaagtaacacaccaagtggaggattcatggcttatgcttgtttcatacatgtagaattcgcagtgatatacttaagttatgtgcaggggtgggtatgctcgtttctctcaatttgaaacacaagaattacactaatagtaacaggccttgagcacaaaatttggtcaagaaatgagtctgtttgaaatgcttagttggtgaaacccagatcgctgtgttactaatgatcactctggaaatgcaaatagaataggaggggaaaaaacaaaatcatgttaatgcgttttgtacatcagccttctcctgtctccatgataactgcatttggtaggaagcctgaggcaaaaactgcttaagtggatctgtttgtaagtggattcagttcattcgctttgtctgtcggtgactcctgaaggtttcctggtccatctcattgcggcctgttgggcagagctggacaaggtgtctttgaaggaaagctaagtcttgtctcatttaggactgggttccccacagtgacagtcacttccttcagcatctcacttcttcttctagaatccccacagggaaatactgtattgaatattttattaaaacattttctttgta

SEQ ID NO: 36735 - DNA, 9859 bp, Homo sapiens; identical to SEQ ID NO: 36734

SEQ ID NO: 36736 - DNA, 23894 bp, Homo sapiens
gtaacaggacaaggagttctgctcaggcacgtggccacagaaaactacttaggaagcctgtggtgagaacaacaacagtgcctgagaatcccacggctctggggaagtgagccccgaggatgaggctgctcgcctggctgattttcctggctaactggggaggtgccagggctgaaccaggtacagcactgggaatgtctgctatgcctttgttttgtactgtgaactctggggctgcgggaagctgctcgcagccagcttgaaggtgcttctaaagatagcaaggcaggagctaggcagggaggcaggtggggagagctagtgggccttagcaagtgctgtttgaggctgaagattttaagtggaggcgccagctggccagggagggacaccgacattgcgaagaggtctgggtacgtgagagctagctaattagtagaggtaggaggtggcaggaaagattcgtggactcattcaacaaatgaggtcctttcctgtaccatacgttattctaggagccagggatatatcagagaagaaaagaaagtccccgtctcaatgaagaattccttcatctggggagaaaaaaacaaaccacacgaacaagtaaagtacgcagcattggaggagatgataagtgttatggggaaaataaagtagaacagggaaggcgggttgtggggagggggtacttacaagacgtccagagaagagctgtcaaatcaggtgacactcaagtggagccttgaggcagtgagtgggggagccacatgggtgtccagaacattacaggaagagaggacagtgcacggggtctgaggtggacacacaggagatgtgcatgaggaacagcaaggaagcccgcgtggctgaagcagggtgggcaggacaagtgggggtgaggttggcagatggtggggtggggcaggtgccaaatcatggatagcctcgaagactctcttgaggactcagacatttttctttccacgtgcctgtagataggaaggacgcaggcttttgctcagggtgaaatgggatgtcattggagggttctaggcacaggtgtaatctattctgacttctgtatgtttaaaaggacccttgaggccagacgcagtggctaacatctgtaatcccagcactttgggaggctgaggagggtggattgcttgagtccaggagtttgagaccagcctgggcaacatagcaaaaccctgactctactaaaaataccaaaaattagctgggtgtggtagtgggtgcctgtagtgccagctacttgggagactcagctgggagaattacctgagcctgggaggttgaggctgcagtgagctgtgattgtgccactgcaccccagcctgggtgacgggaatgagaccatctcaaaaaaaaaaaagaaaatgaaagaaaaaaattctctttatagcccctctgaagtaggtgctaatatcattatacccattttgcagatgaggcaaatgagtctcagaggggacattgcacttgctgaagatctcccagctgggaaatggcaggacaaagcctgtgcctggctgtactatgcttcatgtcctcttgggatggtggggtttagaggtactatttttttctcttttctccaaacttgctggaatgtattccttttaaagtaaatttaaaaggaattccgggccggatgcggtggctcacgcctgtaatcccagcactttgggaggccgaggcgggcggatcacgaggtcaggagattgagacaatcctggctaatacggtgaaactaaaaatactctactaaaagtacaaaaaattagccaggcgtggtgatgagcacctgtcgtcccagctacttgggaggctgaagcaggagaatggggtaaacccgggaggtggagcttgcagtgagccgagattgcaccactgcactccagcctgggcgacagagtgaggctccgtctcaaaaaacaaacaaacaaacaaacaacaacaaaaaaaggaattccgcagcacctgtaaggtttttccaactccaggtgtcttcctgaagcacaggtggattctgagacaggggatcagacagcatcatccctgctttgcattaaactgtgggatttctgcctccactttccttagccaggagcttgggtggatgccaacttgctggctccttctcctcctacacatgtcctgtgtaacatttcgctccttcctcagcttctaactgcagagaagcagacaggttcttcccctgtgggttagcttggtaggaaaacactccctggaaggccagcccagggctgagggagcaggaccagggcaggaatggtaacacctacctctggagctattgtgaacagagggtattcactgtaggtggtccgtaaatgtaggttttaacaaatgaactccatgggttttggagggcctccatttacaaaggatgaattacaattgtgttttggggctaatgctagccttaatagcaaaggactgaaatagagactgagaccattgtgtggtgtgggttataggcaataacagacaaaagccactgaatcacaggagtcagactaggagggccttcagggaacctctgttcagtactttcatcttatacttgaggaaacggaggctgaggggcagtgtggcccagggaatgagtcctaaggctgccttgctcaccccacagccaggtgctctgtataagagaactcttttacctgcacaactgaggcaggaggtgggactggactccagaggcagggctttgacaccagaccagattgaggactagctaaaatacggcctgggcaaaagcagttttcaaacacacccagcagtgtggcatgtcaatttacctttgcaatggcaacacccaggagttactgccccttctatggcagtaacccaatgatttaaaagttactaccccttccctagaaatttctgcataaatgccccttaatctccaggcaattaaaagtgggtataaatgtgactgcaaaactgccctgagctgctactctctgcctctggggtagccctgctctgcaggagcagtcatggagctgtacatcacctgttcaccaaagctgtttgcttcaacctcaagcttgcccttgaattttttcctgggcaaagccaagaaccctcatgggctaagctccactttggggctcacctgctctgcatcacaagcatccctctgctgggtgcattctaatcctcattttatagatgaggaaactaaggctcagctctgaaaatcccttgcttaagttgccactgcctgtatggaagagccaggattcaaaataagatgtccctgattgcaggtttcatgcatgtccttgcagaaataacttactgcctgaagccagaaaacttaggtcctacctgtggtcctgcctttgaatacctgtgtgacctgcaacctttattttactgtttataaaatagggatgttagcagaggagagattaaatgtgatggccttaagtgagatcatgccaggtacattgtaaaatgttgtaaaagtttaaggaggcatacacacagatggtccctgacttacgaagattccactaagctgtatgatggggcgaaagccttaggcattcattagaaaccacacttcgagaagccatacaaccactctgtgtttcactttcaattcagtatttaatacattgcaagagacattcaacacttaattataaaataggtctgcatcagatgattttgcccaactgtaggctaatgtaagtgttctgagctcctttaaggtagactgggctaagctacgatgccctttggtaggttgggtgtgttgaatgcatttttgacttatgatattttcaattttgggggacgtagccccattgtaagtcaaggaaaacctgtatatatctccaaggccatgctggtaggtggtggcagaatatagtgcactgtgatcatttccattctgacgtgctcggcatccccggtctgccgctcactcgctcagtttcctcatctgtaaaatgagtacatcttaggatgcatttcataatgttgtcatgaggctgcatggatagagtgtgtggcacagtgtctggcattcagtaggtgctaaatgaatggcagatgccttcctgcccccctgtctccaaccataagggaactcaccttctagccattttaagaacttaggttttataaatgactatgactatgggagttctccccacccctatcacaaatcatactaaaaagatcccatatcatgtatgattttaatttttttatcttatttttcttttttggagacagggtctctatctgttgctcaggctggagtgcggtgctgcaatcatagctcaaggtaacctcaaactcctggactttagggatcctcctgcctcagcctcccaagtacggagaaattaaatttctttttaaaaagtagctgagtgtggtggcatatacctgcattcctagtgtggtggctcatacctgtaatcctagcactttgggaggccgaggcaggcagatcacttgagctcaggaatttgagaccagactgggcaacatggcaaaccccacctctacaaaaaagtacaagaaaatttgccaggcctggtggcacgtgcctgtagtcccagctacttgggggactaaggtgggagaatcagttgagcccaggaggttgaggctgcagtgacccaggatcacactgctgcactccagcctgggtttttgtttgtttgtttttgtttgtttgtttgtttgtttgtttttgtagaggcacggttttgaactcctggcctcaagtgatcctcccactttggcctcccaaagcactgggattaccggtgtgagccaatgcatgtggcccatgagatttttaatattgcttttgaaatgaattgttgattttgatgacttacttgatatttgtaatttttgtctttcctgcacttttagagtcaatgcatttttttccaagtctcagatatttctgtgggccttgcagagctatgaggccttgggccctatgtctgttgtccctagtgagcataaaggcctggtgatcccctttggtgaaggaggaggcgggccaggacactttttgcctgcccagggacgcgctgtgcccaccagtcctcctcttagagatggtcatctggggcagacaggctctatcttcatcttgtttcccttcagatgtcctgcctgccctgcccctgcactttacctgtggacagtagccaaggacacgctggggctggctgggtagaacgtggccactccccaccttgtcctgtctctcatggtgagagggggccttgtagaaccccccaggaaccaaatgtggagtaaccactgcttcccatttatgaaatcatctcacatttctcattttaattctcacgagggccccaaggggtagggggcgctgttatcttgattttacagaggaggaaacgggcccaggggaaggttccgctgttcacacagctatggggtggtgcagtaggactccctcccaggtctgtggcctcagctactcactgtactcaataccaaatttatttatcttctcagtaataaatgaataataatgatagctgagattggtgtacctttctataaaactcaagttatagatgaatactgtcttactgtaaaaggtccaagcagtgcgaatgtagaaagcctcttaactttaacaagatccccagtgaagcatctgaacagtaacatttgagaagttctggtctaaagggtaaagcattaaagtacccaggcgcccacacctccccagtctcactcctggcccaaggggtaattgcaggtaacggtatggtgcgttgggattgtcctctatgagccctttctccttcactatcttatttgatgctcactgagaggcaggccagatgtcaacatcctctagctcagtgaggcctggtggcttgcccaaagcccctaggcaaacacatggaagaggctggattagaaaccagatctcccacctccccatccatggtcctgacatgctaattagagcttaattattttgatgtagggcctggaagctgatggatcccatattcttatggaaagcatgtatttattattacagccaccttctgggcggcggggggttccaagtcaacaggcatgacgacattgtgtctcagctttggggtcagagaggtctgggtttgagccttagtttgcttatctatgcagtgggcataagaatccctatctcacagactggctgccaggatgaaataagaccagtgtatgaaagtctgggcacctatccaacactgtctgagtgcctacaattctaactggcctccccacagccttgttcattcatcgaatgtgcatttgcacgtcttccacgtcccaggcacccttctaggcactgaggacatagaggtaaacaagacgggcttggtgctctcatggaactgacattgtaaacagggaagatggacaataagcaagccaacaaggtaagttcacatgtgatagtgctctgagaaaaaggaagctggggaagaaatagcgaccagacaggcaggagaggtggcacttgagatgaggtggtcaggggagtcttctgaggaggtgaccttggggcagaggcctgaatgaggaggaggcagccgcatgatgatgtgggaagattgggcgaggccatggcgtagtcagggaagaggccctgtgaggagaagcagcttggctgagggtggtgggttgggctgagctgacaaggtcgctgggatctgcactcccacaatgaggaggctggaccccaaggagttggagctgcccacctggaccccaaggaggtggagctgcccgcctggacctctggctctctccaccattctgtccactagcctggcctctcctggagtcagcacacacacatgcacacacacagacacacacgcacacacacataaacacacatgcatgtacacacacccttcagcagtatgtgccagagaggctggaaagtagtttcagttctacacactggctggaaaacgacaactgacaggtgagatgaggagtttctggagtggagaaatgttcctgaatactttgagggctgacgtcaaaggggccaaactgctcagtgtttgtagttaactgagaaagagccagcttgaggcaggggaatagcctctttctctgtctgcagaggaagcgcaaggaccatgtgcccaagagaaaggcaaagggcctcccccaacatccatcctggccagcctggctccgggcttggaagcaggtgagagccactcacggtctcagctcagggacttgggatgcccagcaactctgcccaccaactaactggtatgaggcagttcattcctttactctggcttggggttttgtcactgtattctttttaatttttttgagacagtcttgctgtgtcgcacaggcaggagtgcagtggtgcaatctcggctcactgcaacctccgcctcctgggttcaagcgattctcctgcctcagcttcccaagtagctgtagctgggattaaaagagtgtaccaccatgcctggctatttttttgttttttgttgttgtgtttttttttgagatggagtctcgctctgtcgccaggctggagtgcagtggcacaatctcggctcactgcaacctccgcctcctgggttcaagcaattctcctgcctcagcctcctgagtagctgggattacaggcgtgagccactgtgcctggctgaattttattttctgtagagacgaagtcttgctttgttgcccctgctagtcttgaactcctggcctcaagcaatcttcctgccttaacctcccaaagtgctgagattacaggtgtgagccactgtgccaccatgcctggcaggaatatattagtgatcacaatatgtgtggaaaggttaaattttccccattataaacaaaggctcagtttggataaaaaataaaaatgtgggaatatgctgtcaacaaaaagacccatctaaaatagaaaggcactggtttttaacccctttcacaatcacatcttcctgggagggattggagcccagagatccccatcatttaccatgtgatcttaggcatgttgacctccagaccttagtttccttatctgtaaagtgggataatgttcccagggctctgcggagaacactgtaacaatgcatgtgggagggataatgatttgcttaatcagccatttacactttagtatgaatgtgtttcacatcctttcctgagactgtttagatcaggagaggtggggaaaagctcaagagcatctgggagggaaagtcaaggagtgagggtcaggggccagcctttatctgcaggctgtccactgaatgtcctgtggcctgggtggggccctggctatccaaccctgagatcaaaagaagtccagtctcccaggcccagacacagcttcttggggccagtgatgttgacttgtggctctaggtgacacaagaaatgggggaggaagtgattgcaatagcagagggtgaggaaatcctgggcgtcattcttgttttatcgagaaacaggatgaacagaggccagatctgctcaaccctccttcagtaagcagtcattgaaacaacttgtgctggccaggtgcggtggctcacgcctgtaatgccagcactttgggaagctgaggcgggcggatcacctgaggtcaaggagtttgagaccagcctggctaacatggcgaaaccccatttctactaaaaatacaaatacaaaaaaaaaaaaattagctgggcgtggtggcgcatgactgtaatcccagctgcttgggaggctgaggccagagaatcacttgaacccaggaggcagaggttgcagtgagccgagattgcaccattgcactccagcttgggcacagagcgaaactctgtctcaaaaaaaaaaaaaaaaaaaagaaactactgtgccaggccgtgttgggttcgcatgagaagtctactccatctcacctgtttctttggattcctttctctttattacactgtgaagttttttgccacttcagcctcctttggtcggaaactgagtctaggtttcggtcaatcacctcagcaagcaggaccactcccagctgcttgagccacaccttggatccagaatcaccagcaaatatacctaccagaggaggtcagcccgatctgaagtggcgttcctttttccctggtctagtactcttatactcacttccacatgtagtccccaggtttttgctgtttttgttttgttttgttttggagacagagtcttgctctgtcacccaggctgcagtgcagtggcatgatcatggctcactgcagcctccacctcctgggctcaggcgatcctctcaccttagcctcctgagtagctgggaccacaggtacatgaccccacacccgacgaattttctaaattttgtgtagagatgaggtccgcctatgtagcccaggctggtcttgaactcctggcctcaaagaatcatcttaccttggcctcccaaagtactgggattacaggcatgaaccactgcacccgggctttgctggtattgcttagcaaggttttccagctcatttggtgtgtaagccttttccatccaggtcagacttttttctttttttttttttttaattttccaagaaattccaggacaggtcagattttcatatgtagttatatttccctgcagcatgagaggatatggctctagttaatgggcttagaaaagtgacatagcccaggtcacacagctcctaagtggctcagagcctgagcacttaacccataccctctcccgcctttgctttaaaacaagccccctcattagaatgcctgagctctaatgttgtggctgcccatccaatgtggggaggaggacggggccttgccaaaggtcagcgctcagggatggagctgagcctgttctgtgctctgctcaatgtgtccctgggcagagccaggcctgtgggccttttctctgaacccggggtgctcagagaagacttccatttgcctgtgtaacgcccctgccccagcccagggctcccctggacttccttgcttccaggctgagagagagaccagctttgaaggaggatgttttttcccctgcagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactgggtgagtacagttgaggtggcagctaccctttgccaggcatctgctatgtgctacataccagtctggccctttgcccacattatctcccttaatcctcacatcagtctcacgtgaggctgaggaacctaaagctcaaaggaattttgtaacttgcccggggattcctgagtccaactgattccacagtctgtgtcctcgacctccatgtctcctggctgtggcagaacgcagctctcaatcaggcttttggacgtggtcctggcatgcctgggcacccggagagtgtccaggttttaagctatgggtggacactggagccatttcccctggggcttagggactctaagtctgagaggtccaagtgcagggagggaagaagttatgagggctgaaggtggcccagcctggggtcctagtgtcctggccagctgctggccacccctgggctgcccagtggtcctggattttctcaccagtcagagctctgctctacagagtgacagcttgagggccgatcccactcagccgcagagacccagtttctgcttcctgtccaaggttgctgctctaattccttcaactttcctgggaacttgcctccttatcattcaagattcccccattccggctgggtatagtggctcatgcttgtaattccagcactttgggaggccgaggcagtggatcacctgaggtcaggagtttgagaccatcctggccaacatggtgaaaccccgtctctactaaaaatacaaaaattagcctggcgtggtagtgcacgcctgtggttccagctactcgggaggctgaggcaggagaatcgcttgcatttgggaggtagaggttgcagtgagccaagatcacaccactacactcccagcctgagtgacacagcaagactctgtctcaaaaaaaaaaaagaaagaaaaagaaaaaaagatacccccatctcctcgcttgctccctcacttggcagggcaacaagtcgtgctcagttgtggggtagatgctagggatctgagatgatggacacccacacttggctccaaggagctcacgttcttgtgggcaatgcagacaaacccattgaccctacccttacatccaagcaaggagagagagtcacctggggggatgtgggaacttcacagggcacatgatcccatctggcaggattaggggaaggacatcctgcaggaggtggtggagcaggggagctctcgaggaaggctggaaggaattctgactttgcgctccctctaccagcctcagtggacacttctataaggcagggtgaaacccatgatgcccctagctgtgatgtggtttgtgggtgtgaccaggaaggaccctcagatgaacctgccaggctggacacataagaagacatgtgacattgtctcaggaggggcctggacagctctggcttccttgggctcaggaatcaatctaagaagagagtgagatttggtccatgaccttgggcctgctcccttgaggggagcttctgatttctccgagaagggagagcatgtgtagcattcagacagatgggatccctcaggaaattcatgatcctttaacagatgcacatttttttttttttttgagatggagtttcgctctttttgcccaggctggagtgcaatggcgtgatcttggctcaccacaatctccgcctcctgggttcaagcgattctcctgcctcagcctcccgagtagctgggattacaggcatgcgccaccacgcccggctaattttgtatttttattagagacaaggtttctccatgttggtgagagtggtctcaaactcccgacctcaggtgatctgcccgcctcagcctcccaaagtgctgggattgcaggcgtgagccactgcacccggccacagttgcacctttttttcctgggaaatctctgagaccttgaagaggtacacagcatcagatgagaagatctctaggaccctttacaattcttcaattataataaaatttgacttctaagagagctgcagtccctttgaggatggccattagaaattaggtatgttttactactcaggaggctgaggcaggagaatcgcttgaacctgggagacggaggttgcagtgagccgaaattgcgccactgcactccagcctgggtgacagagcgagactccatctcaaaaaaaaaaaaaaaaagaaattaggtgtttttttgttttttttttttaagatggagtctcgctctgtcgcccaggctggagtgcagtggtgcgatctcggctcactggtgccccctaccacgcctggctaatttttgtatttttagtagagacagggtttcaccatattggcctggctggtctcgaactcctgaccttatgatccgcctgcctcggcctccccaagtgctgggattacaggcgtgagtcaccgcccccggcctaggtgtgttttttatcagacagaattagattctctaacctagaaattaaaaatatgaaattttgtccctgtgtctttgggtttccggcctgtccccagggagttttcagggcaaaacagcccctcttgctgccctaatgtgggtatcagagacactataggatgcagtggctgtgagcatagactctggggccaggctgactgggctcaaatcttggccccaccactttctagtggtgtacacttaggtacaatttttcccccgtgtctctggtgcttgatttaggataggcaaaattcttaacttttctgtgtcttggtttctttatctgtcaaacgggcctaaactaataatagaatttacattgcagtgttataatggggaaaaaattagtggctgtggcaacaacacacagaaagtgcctggcagaaagtcagccggtgtgagcttctagcagcagtattaatactattatgctaattagtttccctgggggaatacctgggcagcagaggccccaggattttgactgtccggacgtctccccatccctacactccacctgccaccattctcctccccttgccaagcatttctaaggtggacccaagaattttgattcatggcatgaagggcacagtggtcccagggcagaatcagtatctgccctggaaaagatctgaaccctacacttgaagccagcttcaaactcctttgaactcttctggaaaggaacagaattcagagatggcttctcaaccctgagctccctcggggtttgcagatgggactggaactccagagctttcctctctaaataataatattcattacaacctagcagctactcttactgtactatattatgtatataattttcctccttgatggatacctaacaaacactctgtgagtaagaactgtattatcccaacattacagatgagttaatagaggctcagagaggttaaacagccaatcaagggacccacagcaggaaaatggcaaagcctagttctcagctctgtcccatctgactccactctagcctggccattccccctcaaggggacatctgaggcccaggtccataggttttcctctcactgcagagctgtcccttccttttcttctgctgcttcctgagttgcctgccccaaattggcttggtggtgttttgtagtgatgacacgcctcatgtgcccgatgagaaactgggagaggcagctgtactggaaattgtggaacgcctgaccaagctcatcagagaggtctttccaggtaagactgtgccatcagtccctccacagtgttctcggaactctaggcactgcctggcacagtgggacaacagcagcagcgagtgtcctggctgaccttcatccatggacagcgatggctgttggccaggtcttcatggtgaccatttctcaccttcctaacaagcccgaaggcaacatgcaagcccatgggccggtggatacacacagaatcctatcaaaggaaatgcccagcctttcactgacttctgctcctgcctatctccagactcatgagcccttctccaggtgtctagagttgcacacaggtgtcgtccctgggtgagtctcacacacagcccttgtgtcctgctctggagttggcatccatcaccctcaaactgtcctggctgccagggcctctgggaaatgctaatttccagccaaggtgctgtttcttgttgcttccaaggacttcagagtctggcagagcaggcagggactgggggtgagtgaggcagcagccctacgggacactatagggtgaatagggtctgcgtgccccatctgatggcccttgcaaatgttttaaagcagtctgcaccgaaaacaacatcctggaggctaaatctggctgccaggctgccaactgggcgcctgagaaagcagcccatagcccccacccccaccttttttgggttccagtacctctgccccctctaaagatcttcatcatgggtcccaggacacagatatggagtaataataaaaataaataatggcactagcagcagttactctagatcaagtgtaaagggtcaggctggctctaagaatattcaagccttagctccttcactgtcaccataagccttgggggaggtgctgtgacctcaattttactgatgagggaggtgagccttagggttaaataaactagtgaaggtcacatttacttaagaggcccaaatcctggtgtgagcactgcccttactgtctgttcccgctgcttcctttcctcaacaaagtcaatctaggcaaagagatgcctggatgcttccaggttatctaacccagccaacccaagtcaggctgcttggtttcctttgtcttccagcaggggtcaaaccaggacattcccctgaccccaacagcaggcaccattattcccaatgtatagaaaaggaacctgtggctccgagctagtcggttccgagggagggactcaaactcagatccaactgggagtacctctcctttgcttcacatggggcttctggaacacaagtcaaataatgagtaagaaaatgcttcactgactgttttgttttttgagagaaggtcttgctgtcacccaggctggagtacagtggcacaatcaagggtcactgctgccttcatctcccaggctcaagcaatccttccatctcactctcctaagtagttgggattacaggcacacgccaccacgccctactaattatttttattatttttttatttttttaaggctgagtcttgctccgtcgcccaagctaaagtgcagtggtgcgatcttggctcactgcaacctccacccccatgggttcaagtgattctcttgcctcagcctcctgagtagctggactctaggcatccaccaccatagccagctaattttagtatttttggtagagatggcatttcactatgttggccaggctggtctcaaagtcctgacctcaagtgatccgcacgccttggcctcccaaagtgctgggattacaggcgtgagccactgcgcctggcctgttttcaatttttgtagagatggggttcttgctgtgttgcctaggctggtcttgaactcctgggctcaagtaattctctctcttagcctcccaaagtgtagggattacaggcatgagccaccatgcctggcctattgactatgatttaacacaaatgtaaattataagattttgtagtttctactacacttgcatgtttattgaatttcctaatatccaagatgccattgactgaaagatgcatcattatgtataactaagaaaaaacagctaccaattataatctgacacagcgctttctcatggccacacctcacttttagagatggtactatgagaacaaattggaagagatgaaatgaaggtattatctagctgagaattctaaaaacacaagtcaagcagaacactcccatcttatagataactaaactgaagtacagagaggtcgagtaagtggcctaagaagaggaagggactgaaactcgagattcagggttccacatcatgtgttcttcctgctgtgttcaactttacccaccagagtcagctgtgaacactggtcctcacctcatcagcacagccaagtggttgacaacacaggcacgcaaggcaaacaaatccagggccctgggccaggtgcagtgatcatatgcctgtaaacccagcactttgagaagctaaggctggaggatcgcttgaggtcaggagtttgagactggcctgggcaacatagcaagaccctgcttctacaaaaaataaaaaaaaattagctgtgtgtggtgctgtgtatctatactcttagctacttgggaggctgagacaggaggatcacttgaccccaggaatttgaggttacaatgagctatgatcgtgccactgcactgcagcctgggaggcaaaggaagaccctgtcatgcagggcccaattctagctctggtatggtttagctgggtaatctcataaagactcagtctgctccctgtgaaaaaggaaaataatggtacctgtccacagggttgttatgaggattaaataaggtaattcattcactcatttagtcaatcaacaaatagttattgagcatccactatgggtgagacaccattccaggagtagaagacatggcaatgaacaagacaccaggtcgcaccctcatggagcttatgtttgcaaggagctgggcacacagaagcagtgaaaacacaggagtgagtccctcccttctcatagggattttttttttttcttaaatggattcttaatggctgctggcatttactttagagaggtgaggtttttctaggcagttacagtgatgcgttttgacaacctcctactttggcagagttctcagcatttccaggtcttgtcggctgtacagggcaaagggtgtgttagagatatttcccaactggaatgggaggctccagcctccctcatttgttccaggtcactccctgtgatagactaagctcatataagggcccagccctgttctgagtccaagagttatttttgttgattgtcaaatatttattgagcaccgattaggtgccagacactgagcataaaataaaaacagaaatgaggctgttcatgtggaggaaatgagtctaatgggttcccctacacctccaggcctcattcacaggccccttcctcagggaggcctccccaaacccactcctaccctctgttattactcccatagcaagtggccattccctttctgtgacatcccttacacctctactcaatacctgtcaaccctattgaactgcaggacctctggggctggaagcctggtttccagttctatgcattggctcatagttggtgctcaataagatacttgctgactgcatggatgagtgaaactcctaaggcctcccagagtgacgcagaccctttccctaacagtaagatgatctggaatcaacaggaattgggaacactaaattaccaagtggctgatgacgatcggactcatttagacctagttttccccttctcatcatctgctgctttccttctaactaggaaactttctgctgggaatgggtttagggactgtgatgaaagaacccactgctcttccctccaaagtctaagcaaagttcagtcagattctatcaaatgtgggtttcctatctgtgtcttttcctcatctgtgctatcgctcttccccttgagctctgatggccagtggccaacagaaaatgattaactcccccgagtgcttttgcatatatattttgatatttcaccctttcttcctagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtaccaacaccacctgctcctatcaagagcacttactgtatgccagggtctgatcttcgtcttcacaacaacctcttagaataagtactgattttatccccaatttacagataaggaagccagggtcatacagcttagaaaaggcagtcttgggagcagactccagaattaactccaaagcccttcctctaaaccccacgacactgatgatgctcctaagttcatatttattgagcctttactgtgtgcgaggcactgccctctcagcctggtcctagacacttcacaacaacccttggaaggagtggtttcatttccagcaggtttgaaccttgccaccactgacaccatgggctggataactctgtcgcagacaactgccacgtgtgttgcagaatgttgcaaacactcactagagtgataccctcaggaacacccccagctgtgacaaccaaaaatgtctcagacattgcccagtgttctcttgggccagaagcacctggttgagaatgactggttcagaaacacagccagcccaaggtgactttgaccctactcttccctttcctcggtctcctgctgttgggactccccagtggttaaagccgaccagaagcctgtgccacagaagcctgttgatttagtccacatagatcagctcttggaaaagacagctgagcagtgaagggtcgacagtggatctggatgggcaaacacacatcactgttagtctcactatgcagataaggaaaccgaagtatagagaggtgaagttactttcccaagttgcacagcgaatgagttccagagccaggaattgaatccaggccgcctggctccagagcctctgatcttccagattgatgtcccacccatgggaaagatgggaggggaagatgcaacggaaaaagaaagtgggacattgaggtggaaggggcggaagcctgtctggccagaggtgggggcctccttcatattgtccctggctgtgacaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtaagaggccctgcttctttcttttctcatctggggttatttcctgcacaagtctcccgcttggcacaaactcacccacccacccaaagatgcccatatcccagagggtcctttatcagcccggcaccagcagagggcttcctccatcctcaccacagccctgtgtgctgggatctggagcccactgcagatgaggaccctgaggctcataaagagtggtgacggtcccaagtcacataataagtgacgaagcccagactagaagaccagactccaagtccagtgctctttccactcccaccacatgcacagctgcagccagtactgtgtgccagatctccaggggatgccctgcccttgagtgtgtccagctagcctgctggcctgacagctcctcaaggactggctcagtgtctcatttgcccaagtccttgcactgaccagcccatcccaagaggatctcacagctggtgcccatgagcatgcactatgccaacattgggcacgttgtttaggacattatgcggatgatctcaggtagcagaactatggaaaccccggctcagtagcgagtccatcattctcaaaaccccaccagctatgtgctattccagatgagaaaacagcagctcagagaggtgatacacagctggtgtctaagctgcagtctgactccaaaactcatacatttaactctgtcccctgttctaactcctgccatggtggccaagtgcccaggtgttgtcagatgagtgactcaaggaatgtaagaaacgaatgcacattaccgtgtagcatatcacacaaccacgcaagaatggtttcgttgcagtgttcaagctctccaagagaagagtagtctttgaaggattaggaaagcttcatgggggaggtgctctttgaagtgtggggaggatttacagaagtgaaaaggagaagggtactccaggtggcaggcacagaggtgggaaggtatgtggtgcattcattgcagggcacagggagaaagtgggacatggaatccgggaggccttcagggaggagatacatttgggcctgtctacctgcctttggggcaatttgcaggttttgagaagtagaaatgagggtctggagagggcatctgtgagcctcttctgggaacccctcccttgtaggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtattcaacctggagggcaactgccagctccctccctccttctctccccagacccgctcagtcctgctgtctctctcctgacaggtgtccccataagcgccatgttcatcacacctggagtcaccccatggaaaaccacattacctggagtggtcaatggggccaacaatccagccatccgggtgttcgaatatgaccgagccacactgagcctgaaggtcaggagtcctgcggaggccagaggaggagggtgggaggggcttaaatgcatcaccaccttccctcactctcagcttatccaccttcccctgaccactgagcctcaggaaggttgagctccttccacccttctccagctcaggatcagaaccctggaggcacctgccaccgagtcagggcagtgcctcaccaagtcaccttttcccctggatgactgtcacagcttcatacctggtctccctgcctctggccctgccctgctatggcccatccgctacacaagagagaagaaactaatctcctatagcaccactttcatcttgtctccgtcctgctcaaaaaccttcagtggctccccagtgccttcaagataaagttgtgtctccttgacctagtactcaaggcttcccacagtctgacttcaagcccattgtccacattttccgtacacagacgaggctccagcccctaattctttgggcagtccctcacctcgtaggatgagcttgtggttgttgagatgaaaaatattattcctttatttatccaacaaaatgcattaagtgtgtgccattggccaggccctgttctaatctcagaagatatgtaaatttaaaaacaaagtcacccctctcctggacctgacatcttacaggagagggacaataaatatgtagaattaattatagtactgagagaagggctaaggagaaaatcaaaacagtgaggcgacagggtgacagctatgggaggtgtgtactgtgttagataggtgggaaggggaagtgtccacataaggtgccatttgagttctgagtgtattgagggagggagcccagtgggtatcttggggaggtggagggaacagcaagtcaaaggccccggggtgggaatgtgcgtggtaggttaggggaagagcacggaggccatgtggccacagtaagaggcacaaggggagagtgggaggggaggtccgatcttgcaggcctccatgaggactctggatttggagggttttgcgcagaagaatgaaatcctgtgacttataattttatggaatcatcatgtctgctgtgcagggaacaggctgtaggggcaggtgggggagcagtgaggccgtttggagggaaggacaaatcccagatgacaggatagtagcttgcccagggtggaggcagtgagatggtgaaaagtgccaggtcccagatgaattctggatgcaggatttgctagagtggatatgagctgtgagaaaaagggacgaatccaggaggcttccaaggctcttggcctgtgcaacggtaggctgtggctgccgattactgagataagtggcagggtgatcaggcttcggagggtcagtcagaggtcttgttttggacctgttacctttgggagggctaaatggcatcaagtgaaagtggacagggaaggggcaagttggagcttgaagaggtgaggatagagatgtgatctgggagtggagagaggacatttaaagccaacgactgcatgagctaacccaggtccttgattctagtaaaggtagattaagaagaggtctgaggggtttaaagagtggcctgttgtccacatgggcactccaagggtctgagcaaggggaatggcaggctgcaccatcaccccctaacaggccctccattctcctcagggagggagtcagccctgagcttgaatcctggctccaccactcataagctttttgatcttttgacctctgtgcctcacttgcttcatctgtaaaatgggagtaacagaacctcgcagggtttgaggaggactacatgaaataatggaatgttcctggcacagagtggccatgcatacgggcagctcctcttaccccgtctgcagtggcctgaagcaggttcataaatgtacctggaacccgctggactgatgaaccctgcagagtctagccgtgaacatgcacctgggtcctaggagtctacagttcataatctctctcatgcttagtgttgctctttttatgttgcttttatctattcattatgtaaatatttactgagcgtcttctatgtgtaccctagcatggtgggacctggggtaaacctggggtccaatcctgctaccactgaatacctgtatgaatacctgtatgaccctggccaagtgaattaacctctttaggcctcagtttcctcatttgtgaaacctaggtaataagcgcagttacctcattcgattcagaggatgtctgccaagcacaatgggtgcacagctaagtgctcaataactactagtggtcatggtcactgctctaaagaacttgggggcaaatgcaaggtgcaggatggggatggaagcagacaactgctcacagccggtctaccccaaaccctttttccaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccga

SEQ ID NO: 36737 - DNA, 23022 bp, Homo sapiens
tttccttcctcttttggcaacatggcgggcggagaagctggagtgactctagggcagccgcatctttcgcgtcaggatctcaccaccttggtgaggttttgcttggggaggatgcagagtgagctcaggagtggaggtgaccgagcctcccggtggtattgggactagtcagtgtcgggagcatgggtcaggagcctgggtcaggagggagacctggaactgggcgccctaagccatgctcgcgccgcctgtacccaggccagtccacgatctgggcgcaggcgtgtacggtcgtgggacttctagcttctggagggttcggctggaaagtcttgatgttgattgtcatggtttcagcctctgaacgtctgggaagggggtgtcctgtctgcattacttttagtgctaatgttcccaagattggggggatctctgacttccagatatcccctaatagttgagtggaggtgtagtctgttgtgtaatgatgaagggctcttaacagcttcccagccataggagtacaaagttactgatagggaaaaggagctttagaagtagtggaaagctgtgcagatggtggcaagatgtagatagcaaacgtaaagtcaaaggaaaagttctcatttgttttacgtgcagtgttttaaaatatatttcattgcaggatgttaccaagttgacgccactttcacacgaagttatcagcagacaagccacaattaacataggtaagagtaacttaagagacctaaccttggtctccaacaattaattttaacctcactttttgtgtgattacttgaatagtatgaggattcagatattcaagaaatagatactgagtccttgtgaataaagcatctgctacatttgcggtgcagggggagcacaaagaatgctgcccacatgtagcttacagactcggtaagaagaaaaaatggagacataagaaaagtttaatagcataaggcagtatgtagtcatatgtagcagaagtttaaggaagaggtgaaaaatgtggctgtacttgacacacaggattatttcaagggcagaatttatgaaagttttatttgatgtacaagctgtgattaaatagaaggttttttttcttaattggcacctagaactttagaggagaagttacgttgactgagtgtaaattttggacattttgagtttgtacaaacagcacagtttgtacgaaagtaagttaaaaagtacagaagtaagttaaaaagtaagactagtttttaacctagttaaaaagtaagactccaccatgaggctattaaagttacagtattacagtctggagctttaatttattaatgcaaacaaagcccaaataagcctacaggccttgaactactgcccctgcattaaaaattttggttgaggtgaccttggagcataacctaacctccgaacaacctatgctaagactataccagttaaagcaaattactgtgcatatattgacccaataatttgatcaacggaacaagttgcaattaaacttaggttgtttccttgtttgttcacagatccctttttgttgtgtcagggcccatcatacctgtttaatctggaaatgctggaaggttccttaatatataaagttctggccgggtgcagtggcttatgcttgtaatcccagccctttgggaggccaaggcaggtggattgcttgagcccaggagttggagaccacctgggcaacgtggccaaaccccatctctacaaaaaatacaaaaaattagctgtgcgtggtggtgcatgcctgcagtcccagctactaaggaggccgaggtcggaggattgctcaagcccaggtggttgaggttgcagtgagctgtgatcagggcattgcattccagcctgggcagcagcaggagaccctgtctgtcccagagtatattttttaagtaaagctgttagttacatggaagtttctcttaagtcctatatgagaacacgtttctagtaggaaggggtatggaggaggaaaaattgaagtcactgttggttttatgttgatatttacagcaagttatggctttggctttaattgtatttatttatttatttatttatttgcgacggagtctcgctctgttgccaggctggagtgcagtggcacgatctcggctcactgcagcctccacctcctgggttcaagtgattcttttgcctcagcctccccagtagctgggactacaggcatgcgccaccacgcccagctaatttttgtatttttagtagagatggggtttcaccatgttggccaggatggtcttgctctcttgaccttgtgatccacccacctcggcctcccaaagtgctgggattactggcgtgagccaccgtgtccagctggctttgggttttctactcttaacactatttgaaaaaatatttggtatgtaattaaatacacatgaattaattttttgaactttgtccataggtacaattggtcatgtagctcatgggaaatccacagtcgtcaaagctatttctggagttcatactgtcaggttcaaaaatgaactagaaagaaatattacaatcaagcttggatatgctaatgctaaggtaagctgtgtactgtggaacgagaaactaactttaattgttgtgcagataacaaatcaaaatctttttttattgaaattttagatttataagcttgatgacccaagttgccctcggccagaatgttatagatcttgtgggagcagtacacctgacgagtttcctacggacattccagggaccaaagggaacttcaaattagtcaggtgacctctcttttgctacaaacactacactttatattttattgtcttctgttttgtgctttttgaaatatcgaggtgttaaacggtgaacctaatggctaaatggttttgttgtttttccattgtttatgtttttatgggaaatctgaaaagtcaagcatctaaacctaagttaaaatacttacatgcaatttctccaaactaaaagtatcacttaaacaaaacagaaaaacaactcattggattgaagggattctttttctaggcttcctgaatttcttttaaacagcgctgtttctgtatgttaaataggagagaaacagagccatttctaattacttctctaaaacacttgaacttgttccccatctgttttctgaatatgattgcatacctgtttttttatcaggatactgacacctgtctagtgatgtttatggggattggagatgccctacaaggaatgtttagattggggcagggctgggaccagggagggacaagtgaggccttcacctcaagcccaaaatgtaagtgggcctggcggtggcaggtatgccagaaaactcagtaattaggataaatattttaatgcagtgttttttttaaattaatgcaaaaaatgtgataaatcagaattttaaataagggcagactctattactaaatttttttccccttttgctttggctcagcatggcattgtattttgtttatgattgattttttgcattaatttcgactttttaaaaatactgaatgcatatatttttttttctttcttttttttttttttttttttgagacagtctctgttgcccaggttggagtgcagtggtgcgatcttggctcactgcagcttccacttctgggttcaagcaattctcctgcctcagcctcccgagtagctgggattacaggcgtgagcccccatgcccagctagtttttatttttatttatttatttatttatttttgagacggagtctttctgtgtcgccagactggagtgcagtggtagagacggggttttaccatgttggccaggatggtctcgatctcttgaccttgtgatccgtccgcctcggcctcccaaagtgctgggattacaggcgtgagccactgtgcccggcctagtttttatatttttagtagaggtgggcttttgccatgttgtataggctggtctcgaactcctggcctcaagtgatctgcccgcctcagcctcccaaagtgctgggattacaggcatgagcctccatgcccggccattttccttgattactgagttttttggcagtctcttaaattttgcacttgtctcactgtagtcctggcctttaataggggatcagcaaactttttccacaaagggctaggtagtaaatattttcagctttgcaagccatagagtttctgttgattctgttcttctattacagaagcaaacgtagacaatacgtgtgtaaataggtatggtggtgggccagatttggcctaagggctgacctctgttttagatcatgacaatgtgagcatgcgattaaaaaaacaattgtgactctgaatgaataccatagttttgttaaaagtgctgccatctctgcttcaaatgggcaattctagtttttcaaggtgttagaggtatttttggaaaattgtttttttttttctcttttttttttgagacggagtttcactcttgttgcccaggctggaatgccatggtgctatcttggcgcattgcaacctccacctcctgggttcaagcgattctcctgcctcagcctcccaagtagctgggattacaggcatgcaccagctacatgtggctaattttgtatttttattagagaccgggtttcaccacgttggtcaggctggtctcaaactcctgacctcaggtgatccacctgccttggcctcccaaagtgctgggattacaggtgtgagccattgcgcccagccagaaaattgttttttcaaattctcattctgttaacgtggtttttataagtcattataagttttagctttcaaatcaatgacattctcagtatatactctccaccattattctataccatattcattttcattggattttggagtttatcttccattctgcacataactaatttaatttgctttgtaatctgcagtggttttcatcagctggtgaacttatttccaagttctagaaacgacaagccctgtaaccattttatagcaataagattatttcctaagttgatttaactttaaaaaatctaaaactagcatgtgtaagtagtgatttatgttaaggctgattgttatttctcaatcattagacatgtttcctttgttgactgtcctggccacgatattttgatggctactatgctgaacggtgcagcagtgatggatgcagctcttctgttgataggtaaatacctcacaattggtttggacaaatcaatgtggaacaaatccaagatgaaatatttaaaggggaactaaggcctttaaggatcatatctattacctaagggtgacatgaatgggaactaacatgtcatccaggatgactttcctacctatcagctatcacaaaatactcaaaaagatagacttggggctgatagcttgcgagaattcttgtggtagcatttgagaaaaagaaaaaaagtcaatagttcatttttctcatttaaatcacatgaggtgatttatttagttttaaatgtatgtgtaaaactatttgtgttatggtttgtgtgtgtgtatgtctgaactgtctactgtggaagtatttaagatacaaatattcataatacgtgctgaagtgtaggaataagtggagttttgaagggtagcgtatgctttgtttcttatgttagctgttgagagatttcattactagggggtaaaattttttaaaagctgctggtgcggtggctcacgcctgtaatcctagcactttgggaggctgaggtcggcggatcacctgaggtcaggagtttgagaccagcctgaccaacatggagaaaccccctctctactaaaaatacaaaattagccgggtgtggtggcgcatgcttgtaatcccatctactcaggagaatctcttgaacccgggaggcagaggttgcagtgagccaagattgcgccattgcactccagtctgggtaacaagagtaaaactacatctcaaaaaaaaaaaaaaaaaaaaaaagcgactgggcatggtggctcatggctgtaatcccagcactttgggaggccgaggcaggcggatcacttgaggtcaggagttcaagaccagcctggccaacagggcgaaaccctgtctctgctaaaactacaaaaaattagccaggcttggtggtgcgtgcctgtaatcccagctacttgggaggctgaggcacgagaatcgcttgaacccaggagacagaggttgcagtgagcagagatcgagccattgcactccagcctgggcgacagaaggagactcagtcttaaaaaaaaaaaaaaaaaaagctgggtgcggtggctcacacctgtaatccctgcactttgggaggccaaggcaggtggatcacttgaggtgtcaggagtttgagaccagtctggccaacatggtgaaaccctgcctctattaaaaatacgaaaattagccgggtgtggtggggcacacctgtaatcacagctactcaggaggctgaggcaggagaatcgcttgaacttgggaggcggaggttgcagtgagccgaggtgacgccactgcactccagcctgggtgacagagacagagtgagactcagtctcaaaaaaaaaattttttttttaaagcatgccatgttggtatagtcaggacacttgaatatcacgacttgaggaggttgatcattagagtgctcaacaaaacatgcctatttctttataatacactgttggttatcttcacaatagcattcttccctccctcagttgaagagtagcctctgatattagtaaaaattcatagacagtattaagtgcttttcccttttaattactctctacttctcaggagcttgcctgggccagaacatttctaaaactggagagagttagagggctatacctcatacctgagcaaaagctgagtgcagaccctgagaaaagccaaacttgctgattttaagcttcttgcttaggaccaggattgggagccacacaattgggaggttccagtgaatgcaggcaacagaggatgaagcagggccaaaaggtggatacctggcaataatatcttccttattagggttagaacattcagaagtctcctttattagatgccaactttttttggggcggggagtgggtggcaaaagagactcataaaatgtaccattttatgtatttacagggtagaatttagtggcattaagcacattgacaattttctacaacatagtggttgtcatttcaccactatctagttccagaacttttgtatcagaacttttgtatcaccgcaaaaggaaaccccatgcccatgaagcgtcagtccacatgttttcctcccccagccccttgcaacccataatttgctttgtctctttatggatttgcccgcctattctggatatttccagctattcttatatgcatcttttttattcttcatcaactagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtaagaagccataatatgaaataaatctatgaatcactttgagaggcatttactctggataccagatgttaaattaacttttaatatattatctaaaacaaggtaaacttacaagtcttaagccttatcgccctaccttttgcttgttagtaacctgatataactaatgaaacctgtgattctgaatttaatatactaaagtatatttttgctggcagcaagttagaactgaggttgttttctggaaactttatcaatcagattaaaaaaaatctcagtgacagtaaaatgaataaaataattttaaaaaaccttgtcttacagtatttgttactgaacagctttcagatttggaagtgacagtgattatttaatctctagagtgtcggccgggcatggtggctcacacctgtaatcccagcactttgggaggctgaggcaggtggatcatctgaggtcggaagttcgagaccagcctgaccaacacggagaaaccccatctctactaaaaatacaaaattagcagggtgtggtggcacatgcctgtaatcccagctacttgggaggctgaggcaggagaatcgcttgaacttggggggcggaggttgcggtgagccgagatcacgccattgcactccagcctgggcaacaagagcgaaactccatctcaaataaataaataataaatctctagagtgtcccttctctaatagcataatgtttttcatttcagaggagatgtgatttattgttgacattttctctctcagtcttgtttttctttttagaaaggttaatttcttatgaactcagttctgtcatcacgagaagtaataagtgaatttgattaaagtctaattgtgtttggtctatttctttgactagcttgtttgacgtataatcaatacgtagcaaatatatatggttgggcgtggtagctcacacttgtaataccaagactttaggaggctgaggcgggtgggtcacttgagtccaggggttcaagaccaacctgggccacgtggtaaaactctgtcaatacaaaaaattagctgggcttggtggcacacacctgtgttcccagctattatgtaggaggctgaagtgggaggatcgcttgggcctgggaagtggaggttgcaacaagccgtgattatgccactgcagtctagcctgggtgacaaagcgagaccctatctccaaaaaaaaaaagtatatatgccagcagtctttgattagcagagtctgtaattttatcttgacatttattgggagattaattacatgttgttagaaattttttcaactagtagagtgctctttcacaggaatgttagtattttctttatttaaataagtttatcattgtactaatattaagtatgtctactaatataatgtaacaaattttctcttacagggatttgtattcattttcaggagtaaaaacaaacaatattgccatctttctaaacagaattatccactttccacttgttgctgacatttatatggggtttaggcatctattttattatagtaatcttaattgttttatgtaacagatacatagaataaattttataaaactgtataattttgatctttctaaattttgtcatataggtacagtagcagagggagctcccattattccaatttcagctcagctgaaatacaatattgaagttgtttgtgagtacatagtaaagaaaattccagtacccccaagagactttacttcagagccccggcttattggtaagtgataggatttgcctttaactcttaatctgatcttttccacattggtgattcctcttcaaggatgtttattaatatttcctctttctgcagaggtgataattcatacaatttttttgaaatcaattctgagattgtattggcagtgctagattgtattactgaatgagggacagagtcctgaacacagtaagaactgttaacctaagccgggcgcagtggctcacgcctataatcccaatactttggggggccgaggtgggtggatcacctgagttcaggagtttgagaccagcctgatcagcatggtgaaaccctgtctctactaaacatataaaaaattaactgggcatggtggcgggtgcctgtaatcccagctactcgggaggctgaggcaggagaatggcgcgaacccgggaagcggaggttgcaatgagctgagatcgcgccattgtactccagcctgggcaacaagagtgaaactgcgtctcaaaaaaacccaaaaacaactgctaacctttctgtgcttaatatatggtacatgatcaagatggagtaatacagtattctccatggaatcataatgttttagggtgttagaacttcctgactaaaacatttacagatgattttgttgttcaattaacgaagaactgatactggtataatttgatcacctaggcttgtggttcctacacggggatgtagtagccttctcgaaacagacatttgagctcctctggctttcatccgagcttctggtgtttagtaggaaatagtctccgaagtgcaggtcatgtagtcctagtgttttatagttataaagctgaattgttcttacaggagttacagaggtctataaagaaaatgtccataatctctctgtcttcaagttctagttccttagccctaaagtcagcaaagttaacatttggtgtccattattcccacacttttctctttgttcatatcatcgtgtataaacatatacacaggctgggcatggtggctttcacctgtaatcccagcactttgggaggctgacgctgaggtgagaggattgcttgaggctaggagttcaggaccatcctgggcattaagggaagaccccatttctacaaaaaataaaatattacagctgggtgcagtggtgtgtacctgtagtccgagctactcggtaggctgaggcaggaagattgagcccaggaatttgaggctgcagtgagctatgattgtgccactgcactccagcctctatgatagagggaaaaaaaaatccatatacagacattgattattttatttttctttatggaagtgggattatattatgcgtgtaatttttataacttttcttaacagtatgtgagggtcatccttccagatcattacatatagctctaacattgttaatagctgcgtgatgctctataatactggtataccctatatgccacttattaataaacttaagttactttcattttttccatcataagtaagactgcttaatcattggaataataatagattttgttaaaaaggcacccctttggtataaatctcaaatggccactattttagaaacattaacatggaaaataatatttcttctaaagttaagattaacagaactgactttaatttgttttattttagttattagatcttttgatgtcaacaaacctggctgtgaagttgatgaccttaagggaggtgtagctggtggtagtatcctaaaaggagtattaaaggtaaaatgggttttggttgttgtgattttgggttttttttttttgttgtttgtttgtttgttttatccttgtcttaatcaggaaaaaaagtatggacaatccaaattgaaaaataaaattttttccatggtttctggtatttgatgtagagttctcttttttaatattctttttttctctcttcaaacttcactcctcccacccttctagacctctgaatccacaatctaccttcatgagatccacctttttagcttccacatatacagatgagtgagaatgtgtgatatttgtctttttgtgcctggcttattttacttaacaaaatggcctccaattctagatgtgctgctgcaaatggcagaatttttttttatggctgcataatacttcattgcatatatatatatgctgccattgcttttcttttcttttttttttttttcttgaggcggagtcttgctgtttcgcccaagctggagcgatctcagctcactgcaaccttcacctcctgggttcaagcgattctccctgccccagcctcccaagtagctgggattacaagcaccccccaccatgcccagctaatttttgtatttgtagtaaagacagggtttcaccatgttggccaggctggtcttgaactccttacctcaagtgatccacccgcctcggcctcccaaagtgttgggattataggcgtgagccactttgcccggcctatatactgcattttctttatccattcatctgttcatgggcacttaggttgattccatgtttggctattgtgaactgtgctacaataaacatgggagtgcagatacctctttgataatattgcttccctttctggtgaatgtatacccactagtgaaactgatggatcatatggtagctgtattttcaggttttcaaggaacctccatactgttctccatggtagctatactaatttacatgctctgataatagttttttttttgttttgttttttgagcacagtggcatgatcttgactcactgcaacctccacctcctgggttcaggtgatgattctcctgccacagcctcccgacttgctggggctacaggcactcgcaacctcgcccagctaatttttttggtagagatggggttttgccatattggccaggctggtctcttaactcctgacctcaggtgatctgcctgcctcagcctcccaaagtgctgggattacaggcataagccaccacgcccagctatatttctttgttttctgttatgtcttttgaatgtgtctgacttgaaaatttatagacttgtaagtatggagcacatttgatgtggtaatagacttgtgtggtgggtagttaacaacagttggatggttctggttttgacagtctcgttcacatctttttttttttttttttttaagaataatgatctttgaaatacaggaatgattgccttttcagttttatggtcttccggttggacctttattattattttattttattttatttttgagacagagtctctctttgtcacccaggctggagtgcagtggtgcgatctcggttcactgcaacctctgcctcccaggttctagcaattctgccgcagcctcctgagtagcagggattacaggtgcgtgccaccacacctggctaatttttgtgtttttagtagagacggggtttcactatgttggctgggctggtctcgaactcctgacctcaggtgatccacccgcctcggcctcccaaaatgctaggattacacatgtgagccaccgcacccagtccctgttggaacttttgataggtaaatgataattttgcgtaacacagtaattctaattactaattatatgtttacaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggtaaggatttttttctcatctcttttaatttgtggctatttgtggtacttttcatgggggatggattaccaaaagggacatattacagatttttaattgggtattttaataatagagtagggtggggaacaatcatgtggttaagctcttgttttaggttataagatggtttcatgggtttgtaaaaattatttttaaacacaaaggatacattttgatcaaatatagagtaactcctttttagcaatataaaaaaataaatttgatgacttatcatgtaagatatttacctacacttatgtttttgttaacatgatttttgtgctagataatggttgccttttttttttttgggagatggagtctcgctgtgtcctccaggctggagtgcagtggtgcaatcttggctcactgcagcctctgcctcccaggttcaagcaattcttatgcctcagcctcccgagtagctgggactacaggcacatgctgccaggcccagctaagatttttgtattttagtagagacggggtttcaccgtgttgcccaggctggtcttgaactcctgagctcaggcagtccccctgcctcggcctttcaaagtgctaggattacaggcgtgaaccaccatgcccggccatggttgcttttatgtatattttgcaaatggaaaattacctacaaatgtcagttgaatgatatcaggtcgtatttccaatgaggtagaaataaaagaaagtaaatttctttgtgtagcaattactgaagtgatttaaaaacttttctagtcccttacaacttagtgtattactcaatacccagaaaaatgaaagattcagtgagaattagaaggggtgttgtacctttagattaaagaagaaaatgtttggtaaagaaacagttaattcttcacccaataagttgtgtctctggttgaaaattttaaaaaggaaataaaagaaaacaaaaaaatgaaaaagagtttaccaggttggctgggcgcagtgtctcatgcctgtgatcccagcaatttgggaggctgaggtgggtggatcgcttgagctcaggagtttgagaccagcctgggcaacatggtaaaaccttgtctctactaaaaatacaaaagttagctgggtgtggtggcccacgcctgtaatcccggctactcgggaggctgaggcatgagaatcgcttgaacccagaaggcggagggtgagccgagatcacaccagtgcactccagcctgggtgacagagtgacactctgtctcaaaaaaaaaaaaaaaacaagaagaaaagaaaagaaaaaatgaatttaccaggttgggtatggtggctcatgctcataattccagtgctttgggaagctgaggtgggaagattgcttgagaccaggagtttgagaccagcctaggaaaccatgagatgccatttctccaataaaatagtaagattagctgggtttggtggtgtgtgcctgtagttccatctatcattttatcttttgtgtgcatgtgtgtggtaaacaagggaaatctggaaactttttaaaaatttaacttaaggaacttttttaatttcttttttttttttttttttttttgaggcagagtctcattctgccacccaggctggagtgcagtagtattatctcggctcgctgcaacctttgcctcctgggttcagttaattctcctgcctcagcctcccgagtagctggaactataggcacataccaccacagccagctaatttttgtatttttagtagagatggggtttcgccatgttggccaggctggtctcgaacttctggtcttaagtgatctgccctccttggcctcccaaaatactgggattacaggcgtgagccaccacacttggcctaaggaactctttaaacataggatagaatactgtaatgataacccccatagagccatcactcagcttcagcaattattaatgttttaccagtcttggctgggcgtggtggctcatgtctgtattcccagcacttcgggaggccgaggtggacggatcacctgaggtcaggagttcgaaaaaccctgtctctactaaaaatacaaaaaaaaaaaaaaatttagtcaggtgtggtggcacatgcctgtaatcccagcctgtaatcccaggtcacagtgagccgagatcacaccactgcactccagcctgggcgacagagactgtgtctcaacaacagcagcaaaaaaaagttttcccaatcaatcttgctccatctatatatcttctttcccctactcccctcaagacacagctagaatattttgaagtagatcccaggaatcatatgtagtttttttttttttttttttttttgagagtctcactctgtcgcccaggctggagtgcagtggcacgatctcggctcactgcaacctctgcctcccaggttcaagtgattctcctgcgttagcctctcgagtagctgggattataggtgtctgccaccatgcccagctattgtatttttagtagagattgggttttgccatgttggctagacttgtcttgaactcctgaccttaggtaatcctccaacttgggcctccccaagtgctgggattataagtgtgagccactgcgcctggcccatatgtagtctttaactatcttttcaatcagtctttcaggggagaaatggcatgcaggtattctgcaaactactcattttgaattttgtattctttcggtctttgttaaggatattcggactcattttgagttcacttattatctctatttgccctttgtttagaatttattgttttcaagaccaggtcagtaatacttaccatctcctgcattaagttctcagccaagccatcattcctagaaaatcagatttctaaaccctttgtttagaatttaaatcaagagaatcgttctgttctcatttgcccagtcatctcatgagtgtatatttctatttgtctagataaaacaggtattttcttgtacctatatagctattatatgagtataaaaataaaagtatgaaagtgtgtaggtatatgctgtgcttatatggctttggggtatctaattcactttttttttttttggagacagagtctcactctgtcacccaggttggagtgcagtggtgcgatctcggctcactacaacctctgcctcctgggttcaagtgattctcctgcctcagcctcccaagtagctgagactacaggtgcacgccgccacgcctggctaattttttgtattttaatagagacagggtttcaccgtgttgcccaggctggtctttaactcctgagctcaggcatccacctgcctcggcctcccaaagtgctgggattacaggtgtgagccactgcacctggccaactaattcactttataggtgttttaggaaataaaaaattgagctatatacatcttatttttatataggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggtaaatgcttttttaaaaattcctgtttctaaaaaagtgacaaatgggagtgttaaaccagtgttgagttttattgttttacagttaacatgaaattaagaaaaaaagaaaaggtaaataaatttgacctccccaaaattgagggtttttttttttttaatttagagatggagtctctcgctctgttgcccaggctggagtgcagtggcgcgatctcggctcacggcaacctccacctcctgggttcaagcaattctcttgcctcggtttcccaagtatatgggactacaggcacgcaccagcacgcccagctaatttttgtatattttagtagagatggggtttcactatatgttagccaggctggacttgacctcctgacctcaagtgatccgcccgccttggcctcccaaagtgctgagattacaggcatgagccactgcgtccggccaaaattgagaactatatggcagttagtttaagaaagaaacttaataaacagggaaaagtattagccatttatgacaaagacatgatattcctaaaatccatatttttgttttgttgtttattttgagacagagtcttgctctgttgcccaggctggagtgcagtggtgcgatctcgactcacagcagcctcgatctcccagctcaagccatcctcccaccttaacctcctgagttgctgggactacaggtgtgggtcaccacgcctggctaattttgtattttttgtagagacggagttttgccgcattacccaggctgatctccaactcctgggcttgagcaatctgcccaccccagcctccgaaaatgctgggattaacaggtgtgatccactgcgcccagcttcatgatttttaaaaaatgtcccagattaggttggcagagatgggaaattgctgacacctagtgttggcaaagattgaggaaaataagctatcatgcttttttttccccccactcaggtgatctgccttcctcggcctcccaatgtgctgggattacaggcgtgtgccactgcgcctggcccatattaactcttatatagccatagtccttcatgctcccctctttgggaaattttgtacctcatttgtactaggtaactgcttcagaattttaagaggtactctggtacggttactaccctattttttaaaggtagatcttgtgtaaattcagtgggtgccaaataaactatactatatatagttcaaattcctttacaatgaaatttctatagaattttttttatgattgacatatttcccaatagtatttggtaaattcttacttacatttggaaagcattttcttgattttggggtttatttttccctaatttatttttctaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcggtaagtttgttagtctttgccactgtctaattaaaaaaagacacagtcttgtacagaaaaaaaagcacacaatcttccttgaggacaacagttactgtggctttcagtctcaactatttatttggatgactttgaaaactatacttcggccgggtgcggtggctcacgcctgtaatcccagcactttgggaggcctaggcgggtggatcatgaggtcaggagatcaagaccatcctggctaacatggtgaaaccccgtctctactaaaaaatacaaaaaattagccgggcgtggtggcgggcgcctgtagtcccagctactcgggaggctgaggcaggagaatggcgtgaacctgggagtcggagcttgcagtgagccgagatggcgccactgcactccagcctgggcgacagagcgagactccgtctcagaaaaaactacaaccttgactatagtcccatattttagtccaaatactgtgattggcttctcttcctgttagacacaacctatgcaaaaccaaatgaatttgggttcggtatttctatcgtcattggctttggaaatcatttcacacttaatagaaaaattgtaagagttttacagaaaactcctctatagctttttcctagattgacaaacacacatacagatttatttacatatataagtttttttctgaaccatttgagtgtaggctatatatgttatgcttcttgatctcttaatacttcagtgtatatttcccatcaaaaaaggatattcttatgtaaccacttagaaatttaacattggcaaaatactgaaatctacagtgcatgtttcagttttattacttgtcccaataatgtactttatgttcctcctgtttagaatcttgaattgcatttaatttcatgtctctttgatctttaatctggagctttttcagcctttgtcttaattgacattaacagttctgaagaatacaaactagttactttatagaatattcctcaatttgggtttttcttatcattcggaagcctaacattagattcagttatatattcttaacttaaatacaccgtgaagtctccttttcaggaatcacagctagaggcacatgatatctgactgctcctctttgttaaggttagttttgactatgtagtcaagatgttgtccagcttctctgctgtgtagttactctctacccttgcaactaataagcaatctgtagggagatctttctagccagtacaaatagcctgctgatcattgaatcccacacccctggatgtagcatccactgatgattcttgcctgaatcgaacttgactataatgattacaaaatcatagcacctctacgggttgcagtatcctccctcaactctaccaccccacatttatcatttggcattctttctttgccattatttatttccctatctagttataatatggactcatggagtcctattttattcaacatgttatgatccatcactgtcttcctttattttgatgtgcattgttcgacgtttggccagtggaggtccttcaggctggctcttgtgtccttttgacatgtactcatcatttttttttcttcttctttttttttttttttttttttgagatggagtcttgctttgtcgccggggtagaatgcagtggcatgatctcagctcactgcaacctctgcctcccaggttcaagcaattctcctgcctcagcctcccgagtagctgggactacaggcacacgccaccacacccggctaatttttgtattttcagtagagacggggtttcaccacgttggccagcctggtctttaacccccgacctcaggtgatccgccctccttggcctcccaaagtgctgggattacaggcatgagccaccacgcctgacctctttcttcttttttttggaacatttccttattttctggcacaaaatcttccagactcatcttgtaccttctctgttccagttttagaactggccatttctcttataaatgaaaagctgagtgttcaggtgtgctcatggctcttagggtgctgttgcttctaggtcttttgagagcatagagccaggaagcatacacacatttttggctcctgactttttgctctttcccaggttattgagtttgccccttgctttccattcctcgtcacctcatcacagtccataccaccatcactttacacttcacagttagtgcgaaagactcctagtttgcctcttaacttggtcaaaattagtcttcttaaaacattttcatcatgctgtgtttaataatttctagagtcttctcactactttttgatatttgggacttttctagaaacctgcttcaacccatttaagctttccttctgcattgtcttatataaaccctctaaattagactgttttgtgccctaactgtccccataattattcacatcacccctacccactatctacttccttaattatttattttatattttttagaggcagggtctctctgttgaccaggctggagtttagtggcatgatcatagctcactgcagcctcagtgtctaagtagctaggactattggctcacaccaccgtgatcagctaatttttttgttttttgtagacacttggtctcactgtgttgcccagcatgatctcaaactcctggcctcaagccatcctcccacctcagcctctcaaagtgttgggattacagacatgagccaccccgcccagccctgtttcctttattaaggcttccatgctactgtgcccacgatggtctcatcacttgtccaggagatttatctgaattattgccctgtaatttagaaagttaaatttttgttgtctcttaagtaaataattatttgtggtgacttatgcccttttgattttactgtcttttgtgattatatttttttgctattacagacacacgacttccagtgtattttgaaatagatttaagcaataaactttcagtccaggcacggtggctcatgcctgtaagcccagcactttgtgaggccgaggtgggcggatcacttgaggccaggagttcgcaaccagcctggccgacatagtgaaaccccatctctactaaaaataccaaaaaatcagccgggcatggtggcgcatgcctgtagtcccagctactcgggaggctgaggcatgagaattgtttgaacccaggagccagaggttgcagtgagccgagatcgtaccaccgcactccagactgggtgacagagtgagactgtctcagaaaaaacacacaaaagcaagaataaaaaagaatctaagaatatagtgtgggctttctttatggaggagcaggctttgggaacaaatttgaattcagaagataagcaggtaaaatttatcacaagattgtgtggtaatgagagtgaagtggatgtaagatttatgatttcttttattttcattttgcagtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattctctttttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagc

SEQ ID NO: 36738 - DNA, 12369 bp, Homo sapiens
cttctctgcctctctctcctccacgctgctttgatttcgctcttgcctctcttcttgcgctgctcagctgggaacatcgtctcaccaggggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccaggtgagtacccttcctccctggaacctgctgctgttgatcctgagtagccgggatctgggggctctagggtcctgccaccacccagggtgcccacctggactgccaggcctgacgaccttgtcccctctccccccccccggccaggcctttggcaaagtggttaatggctgaatccagtctctggggcaccacagttagtcaccccgtgaccgttctgctgcagtcagcgatgccaacagggacagcagggtgggggaagcattccctgtggcagggtggctgtttgaatgggcatggggaaggggcaccggtgtgcgcggcgtgtgtgtgtgcgcgctcgcgagttggctggaggcttgctggcgcagataggtccgtctgtccgcagtcatgctcatgtgtgggttttgaatggtgtgaggcatgtctagaaacatatctttctggcacacgtgaggtacatgtgtgtgggggacttatttgagtagcctgtgggtgtgcgtgggtggggacactatgaggcagtatatttaggggtaaccatgtcccttttcatgtgtgtgggagtgtatgcagacaggggctttctatatggggaggtgagacccagagcaggatggagtgggtaaagagaagaaggggcagaaaccattgtctgtgggcagagccacgtaggtgcacaaacctgttggcatgaaggctcagggctggcagagtgtggccagaggcaaacacattttcaaagtctgtctttgagcctggagatgattcgagagagaataccagacttcgggcgggggctgctgtgtgtatgaacacacatgtgtgtgccggcaggcgtgtgggttgcgtgccttcttgtggaggtggcacacatgcatgttggtgcctgtggcatcctcttttccccacatatggcttgtgaggcggtgtgcgtggacgtgtgtgtgcgtgagcctgtggacatgaacatgtctgggtgtgcatggaggtgacagattgaagagggaaaactgtggggcattcttagaatgtggaaggtggcagcaggcacctgaatgtggagatgggtgtgtgggagtgaggacatctgcggaggtgtgggacgcgggtgggtgggcactcttggcgcatgtgtgtatgcgcgtgcgtgcctgcctgtgtgtgggtgtgtacatgcctgtcttggggtggatccacacaggagtgtgggtgtttctcgggtgttgcctcaacctgtccctcacaccctgcccttccccagtcttctgggtgtagagaacttgggttcacacccacccctctgtccaccccagctcactcactgccaccctcccaagctagcggggggatgtcatctcagctttcccagaaccgtagggagggagggacaagcagacacccaggtcctggagacccctaccgccaaacacagctgcccctatttctaggaggactccaaggagaggcaggaataggtgcctactcatgggacgagtgtgggctgcctccgagcgtgtgggtgggtgccgctcagggcctcttgggtaggagtgtgtctgtgttcgtgtgtgtgtgtgcgtgtgtgtgtgtgaggggcacatgtgtgtctccctgggagcttctcaccaggttcccaagagatggtaactccccactgctccacacctgtccccatgaattacaaactggtttattatggtagggttgtttccagacactcaatcccatctgcctgattttggggtgggcctggtagcaccgccatgcttatttaccataggattccccatgcacaaagccaccggcatttggctgtggggtgggaggctaagatgaaacaggacttgagtgacacctggagcaggtaagggccatcacctttagccttcaccctgtacttgccatccaggcaactcacaggttaatacagaggtgccaggctctggagcaagcttaattgacaggaaggtgtgggctggatcctctggaagctataaataaaagtacctgcttttgcaggcacaagatgccctcaccactagctcctgggcaaggggaggagaaaaagaggggagaaagaagagaaggaggtgacatttagaaaaatgaggggtgccaggaactgggctggaggaagggattggaaagcaggagaccaaatgcccctggagaatgccccacccacgtctgctgtcccctcccagacgctgtcactccccttccctttgctcttccccatcccggagctaggccagccaggccagagtcatggccagagtcagctcttcccagctaaagcacacatgagagtgaccgtgatgaggtcctctcatacctggacgagcagcagacataaggggagaaccaaaggagtaagacagggaggggagagaaaatgcagttgcttgaaaggaaacgatggaaggaggaaaaatgccaggtggaaacaccatgggcacccatgcatgcacacacgccacacatgtgcccctccacccccacacatgaggggacactatcttagcttagtgatcaagagcttgggtgccggagttcaaatcatttgctctctgcgtggccttgggcatgttagtacctccccaacctcagtcgcctcatctgtaaaatggagataatgatagtgtgtgcctacttccaaggttgcatgagacgtctgtgaaattatgagcacatggccggcccctaatagatgttaatgttaaaagtcatgattgaaaggagtcaagagaagattggccgaaagagaaagagggatcatcaaaaaaagttatgggtggaaaaagagcttgaagccggctgtgccgcgtacccctcccaccacgaatgtgtccacatgcaccaacgtggcacttgtccttccagccatgtaccgcggcaacgcttgctgaccccagtgaggagagaggcctgaatccgagggccctggcacctgtgagctcttggctgtcacctgccccaagcctcgcacctccgctccacagcaggtgcttcctgcgtttcctccgcctctcacccgtcctctccacccccacccctttctcttttcacgcctgctggctgagggccccctccctcctcggctccatctgctgcaaatctgtccccgcccggctttgcagcattcccactgcctctgccacctgtcaggtgccgtctgctctgcagacccctccgaggagagcaaagagccccccgggcaggcacccctttccaccctccatcatccttctccagcctcccctgtacagtctttcccatctggttcatgaggcatgtggattccaggggtccttgaggttccgcctcgaaagggatattgggaggaggacattccagaaagctcgccggggtcaagggatgtactgaccctttccctcctcctcagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggtgagtagaaggtgtcctgggagcccctccccagcttctgttcctgaaggaggccggataagggaacacctggaagtgatggcttggagtcagaggctggttaaaatccacactcttcttcctgtgtcattttgggaaagttacttgacctctctgagcctgagctccttccctggtaaagagggaataacaatgccaagcctcacggggtcgtggagaggatgcagtgagtcatgtttgcgtggtgcttggcccggcgcctagcacagagggagcgttgttatcagcgccacaactgagacttcaggcaggggcagagagcccgggtagggtggggccgcaggcttcgcctatggggatgacgtctcaagtctcgacaaagccccggctcagggcacagcctcgctgttggctgggtgggccacacgggcctcggtcggggcggagcccttttgctgtggcctcagttctccctctcgggcccctcacctgctggcctgccatttgcttgacttagaaaaggaatgggagagagtcctccgtgggtgtgtcctttcctggggttaaaagccagtgtgggggtgggtgggaggaagacccccatcctctcaagctggcagaggcagggggagtgaggcggccagctggctcccaggccgacggcaccggcgtgggttactcacccgctctctttctctggaaccggctctcccgatctgggtgtcttttggcaggccagttgccacggtgacgtgaatgttcaacaccacccccttaaccctcccccccaaagaataaggcatattttcccttcctccctggcttctcagcatttgccgttgccgtggagacggcactgcagtgtgcagagctctcaaagtctccttaaaaaatgaaggccttgccgtcctcaactttgtggcttttcccctccgttcccaagagaacggggtgtcaggggggttcgaggaggggccaaggctgtggagtgtctgggtggccttcccaggaaaatggtggccagggtatggagccattggatcctcaagattggtcctgctcaggagaaacagggccatctggggagtggggattctggggtgatgcccagattgggcatgaacccctgtttgacgcctggctctctgtttgtaccctgtttctcaggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactgggggtgaggccctgctatcacacccctgtcctgctgcttggcacgtcgggctttgctgtggtcaaggcgggtcttcctcgtagtccagcaaacactgatgaacaccttctgtccaccaggcagcgtgcttgggccacaggggagatgcacgggcatgacaccctccctgcctccaggagcccaacctttctcttctctcactggaggcaaatgcgaaccccactaatcacgctggcaagaccacttccattaagaaagggagttacttttcgggcttggtaccagatcacaggcatctttttaaaccttgtggtcaaaggtgcatgacgtaaaatttgccgtctcgaccattttgaagtgtacagttcagtggtattaagtatattcacattgttgtacagccagtctccagaacctttcttcctggaaaaccaaaactctatacccattaaataaccgccccccatttccctctgctagctaccattctactttctgtttctatgaatatgactcctctaggtgtctcatatcagtacaattgtataggatttgtctttttgtgactggaatataccaaaatttccttcctttttgaaactggatagtatttcattgtatggatagaccacattttgcttaatcaattatttgtcaatgtgcacttggtgaggcaatcacatttcacttgttctgagccttcacgtagcctgggaaaatggcccctggtcaatggccccgcaaactctcttagcagaacttaacttgtagactccatcacaaacaaacagtgggcctatgtgtgcttggtccctcacgactcagggtctgcccccacaagattacattcttttggtgttcacggtgagagctgctccagatctctctgtcacacagaagagacacggaacattctcagccccgggcctctgaggctgctggctctatcctttgccaagatttatgccccaagtctccttgagctgctgttgtcttttgagtggtgctttttcttttttttctccttctgccttttttttttttttgagatggaatctcgctcttgtcgcctcctggctggagtgcagtggcgtgatctcggctcactgcaatctccgcctcccgggttcaagcgattctcctgcctcagcctcctgagtagctgggattacagacgcccaccaccatgcctggctattttttttttttttttgtatttttagtagagatggggtttcaccatgttggccaggctgatcttgaactcctgacctcaggtgatctgcctgccttggcctcccaaagtgctgcgattacaggcataagccaccatccctggcctttttcatttttattttttgagacagggtcttgctctgttgcccaggttggaatgcagtggcatgatcatggctcactgcagcctcagcaacctcctccccacgagcccaagccatcctccctcctcagcttcctggcctcctgagtagctggaactacaggcacatgccaccattcctggctaatttttgatatttttttgtagagatggagtttttccatgttggtcaggctagtctcaaactcctgggctcaagtgatcccaaagtgctgggatcacaggcgtgaaccactgctgctggttgagtggtgttttttcttagctctgctgcagaaccccactctctggaggcctcttgctcctggtggggaaagcttcttggtttacccctgagacctccatgtgcagtgggcatttaattcaaattggagatctggctgcaatccagtccacactcctctctccaaaccaagcaccctggccagggatgcagccacaaagagggaagggcatcttctaatttgtaccaaggagctgtatgtgccagcagcagccttgctggggccccagggttcaatgttgctatcctgtttccagccttccctgtttctcctgagatgctcaagctgagagccattgctccagacccaggactgcctaaacattgcctgggctcagttctccctagaccctcacgagccgtcacctgtaattacagctggcttccatgggggtggtgtgggcagcctcctatctactgtatttgagagactttcccaaaaggacctcaagccctcccgtctcaagtcttcctttttcccaggggtcctcttttcacatgaggatggcctgggatcacagcccctgaggaccctggcaggataactgggcagccctctgcctttttctgacccggagagcccggagcctctggcaatgtggttgcagaggtgatgacgacagacagtatgcagcgctctgtgtttccagcagaggccagctggcctgttcccatctgagtttaaggttctgcgactgtctagtctcccctgctgctctggcggacagaggttggccggcacacacagtgtggggtggggtggggacaggaggtgtttgtgctcctcagctggccctcggctcacctaccgcatctgggatcttgcagattatgccaaggagcacctggctcagcttcaggagaaagctgagcagatcgcaggccgcatgctccgcttctccgtcttctaccgcaaccatcacaaggagtacttccagcatgccaggtatgggcgcgggctcccggctggacccgccgggcctctcctccctcccagcccttcctgctcctgtcctggctgtctgaggtcacccccaccctcgtggctgccagtccctcctctagggttgacatgtcctgacgtcaccaggctggctctgaagagactgctactttggggattgggctcagggaagatcaagggctctggggacagggccttctgcaagagtgttgtactaatgagcctgggagaatgaggtctgggtttgctcccactctgggacagttcctttcacaggggtctaccaccacaggtctctccgattcaggccctggggccaaagggaaggtggcagggagtgcacaaaatgagtgttctgatcacaaagggttcgaggaagcacccagctcgtcggttttcaaactgggtgctccctccagggagacatgtcagtgaaccccttagaatgctgccatggggttggggggaccagaggttgaggcttggtgggccccacacctgacctccagtcagagtagcctcaattttatttgcctgtgacccttccacgtataatttcttttggggataaaaagagagttgctgcagtccaaaagtgtttgaaaattggtgatctgatccaacaccctcagcctacagaagaggagcctgaggcccagagggaagcacttgttcattcgagccagggagtcacttgttactgaggacagccaggaccaggcaatgtgaggcaggaccaggagtacccaccatccccgggcctgctggcaagtgctccaaggccgcatccttctgaggctcagccagggcaagcagctgctctgcctttttttttttttttttttttgagatggcgtcttctctgtcacccaggctggagtgcaggggcgcgatctctgctcactacaacctctgccttctgggttaaaatgattctcctgcctcagcctcttgagtagctgggaccacaggtatgcgccaccatgcccggctaatttttgtatttttaatgaagtggggtttcaccatgttggccaggctggtctcaaactcctgacctcaggtgatccgcccacctcggcctcccaaggtcctgggattacaggcatgagccaccacgcccggcctctgtctgtctttatccttacagtcagggcagttttaacctcagggcagtgaggaccttgggagtctttggggtttgtattaaagaagcaaggcctgcttggtggctcaagcctgtaatcctaccacgttgggaggccgagatgggatctcttgaccccaagagttcaagactagcctgagcaacatagtgagaccccagcctctgcaaaaaatttaaagaattagccgggtgtggattgcttgagcccaggagttcgagcttgcagtgagctgtgattgcaccactgcactccagcctggaaagcaagtcagtggcccagtttgggctcctttatcagcgagagtgggagagatagagagcactcatgggtgccaggcaccttacttggtgccaggatgtaaagataaaggcacagttcactcttttgagaacctcagaatccagtcagagagacagtatggaaagatttcatgtaaaaagtacgtgtaattgttgagcacagttcagtgtcctggccaggtgaagtggctcacacctgcaatcctagcactttgggaggctgaagcaggaggatcacttgaggccaggagttcaagtccagcctgggcaacatagtgagaagattgggtgtcctgcacatagtaggaagccaaaaatttgtcaagtgcaggtgtctgctgttcctgggaggttttagaggggagcagacgcttgactgaagcttgaaggctaattagaagtttgccaagccagacggaggaaggtggagagggcagtcagtgcagcagagggaagagtcctgcataggggtcacggaggcaggagactgtgtgtgcagggggtgggtaagtggatggggtggcaggaggtggggagtggcaaggagaccacagagatcagatcatgagccgccgtgtttttcacacacaccccatcaaagggtttcaagctggggagtgacagcttcatatctcttctctgagaaggagtgggctggttgaatccctctccagggccctccctgctcttgcattctggaatgttctatttgcgactagtggaggcggctgggggagggctgggagctgggctggcttcctccctcctcgaccacacgcagcagccaagcctcagcccggctcaccagccacatcttctcttccctttggtgtgtctccctggggtgggcaggacccactgcgggaacatgctgcagccttacctgaaggacaacagtggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagg

SEQ ID NO: 36739 - DNA, 73564 bp, Homo sapiens
ggcggcgcaggcgcactgggttcgccgcgccgaactgcagccatggagcaggcacctccggaccccgagcggcagctccagccggcgcccttggagccgctgggctccccagacgctgggctgggggctgcggtcggcaaggaagcggagggggccggagaagagagctctggggtcgacacggtgaggagaaggggcggcagagccctcatggcctgtgtggtggcctagcgggccgggctgggctgggctgggctgggctgggccgggccgggccagtgggctcggccgaggaggcccagcagtgagggggagcgaggtggaaaggcggggtccgcaggtgcagtgagaggaggctcagtggaaaaacagggtgctgggtgtggggcgagcgccaggcgctgcgggtgactgagggaagtgtcgagactgcgaaggggagggaaagggacccgggggggcgcccccgcaggcgtgggggtctgggccccggatgggcgaggctggaggagggggttttcagtggtcgcgtagctgggagatctggaccgtgagaagaacgctgatgtttcagccagttgctaaggggttttgctggggagtagcttaaagggacacagtggggagtgggcaacagtgcttgagaaggaagggaatgggggactagagtgaggtgcaggtcagggccaataagggtggttggcctggtgctgccatcaggaaattgaagaaaatgtcagcttcaagaaaaggtacaaatgagaaaacattttttagactcctcatttggctgtaatttctttgttttgggggaagtgctgtgtttcccattggagacttattgataacccatgtactttttgaagaccctttagtaattagtgattttcatttgcttgaggaaaaggggaaaaatgtatcatcttatatttgtaagtgctttcattacaaagtgtttgcatatacaattcaagatttgtagacctgcttatattgaaacctttaagaaactaactgcagtgctccacatcagaccaccctgcccaaagtctccttttgtgtgcattgctcacacagctcacttcaccctcgaccccccaggctcaaacaatcctcctgcctcagcctcctgagtagctaggactacaggcacacaccaccacgcacggctaaattaattaattaatttatttatttatttattttgagacatagtctttgtcacccaggctggaatgcagtggcacgatctcggctcactgcaacctctgcctcccaggttcaggcgattctcatccctcagctacctgagtagctggggttacagatgggcgccaccactcccagctaaatttttttttttttttagtttttagtaaggatggagttttgccatgttggtcaggctggtctcgaacttctgacttctagtgatccaccctcctcggcctcccaaggtgctgggattacaggcgtgagccatcatgcccagccaaatttttgtattttttgtagagatgggttttcaccatgttacccaggctggtctgcaactcctgggctcatgcccacctgggcctcacaatagtgctgggattataggtgtgagccatggtgcccggcctgaaagacttttaagtttagagaccagctaagcagggacttcaggatttgaaagttttgcctgctgtggaacatacctgggtatataaggtagcatgaagacttttttggatgtgctttttttttctttgagacaggttctcactctgtctcccaggctggagtgcagtggcacaatcatggctcactgcaaccttgacctcctggcctcaagcgagcctcctgcctcagcctcctgagtagctgggactacagatgcatgccaccacacctggctaagttttggggttttttttgtaaagatgaggtatctctgtgttgcccagacttgccttgaacttttgggttcaagctgtcctcctgcctcagccttctgagtagctggggttacaggtacacaccaccacaccctgccattaggtatttaattaatatgaaattgcaactagaatataaaatctgtttatgttaatttaaaaggcattatatatgtcttttattaattgaaagaacactatgtatatgtagttctaaatatttgaaaacccagggatgctatcatgcagtataagttgtagttacatactacttcctgacatttttattctttttttttgagcagtctcttgacctgtcacccaggctggagtgcagtggcgtgatctcgggtcactgcagacctctgcctcccaggctcaagcgattctcatgcctcagcctcctgagtagctgggattacaggtgtgtgccaccatgcccagctaatttttgtgtttttagtagagttggggtttcatcatgttcgccaggctggtctcgaactcctgacctcaggcgatccgcctgcctcagcctcctaaagtgctgggattacagacatgagccactgccctcggcctatgtggtttcttaaaacaactccctaatttagtaattcataaagaggcacaagccatttgggcaaatatttcagaattactaggtgtttaaacaaacatacattcagtgcattccttccccttcccctcctctcccctcaaagagaaaatcaaactaaaaacccgtcctttgaaggtcttcacatcccttcacttctctccatactctctctcactcagtctgtcttcagttgaaaattactgtaatgtttttatggcctcattgtagctgttactgataggaatttggtctcaccagaaaagtaagttagttttgcgtgtgctgtgcacagtggggctctacttttcatttaattcccaaaattacttccaatagatgggtaaatggaaccagccagaggctcatagagaagtaatttgaccatggtcacaagctagtcagtagcatggctgggatttgaatctaggttcacctggcattgaaatcagtgcttcttccattaagccattttgcttcattaaaaaaaaagtttaaaatagtcttgtacattgtttcaatactgaattttaaagtttttagtgtagttaacactaagttgtaatttttttagactagtcaagtgcagtagtgagaaggggggaaacagtagaacaaagagtttgatctgtaactgatttgtgaaattgagataacttactatcttcagaccagcctaagttgtaattttggaaaggaaaaaaaggtttgaaagatgtgttgatttatccatttttttactacaaagatgtctaggcaaatagtgttcagagatgaaaaaacagcttgcttaaccaccattttttttcttttttgagacagaatcttgctctttggccccagctggagtgcagtagcaggatcctggctcactgcaaactctgcctcctgcgttcaagtgattcttgtgcctcagcctcccgagtagctgtggttaaaggcatgtgcctctacacctgactaatttttgtatttttagtaaagagggggtttcaccatgttggccaggctggtctcggactcctgacctcaagtgatccacccacctcagcctcccaaagtgctgggattacaggcgtgagccgctgtgcccggcccagccttatttttgactgcagattttaagagggagagtaatttataccaattatcctaccccaagaggttgtggaaactgcaccgccaaagagtcacaagactcttctggttttaacaccactgatcaggattctttaaactctatgtaagctctttttctgtagttttttaaagctatagtcagttctatttaaaataatttggaaaatggaaaatatgagaagggaattcattctctaagaaagtagtaattagcccgagcagaaggagaggaaatagcaagggagtggaggacagagtagttttttagattccattgagttggcagttaacagacaggtatttgccagagaaaaaccatttacagtatttgccagagaaaacccattacctgaggaattcataagtgatttttagggagagtgctctagacctgggaatgctgatggagcagagtgattgagcagctggtggttaaaaattcccgtgcacattgactaccttcactgattggcagcagagaactaaatggagtagaccagattgtcggtaaggtttgaggcattctgttggtaaggataacattaaaaaggaagataaagattataggcataattacagaattcatcactttagcagcagatgataaaatcatactcactaattttttattgattgagaagaggtctcactttgttgtccaggttggtctcaaactcctgggctcaagtgatcctcccatttcacctcccaaagcaccaggattacaagagtgagccacagcacccagccccaagaacttttaaaaaccattttctacctcagtggctctcagatttttttgaaggtgattcacagtacaaaatacattttctttttttttttttttttttgaggccaagtcttgcactgttgcccaggctggagtgcaatggcatgatcatggctcactgcagccttgacctactggtctcaagcagtcctcccacctcagcctctggagtagctggaactacaggcatacaccacaatacctgactaatttcttctattttttttgtagagacaagatctccctatgttgcccaggctggtctcaaacatctgggctccagtgatcctcccacctcagccccccaaattgctgggattacaggcgtgagtcaccatgcccgacccaaaaatatatatatatatatattttttgagacagagtctccctctgtcgcccagattggagtgctgtggcataatctcggctcacttcagccttcatctcccgggttcaagcgattctcctgcccaagcctcctgagtagctgggactataggcacacgccaccacgcctggctaatttttgtatttttttttagtagagatggggttttgccattttggccagcctggtctcgaactcttggcctcaagcagtcctcctgccttggcctctcaaagcaaaatacacttttacatcataatcagcgtacacatactttaatatgtgattgttgtttcaggaaacaatacttagccattactgcatgcaacactttctgatatttttctatatttttaaattaaaaagaagcattgggctggatgcagtggctcacacttataatctcaggactttaggaggctgaggcccatgccttgagaccagtattgggaatgtagggagacccagtctacaaaaaataaaaacattagcctagtgtggtgacctgtgcctttggtcccagctgctcaggaggctgaggtgggagcaagaaccagggaggttgaggctgcagtgagccatgatcatgtcactgtactccagtctgggtgacagagcaagaccttgtgtcaaaaaaagttttggaggccaggtacagtggctcacacctgtaatcccagcactttgggaggctgaggcaggcggatcacctgaggtcgggagtttgagaccagcctgggcaacattgtgaaagcccagctgtactagaaatatgaaaattagccaggcatggtggcacatgcctgtaatcctagctacttgggaggctaaggcaggagaatcgcttgaacctaggaggtggaggttgcagtgagctgtgatcatgccactgcactccaccctatgcaatagagcgagactcggtctcaaaaaaaaaaaaaaaaaaaagtgttggtcacaacccaccaaattaatttcatggaccatgaatgtgttactcagtttggaacactgttcaaacttaacatattgttgtatttaaaaattaatgttttctgaatagctctgctgttattttaaaagtatttttatagaaaaaagcacaagagaactggtcatatgttataaccctatttttcttagttattgctttggattgaatgtttctgtctccccaaaattcatatgttgaaacctaatcccattgtgatggtgtttggtggaagggcctttggaaggtgattagatcatgaggatggaggcttcgtgagtgggattagtgccctttaaaaaaaaaaaaaaatccagaagtctccttttttccagccatatgaagatacagtgaaacacagctgtctgtgaaccaggaagcagaccctagcggaatctgccagttccttgatctctgacttcccagcctccgggactgtgagcaataaatttctgttgtttacaaatcacccagtctatggtcatttgttatagcagcctgaactaagttatttactgcttgaagtaagcatcactattagtaaacacaacatttttaacctagtaccagctacctctgatctgtgtagacagagccccaaagggaagtgatttcaataggtggttcttatccttaactctctgaatgtttcagtaacacggaagcatcacgcctagaaaaaaggtgataaggaagtataccattatagtaacagtggttagtgctgggttgtgggatacagatgatttatatttacttaatttttttcagtgtttgtacatttagcatgtataattttcatcatcaaaaaatttaaatctaaaaataatggcggaaaagtaatacttgagctcttgccatatgccaaacaactttaaaaactcttgatatgcattaacccattaaatgttcccgatgactttgtgaattaggtactgtcttagtctgttcgggctgctataacaaggtaccaaagactgagtggcttataaacaatagcaatgaattgcttacagtcttcgaggctgggaagtccaagattaaggaactggcagattcagtgactggtgagggctgcttcctggctcattgtaggctgtcttttcactgtgtcctcacatggtggaaggaggagaggaactctctggggtctcttttatcagggcactaaccccacttatgagggccctaccctcatgtcctaatctttccaaaggccccacctcctaataccatcaccttgagtgttaggattttaacatacacattttaggaggacacaaacattccatttattgcaggtactattatctctgttttccacatgaggaaactgaagcacagacaggctaaattacttgccctgcctggccatcatggcgaaaccccatctctactgttaataaaaatacaaaaattagttgaatgtggtggtacacacctgtaatcccagctacttgggtggctgaaacatgagaatcacttgaacccaggaggcagagtttgcagtgagccaggattgagtcactacactccagcctgggtgacactctgtctcaaaaaaaaaaaaaaaagttgttgtatctgttgaccctgcactgaggtgagaggattgcttgagcccgggagtttgagaccagcctaggcaacatagcgatacctcttctctacgcataatatttaaaaataaaataaaaattaggtgtctctttaaaaggtccctggtctcatctgccattcaacaagccagtccatctttaaatctgttgaatgtgtccttttaacaattatggtgttcagttgtgttattcttggcactgttctgtactttactactgacagtttcagtaattttatatcatctaccaaccctactggtattattgttgtgtgcctgtttgtattctttagcttttatgatagctgattttatgcttttatcttttttccttctttgtaactggatggtatgacagggtcaatttatgattcatatgtcttatctttttgactggggagatattaataacttgctttatcagaatgtgctttcagaattcagcgaatttgtcactggagcagatggtaaatcaaactgcttggctgtgggccagaatgtattattaatacatgtatatatgtatgtgtcaaccaatgagggcttcataaccaaccctgatgttgggtggcttgtgcttaggtgatttcttgagctttcttttggttgatgatttcctgctgtctctcttattttcttagtacataaatatataaaaacttatattttataaaaatgccttgaggactgagatttttgtttttgttggctgatttcaacccactgggttggctctttttctttatcttcttttagcatttttaccttcttcctcatttttcctgtacgttttgggagagctgtgtagtgtatcatctgttttcattcctgattcatatttttgcactgtcacagacctctttcagaccttatagtggctaggtttaatttgatatgtgtagctttttcttgtaccctttgctgcactgagtttctacttttatctctccttcataaaacactccaattataatacagtacaatattttaaattaagttaaaacccacctcaattttgacagtgagcaaagaagaaaaaaaaagccatagcatagcagttatcctgtggtctcactttctcttccttgtttagacttggagttagtttgggtgtatttgaaacctttctgcagtgatgcactttctgaaacatatggcctagggtctgccagtggtgtatttattgttctttttcaccttttggtatagacctgagatattctagtgggaaaagaaaggagtctgctcttcttaaaactctgctgcctcaagggtggagcctattaaccactgccaaaagtttagatgaatttaaagtttaatataagatgactcctgattgttaaaaaaaaaaaattatgctaactgctgataatcttgcctttcggcatatgtataatatttgacttttgagagagagattcgattttggttaaaccccaaattagatatcaatattgaggatcattcatatttttataatgtgtttattcttcagtttaaaaaattgtgttaaactgggcacggtggctcatgcctataatcccagcactttgggaggccaaggtgggtggatcacctgaggttgggagttcgagaccagcctgaccaacatggagaaactccgtctcaactaaaaatacagaattatccggtggtatgcatgcttgtaatcccagctactcgggaggctaagggaggagaatcgcctgagcccaggaggctgaggttgcggtcagccgagatcgtgccattgcactccagcctaggcggtaagagcgaaactgtctcaaaaaacaaacaaattgtgttaaaatatatatgatataaaatttaccatcttgatggtttaaaaatgttcagtcataagtacattcacgtacattgtacaaccagcctccagaactcttttcatcttgcagagctgaaattgtacctgttaaaccacagctacctatttccccctgccgcagctgctggcagccatcattctactgtctgtatgattttgactattccgagtacctcatatacagggaatcatacagtatttgtctttatgtgactgttttatttcacttatcataatgtctttaagatatatatatccatgttgtagcatatgacagaatttccttcctttttaaggatgaatggtattccattgtttgtatatatatcacgttcaaaaaatccattcagccgggcgcggtggctcacgcctgtaatcccagcactttgggaggctgaggcgggtggatcacaaggtcaggagatcgagaccatgctggctaacactgtgaaaccctgtctgtactaaaaatacaaaaaaatagccgggcgtgtggcgggcgcctgtagtcccagcttctcgggaggctgagacgggagaatggtggcgtgaacccggaaggcggagcttgcagtgagatcgcaccactgcactccagcctgggcgacactgcaagactccgtctcaaaaaaaaaaaaaaaatccattcatctgttgatggacatttgcattgcttccttgttttacctattgtgaatgatggtaccatgacatcatggatatgcaaatatctctttgagaccctgcttttaattcttttggatatattaggcagaaatggaattgctggattatatggtaattgtatttttaattttttgaggcaccactgtactgttttctacagcagctgcaccattttacattcccgccaatagggcacgagggttccaatttctccacatcctcaccaacactgattttctattgtttgtttttcatagtagccattctaataggtgtgaggcagtatttcattgtagttttgatttgcatttacctaatgatgagtgatgttgattatcttttcatgtgcttcttcagaaaaataaatgtctgttcaagtcctttgctcatttttccatttttgaattgggtctttttttttttttttttttttttttgagacagattctcgctctgtcacctaggctggagtgcagtggcatgatcttagctcactgcaacctctgcctcccaggctcaagtgattctcctgcctcagcctcccaagtagctggaatataggcaactcaccaccacacccagctaattttttgtatttttagtagagacagggtttcaccatgttggctaggctggccttgaactcctgacctcaggtgatccacccgccttggcctcccaaagtgctaggattacaggcgtgagccaccatgcccagcccaattgggttgtattttgttgttgagttttgggagttctctaaatagtctggatccgtgagagaaaatactttcttctgttctttgggttgcctttttactctaatactgtcctttctctcttttttttttttttttttgagacggagtttcgctcttgttgcccaggctggagtgcagtggtgcaatcttggctcatcgcaacctccacctcccaggttcaagcgattgtcctgcttcagcctcctgagtagctgggattacagatatgacaccacgcctggctaatttttgtatttttgtagagatgcggtttcaccatgtgggccaggctgatcttgaactcctgacctcaagtaatcctcctgcctctgcctcccaaagtgctgagattacaggcatgagccaccacgcctggcctgttaatattgtcttttgatgcacgacatttttaattttcatggagtccaatttgccaattttttcttttactgcctgtgcctttggtgtcatatccaagaaaccatggttaaatccagtgtcttgaaacttttcccgtgttttcttctaagagttttgtgctttggtctttgaaccatttaaagttagtttttgtgtcggtgttaggtaagggtccaatttattttttttgtatgtagatattcagttttcccagcatcatttgttggaaaaattgtccttttcccatcgaactgtctcgtcacaaaattgtttgaccatatattcgagggtttatttctggactatctgatttcataggtctatatacctgtctttatgacagtaccacgttgttgttattactgtagctttgtagtaagttttgaaaccaggaagtatgagtcctccaattttatgctacattttctttttttttttttttgagacagagtctcgctctgttgcccaggctggagtgcagtggtgcgatctcggctcactgcaagctccgcctcccgggttcacgccattcttctgcctcagcctcctgagtggttgggactacaggcgcctgccaccacgcccggctaattttgtgtatttttagtagtgacggggtttcaccgtgttagccaggatggtctcaatctcctgacctcgtgatccgcccgccccagcctcccaaagtgctgggattacaggcgtgagccaccgcacctggccttatgcttcattttcaagattgctttggctatttggggtcccttgagattccatatgactcttaggatgagttttcctatttctgcaaagaatgtcaaagaatgtcattgggattttcgtagggtttgcatcgaatatatagattgctttgggtagttttgatatcttcataatattaaatcttccaaatcatgaacatgggatgtgttttcatttatttatcttcttttaatttctagcagtgttttatactttccattgtacaagtcttttaccaccttaattcccaagtattttttctttttgatgctattgtaaatggacttatttttataatttcattttcattatttttttgttttgttttctttttttgagacagagtgtgactgttgcccagactgaagttcagtggcgtgatcttggctcactgcaacctccgcctcttgggttcaggcgattctcctgcctctggaaatgtcttaatttttcccacacttttgaaggacagtttgctagatataggattctggattgacagttatttttattttttagcactttgaagatatcagctccctgtcttctggcctccaaagtttctgatgagaaatttgctgataaccttattgaagattccttatatatgatcagttgcttctgtcttgctgctgtcaagattctgtctttgaaaagttataaagtgtctcagtaaacatcttatttggaatttgtcaagcttcttggatgtttatatacatttcttctatcatatttgtgaaattttcaaccattatttcttcagatactgtcccttctcctttttctctctcccctctccttactaccacagtgcacatgttggtccgtttgatggtgtcctgcatgtcccttaagctctgtttactttccttccatcttttttctgttccttggacttgatcatttccattctcctatcttctagtttgccagttctctcttgtgcttgctcaaatttgcctttgaacccctctagtgaacttttaatttcagttattgtacttttcagctccagaatttctttttggtttcttttttttttttttttttttctatcacccaggctggagtgcagtggcgtggtctttgctcactgcaacctccgcctcctgggttcaagtaattctccatgcctcagtctctgagtagctgagattgggattacaagcgcccgccaccacacccagctagtttttgtatttttagtaaagatggagtttcaacatgttggctagactggtcttgaactcctgacctcaggtgacctgcccgcctcagcctcccaaagtgctgggattacaggcatgaaccatcatgccctgccactttttggcttctttttaagttttctatctctgtactggatacttctattttgttcatacatcttttttttttttttttttttttttttttttttttttttactttctccacatctttctttaagttctctgagcatctataagatgattactttaaagtctttgtcatccaggcatggtggctcatgcctgtaatgccagcagcttggaaggctgaggcaggtggatcatttgagcccaggacttcaagacaagcttggacaacatggcctgtagtctcagctactctggaggctaaggcaggagaatcccttgaacccaagaggtggaggttacagtgagctgagatcgtgccactgcactccgacctggcgatagagcaagactgtctcagaaaaaaaaaaaaaaaaattagcctggtatggtggcacaagcctgtaatcctggctactcaggaggctgaagcacaggaatcgcttgaatccaggagcctgaggttgcgctgaattgagattgcaccacagcagtcctgcctgggtgacagagctagactctgtctaaaaaaaaaaaaaaagaaatgaaaaaagggataaagtctttttctagtagatctgtcatcatgtcttttttaggagcagtttctgttgatgtattttttccctctgaagggatcataccaccctgtttctttatatgccttgtgattttttttgttgttgttgaaaactaggcatttgcatgtaataatgtggtaactctggacatcgaattcttctcctaccctgggggttgctgtttttgttatttatttatttattttttaattactgtaggctgtctccatgccaaagatcagcctgagagaggtgtaaacttaaagtctttatagatctttcctgagcttgagccttttcctgggcatgtgtgattattttctaattgtcctcacaaatccagttgtttttaaatgtccaattttttcttttgaagagacaaagtcttcctgtgtttcccagtctagttttgacctcctgggatgaactgatccacctgcctcagcctccttagtagttaggactaaagacacgctctaccacacctggctgaaggtccaagtttttaacatctggcttacaaaagggggtcaaaagaaaaatgaagggaggaaaaacaggatgctggcttttgaagtcccctggaagtcacttcagccaggacaagaggcttgcaacaacatggggaggagcaacagcaatgaccaccacttcgtctgtgcctcttagaagaagcagttggtgatcagaggacagatcctggatgtttggagaacaaggccctttttgcctaccctggctgcatcaggctgttccaggaatgctgcacagctgcctgctaggcactaagggataggtagctgaaattgattgaaattaaccacattttgtcatccaagccttcccctgggagttgcaagcctttattggactccagagttcccaaatacttacatcagacagagtctgccagtgcagttgtcgtctaggtggggagatggattcctggtgcttcctactccactatcctcccagaatcctttgtgtctaatgtgtttttaagatattttcttaccttttaaactacctctggaaggctgggtgcagtggctcatgcctataatcccagcactttgggaggccaaggcaggtggaacacctgaggtcaggagtttgagaccagcctggccaacatggtgaaacccagtttctactgaaaataccaaagtcagttgagcatgttggtgcgtgcctgtaatcccagctacttggaagactgaggcaggagaatcccttgaacccaggaggtgaaggttgcagtgagctgagatcgcgccagtgcacttcagcctgggtggcagagtgagacttggtctcaaaaaaaataaaaataaatacatacataactaaaatacctctggaaaagttaatgtacttttgtttgttgacaggctatcatttgctgctgccattttgcaacccctggcaactcaagaactataagtaactattttgaaatatataaacccaataatgggtttaatttatatagctgaggcttttttcagtaccatcttaaaggtttttgttgttgttgttgttttatttacttttgtccagatgacacacaataatttttggttgaagaagatagaaatcagtgtttcagaagcagaaaaacgaactggaagaaatgccatgaacatgcaagaaacatatactgcttacctcattgaaacaaggtgggtaacagaaattacacctgggcaggtagacagaaagctttttctgatagctattgatgcagactctgctgtataacagaattttttaaaggttattttttttttcgggattgactttgtttctttacttttttttgagacagggtctcattctgttgcctgggctggagtgcagtggtgtagtcatggctcactgcagcctcaaactcctggggtcacctcagtttcctgagtagctggcatacaggcgtgagccaccatggctggctttttttttttttttttttgagatggagtctcactctttcgcccaggctagaatgcagtggcatgatcttggctcactgcaatctctgtctcccggattcaagcgattctcctgccttagcctcccaagtagctgggattacaggcatgtgctaccacacccagctaatttttttgtgtttttagtagagacagggtttcaccgtgttggtcaggctggtctcaaactcctgatctcaaacgatccacccgcctcggcctcccaaagtgttcggattacaagtgtgagccactgtgtctggcagttttaaaattttttgtagagatggggtctcactctgttgctcagtctggtctcaaactcctgggctcaagtgatactcctgcctcagcctcccaaaatgctgggattactcgtgtgagccactgcatccagccctgtgtctttatcttttaatgggtaaacagctgtatcttttgctgtgatactcttggtagatagctatattttaatgaatttattttgtggggagaggggaggttagtggaatacttttggaatctggaataaataacatgtatcaaataacgatacatgctttggaggattccttggtcttagaatccctgtgcaattctgtaaaagaataccaggttctctggcatgtagaagtgaacttgggcaggtggaaatggttaacaaagaattctaggagtagagaataaggtctgaatcctcttaggacagttgggagttacaaaaaattaacaaacagaaacattgagattggtgctttagaacttggagtaaattaagaataaagggaagtagacacctttaaaaaacaaagaaaaagaacttggtgagtaaaaatagaaaagacaaattatggagtaggaaataaaaactcaccagaaaagttgtcttttacctcctaagggaaaagctaaaggaattagagttgttttgtctaaagaaaggcaagggaagactcaatttgttgttgtcagttattaacaatttatataaagaatagtgtactatttcttttctgtctgcagagattgagcagaaatgctttcaattaaaacaaatagatatgagagaattgttgatagccggtaaaattatagactaccaaacctagctgggcgtggtggctcatgcctgtaatctccgcactttgggaggccaaggcaggcagatcacctgaggtcaggagtttgagaccaccctggccaacatggcgaaaccccgtctctactaaaaatatgaaaattagccaggtgtggtagtcccagctactcgggaggctgaggcaggagaatcacttgaacctgggaggtggagattgcagtaagctgagattgccactgcactccagcctgggtgacagagcgagaggctgtctcaaaaaaagaaaaaaaaaaaaaactaccaaaccaagttaagtgttataacaatgttttaatgttaatacttttttttttttttttttgagatggagtctcactctgtcacccaggctagagtgcggtggcgcgatctcggctcactgcaaaccctgcctcccgagttcaagtgattcacctgccttagcctcccaagtagctggtattacaggcgcccgtcaccatgtagttttagtagagatggggtttcaccatgttggccagactggtctcgaatttctgacctcgtgatccacccacctcggcctcccaaagtgctgggattacaggcacgagccaccgcatccggccaatgttaatacttttttaagaaaaaaaattttaacctaccattttcataggctttacctgtgagcttgccttagtgctgaaccctgtgacttttcaaggcttcttccaggtctgtgtttctgcctaaaataaaagtttaaatcttggtgaagattgtctacagacaattctgaaaatttagttttccttctaccagaaagaaagaaaaagagagaaaagaatcttctaaaaaaaaaaaagaaagaaaatttttatacagtaagaagtttaggaaatgagagaggtaatgtggttcttttcaaacttaggtcatttcatgacatatgtatgtttatgtatcccagagatttgtaaggttattttttaaagatcatggccctgtgagaggatttttgtttctgtttttttgttttttaagttaaattagccactttaaaaataatactttagaaaacagtgttagctgtagccttctaagtaaattttaagtttacaatgaaaaaggatatatttagtatatgcctgttttttcacccacataggtattgattacttttactgctaggagagaaccttgatttggataatctggaataacttaataatgtttgtacttgactttgaaataaataaaggatcattgttttcttctgtagcccagttctaatttgaacctgggagttagaagtgaccatacatcagtaatagctagactgtgaatacatatttaagtagatcatcaataaatgtgtggcacacaaaaggattattgagtcaactttcacaactatatttcaatataaatttattttaaaacatggattttatacttaaaaacatgttggaattacttgaaaaattggttaaacaactgcaggatttggggtagggcccaggattttacattttttatttaaaggtccagctgctttcagtacagatgggcgatggacctttttttttttttttaaggtggagtctcgctctgtcacccaggctggaatgccgtgacatgatcttgactcactgcaacctcctcttcccaggttcaagtgattctcccacctcagcttcccaagtagctgggattacagacttgcaccaccacacccagctgatttttgtatttttagtagagatggggttttgccatgttggccaggctggtcttgaactcctgacctcaggtgatctgcctgccttggcctcctcccaaagtgctggaattacaggtgtgagccaatgtgcccagctggaccatgattttgattgttgtcttttaaactacaaaggctttccattttaagacaggtttatctgtcttttctctttatgatttatgttttttctgttttaagaaattcttccctactccacatcatatagacatgggatttgagaaatactgattttgaatagattgttttatactatccctaaggttaactgaccttcatcaaccgcaatcatcaaatttcttaatttaattatgtagtattgtttctgtaattcagtgttttgcagacagttgtggacaatatgaatattattgacccttcatgttaactagaaattcaacttctgtcatgtagcttacctacctacctaccttctggatacaagtagaaagcccatttagcaactgtctgtagtccaattgtcgagagggttttgtttctgtaattttttttttttttgtaaattagccacctaaaaaatactttaaaaattagtgttaactctagcttccaaagtaaattcttttttttttttttttttttttttttttgagacggagtcttgctctgtcgcccaggctggagtgcagtggcacgatctcagctcattgcaacctccaccctctggggttcacaccattctgcctcagcctcccgagtagctgggactacaggcgcgcaacaccacgcctgggtaattttttgtattttttagtagaaacggggtttcactgtgttagccaggatcgtcttgatcttctgagctcgtgatccaccctcctcggcctcccaaagtgctgggattacaggcatgagccactgcgcctggccagtaaattcttaagtttaaagttaaacaggatatttttgatatgtgcctattctatagtgttatagtttagtgggctaagattgaataaaactaaagtccctggtttttaattccccaagagatttttgtatgtgttcttcttcattgaataggaactcttttaaaataaatatatgtctcttttagaataggtagtaatgccttgatggcttggaaggcagtatgttattaattcttttaatttgtaaaacatggttaatgatcatattttcattgtgggggttaaatattacaagtaaaaccatttaggtactattgaatagttgttgagtgattagataaatgaggtagttttggggtctaatgaaagtcttctctgtgcttttagtcagtttataatgaaactactagaccctgcctttttgggtttttttttttggtgtttgtttgtttttcttgagatggagtttcgctcttgttgcccaggctggagtgcgttggcgcgatctcagctcagtgcaacctctgcctcccgggttcaagcaattctcctgtctcagcctcctgggtagctgggattacaggcacctgccaccacgcccagataattttttgtatttttagtagagacggggtttcaccatgttcgccaggctggtctcaaactcctgatccacccaccttgacctcccaaagtgctgggattacaggcgtgagccaccgcatccaaccgcgtttttttttttttttttttttaaacacttatgcagaccttctatcagccctgtaggtgtactgcttataggctttatttatccacttatttacaagttttgggttttgttggtagtgattttgaataatttgaaacttgagattaacccaagtatttttcagctgaagttgggcattgtaattgggatagtattagttataactaatgtctaggtatactctttaaaatgaattatgatttaataattctatttttttgccatgggagccatttgtgaattttgcatttcatattttggttcatttttattaatatgcaatgaataaatttagtagcaaacttaaaaaatgataaaaatgagcatctattgtgctgagcatggcatgatgtaaatactttctctagactatttggagactgatttaagttctgtgactttttgtcctaatgtacaaatacaccttgtgcatttcatggagggcaaacaggttattgtcaagcaaattagaaaatagcaaggtcctgataatgtttagaagactggtgcttcctaataggtcttacttatgctggcaagaaatcctaagtagtcaaaatatttaaaatatcctttatatgattttaccttaactttctgccaaaagtaaattgaacttttgtatgtatgagacatggcattgcctaccagccctttataattaaaagtaagactggagatgaatttttatgacccctcttcgccactctttcagagctaactaatattttgttcttttggatatttcttggtacttggattaatctgatttattaataacctaaattgaagtttttgtggtgtcttggtctttgttgtgaatgttattctctcattttggcagaagtgaagttaaaaatgctttttatttaatgaaacactagctaaactagattttatcatattataaaatcaattatttatgcattaaggcttttagagtgttcctaataaaactgtttctcttatgtttaaacaggctttctgtaacagaaagaaagtggttaggagtaagggctttgaaatcagatggatctgagtgctttatccacagacctttgtgatcataggcagagcatatactgtgcagctgtgtcctcatctgtaaaatgaggataataaatctctgcctcacagggttgtcataaggattaaatatgaaaatacatgaggccaaggcaggaggatggcttaagcccaggagtttgacaccagcctgggcaacatagctggaccccatctttacaaaaaattaaagtattagccaatgtggtgacatgtgcctgtggtcccagctactcaggaggctgaggtgggaggattgcctgagcccaggaggcgaaggctgcagtaagtggtgattgcaccactgcactccaacctgagcgacagtgggaccctgtcttgaaaaaaaagaaaaatgtatgaaaagttctttacttagtgcctggttcataatcattctgtagttataattttaaaggtgattgtatttatgtgtatgtatttttgtttataaaaaataacaagtgttgttctgttccttttcaggtcagttgaacataccgatggtcagagtgtcctaacagactcactatggcggcgatatagtgaatttgagttgttgagaagctaccttttagtttactatccacatattgttgtgccacctctgccagaaaaacgggtaagaagtgaaatggcagtagtttagaagtattcagcattgagactattcttaatgattattttgtttacctaggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggtatttttcttttatttagtcttagtaaaatattcatttaatttgggtttcttaaaaaaattgtagaatacttattttaaggatcttttcattaatttatatgcaatttattttttgttatgaatttctaattaatggattatgtcattcttttggttaactttttctatttaaagatactgatgatggtatttttggtatcatttaaataatattaaaatttgtcttcagtattttgaagcccagatctataaaatcttgggttcacctttggtaatcttttagaagttggattgaatgtttaattttgaagtgaaaagaaatttttttaaacttctctctccaattcctgctgaagtaagaacagaatgatagaaatttaatttacttaatttggaatatttgctttgcaataatgatttctaaaattaacttcaatttttaggaaggtaactggaaggagactgtgaatgaaactgggtttcagctgaaggtaagaatatttatatgaaatttgccatgttcctttacagttcccagcatggtgccatgcactcattgggaacttggtatttattgaataaatgaatgttggaaatcgtcttacaataaatatcattggtaaggttttcaaagaaacactacaattcacttttgatttgtgtaattttagttacttatgagactataatgggcaaatttattctacagggaaagaacattttgtaacagtgaattttttttttttttttttagttagtgtttatagtaatgaagcagtaatttaaatacaagttgtagattttccccagtgtactagtattataccttgcctctttttttcttctgtcctgtttccattcgtatccctgcccccgacagttgctcactctatcacatatgaaagagtccaaccttagcagtctaaaagataagcccttagtcatgcttcttctgtctgttgagacatggtggtcagtttgaaatggggacaaaggagtcatttttaaatagttctaagttttatctgttagtggtacaggattatttagtttttgtaacagctttttaaatttagtcattagaattagtgtttgggaatgagatgatgatctgaaaatcaaggagcattagtagtggtaagctggacacttgagttctatgctgctgtttatttcttccctaaaagaaatacaacaaaggttattacaaactttttaaagttttcatctctggtgtaaactgaataggtaagtagactaacagaatataaattgatatataacataatataaattgttcaatgactcacatgataatacagtaccaaaagttcaatataatatgtctagacaagaagaagaaaatttttttacagtaatttaaaaaacacttcccatgcattggcccatagatatttgaaatttggcacaaaacagactagaaggaggaaaatttttttctgcagagaaaatatgataaaccagttctgtcataaactgattctaatttataaatattttggagtttttatgattttgagacagagtcttgctctgtcacccaggccagagtgcagtggtgtgatcatggctcactgcagccttgaactcctggactcaagcgatccgcctgcctcagcctcccaagtagctgagactacaggcgcgtgccaccatacctagctaattttaaaatttttcttttgtagagatgaggtctcactatgttgcccaggctagtttcgaactcctgggctcaatcgattctctctcctcagcctcccgaagtgctagttttactgtgcctagctataaatatttagttgacagttctactgaaacaattagaattttcttggctgtaattcatcactttataacactcagagagaatggtagaatttgagtttagggatggatctgaaataacttggaagtttaaaaaccgatttatgtttagatagagttttctgaaaaatagtttgatatgttaaaagctaacaaggaaaagattaaaatacaatcattttagtgaattctctttatataacaaaaaatttaaaaattctagtcattaagtctttactgcagttaatagttatcagtttttgtctttgaatacagtttttggccgtaactttagtgattctgagaaaactctggagtttctccatcattataaaattgctatttaccagtgccttgaatcttatgtgtaggtgctgcttaagtatttagatagaatgtttcattgtgggggagccttatgtattgtacttttgaaaagtatttgaaaggtaatatcagtatacagaattaataattcaaaacatcagacttctaatgtagtgagccagaaataaaattgatggagagaattcggaaacccatgtgtctctctgtattccttattttgttgtggatgtttcttgttttaagtccttcctcccatcagggaaatgggacctttttgcatagcctcatatacatgtgtacatcatacaaatgtccacaatcatatgtaaataacatacgtgtgtgtgtgtgtatgtgtatatatatatatatatatatatatataaagagagaatgagtgtatcacatttcacttatctggaggtcatatgtttggcagttacagctaatctgatcacagttgaaagctgggacttaagcaaaactgacttctgagatgttcaaggggatgtaacatggcttcctgctatactttactactatactttggtcttcctgtagcagacccattaattttattataggtattcagacaaattttgctgttttttaggttacagcctattttagcagaggattaaaaagtgagtggagacaggcacattgtgacagtagtgacaattgacagctgagcctgatagcggaaaaggaggtagcagtggtatgtgagtcacacatcgcagaatgggtacatttggcgtgaggcaaaatccctacccacctgtaacccctaggacttcactgtatcatagatgagttcagtattaattgtttgtaatggttaactggaggcctcaagaaaaagtagaattttgcttgtgcactcttaattcagtatgtggtcagcggactgcatgtaactcagttgatgggattgtttgttcaaaatactgaattcatcccagacgtacatcccattagcctaaaacttgacaactgttgctataaggcgataaagaaaactattttcaggaagataatttgagaaagattgtcaaaaacggtaaaaaagaagaaaactttttttagaatctaaaacagtttcttatctgagtattaccataatcatatatgcttactatgtgctaagcactatactataattatactatgtttattttgctcaatattgcctcagtacctttgaggtgagttaatattcccattttttagatgaggaactctagaatgtgacttagccaaggtcacataattacaagtgatagaggctgaatccaagtctagactaactgaaagccctccttaattaccatcccatattacctctcttgcttattaattatataattaatatttgcagagatggttgttaaaggaagtgttgaaagctttatttctgtgaacatgaggtcattctgaatgagaccaaatagtcatatcttataagaatatttgaccttggctcttggattgttgtcctcaaattgaaatgttatcttactttaattttccttttctcagacatattttgtctgtagttttggcgtactagattaatattttcttttttttttttttgagatggagtcttgctctgtcgccccggctggagtgcagtggtgcaatctctgctcactacaagctccgccttccgggttcacgccattctcctgcctcagcctcctgagtagctgggactacaggcgctcaccaccatgcctgactaattttttgttttgtattttttagtagagacggggtttcaccatgttagccaggatggtctcgatctcctgaccttgtgatctgcccgcctcagcctcccaaagtgctgggattacaggcgtgagccactgttgcctggctggcaatattttcgtaagatttttgagagtgattattacacccagaaagataatcataaaatttagtttctttttttctttcttttttttttttttgacacggagtctcgctctgtcacttaggctggagtgccgtggtgtgatctcggttcactgcaagctccacctccccagctcaagccattctcccacctcagcctcccgagtagttgagactacaggcgcccaccaccatgcccgggtaatttttctgtatttttagtagagatagggtttcaccgtgttagccaggatggtcttgatctcttgacctcgtgatccatctgcctcagcctcccaaagtgctgggattacaggtgtgagccaccacgcctggccaaagtttagtttctttttatctgtgttctatttaacataagcatgagcaaccagttttttcatcattactggttattgacatttctcctttttaggggggtggaatatttatataaatactcaatctgggcttggtggcatgttcctatagttctagctacttgggaagctgaggcaggaggatcactttagcccaggagtttgagaccagactgggtaacatagcaagactctgtttctatttaaaaataaatacatacacaaaatataaatactcattttacttaattcagtgaaagaagagcaaagggtttatccctagagtaatgaacatacaaactagttgctttagtataaaagtaacgttttaactcagttaacatagttagtcatgaaagcattgttctgaatacccaatccttaaatgaatttaggctgattcataagaaccctggaccctgcctcttccttggggcaaggactaccagagccaaggtctgggcccttagttaggatctctgttaatcttgttattgcacaggaactctgagagatccaatgtggagattccaaatgctggtgcctacagtgtgaggtactcttctaagcgttgtggatacagtagtgaatgagctggaaatactcataaactctgtgttattgtggagcttatattttagtgattggagacattaagttagcatttaaataaaaaataagatactttaaaatagtgataagtagtataaaggacataaagcatcgtccttgttggggaatatgacagcagggattatttttcaggggttaccctaagatgagtgaccataaagtttattatccaaatgggacccctttagagaggaaatagggacatttaagatggggaccacatgttgtgttccagcctgggtgacggagcaagactctgtcttgaaaaaaaaaaagattaggacaacagttataaaccaggactctcctgggcaaaccaggccacatggtcaccctcctttaaaaagcttacatttgagctgagacattagtgatgataagaaacctgcagtgaagtcaccagaggccaaggaagaggaatgctccttcagagggaggcccagactgggtgtgctttactaggtaatgtgtgcgggaagataaagcaggtaaaagtgttgccacagcagcctttgtacagtccaagggccaccttcacactgtgcctttttatggctcttatattcttttttttttttttttttttttttttgagatggagtctttctctgtcacccaggctggagtgcggtggcgcgatctcggctcactgcaaactctgcctcacgggttcaagcgattctcctgcctcagcctcctgagtagctgggattacaggcatgtgccaccacacctggctaattttttatatttttagtagagacagggtttcgccatattggccaggctggtttaaaactcctgacctcgtgatccacccgcctcagcctcccaaagtgctgggattacaggcataagccaccgtgcccggcttatggctcttatattcttaacggacagccaagaatcaagtgaacaagatgatttcagataatgctgttttaaaggaagtaaaataggatcataggaaacaataatgaattaaggggcatctttaggtgttgaatggggaatctgattaggtgggcgataacctatcagatttggaacagtccaggtagtttttcagagatccagcggtttggtgacattttagtcagcttcctcttttttatgtaatcttgtgaaatgagcagattgagttgggtgtggagatggacctgatctgacaaaacatttggttagcaaaggttagaatggtgaccctttacatttatatgacttttaaaaaattggtaaattggtgactttaaaagtaaaaaataaattgctggtgttaaaaagcatgagattcaagaaaagatacaaatgaatatttttttcttagtgttttatgtagtttcatcctcatttaaagaatcacattttgcatgtgactgaagtcatgaacacttacaagagcctttggtttttagtgatttttaatgtataccttaaattcataggtgtttttatttataaggactttgatgtatattagctaatttttccttgagatgtaagaaggatccagaatttgtgaaatactgattttagaaataggagaattccataagagaattccctaaaatcaaaataaactactttagatattctttagatagccctttaaatctcttttggtctggagttctaggaggctgaacttgtgagtagtatatttgttatatttgtttttattttcttagccaagtaacctgggaagccttagtaatatttttgttttgtttgtttattcattaacagtatttgtaattatggttcggaagttgtaatagtgtaaaattttcaaggtgggattttaaaaaccagaccacatttagaaattgattcctgattgagctaccttttatgaaccctaatagttcttctaccttggttagaaaagttgtttggttgtctttttttttttgtttttttaatgagaatttaggacaggacaggatttggatgtgttacgtatacattttatgcagtgaaattattatttagtatttatccctcagtttcttctttgagagtaattatctagaaataagtgaagaaaatagttaaaaagttgtgttgtcttacaacattttctgctagctagaaagtaattgctgtaatctagcttgttttatttagtagagtgttacttagtacatgtatttctttttttttttttttttttttggagacagagtctcactctgtcgcccaggctggagtgccgtggcacgatctcggctcactgcaagctccgcctcccgggttcacgccattctcctgcctcagcctctccggagtagctgggactacaggcacgcgccaccacgcctggctaattttttgtatttttagtagagacagcgtttcaccgtggtctcgatctcctgacctcgtgctccgcctgcctcggcctcccaaagtgctgggattacaagcgtgagccaccgcgcccggcctagtacatgtgtttctatattctttcttctaaaatatagattatgaaaatgagaaaaaccaatgtacatttgctttggaactaccctcagtagatgcagactctaaagcagtagtttcttttttgagatggagtctctctctgtcgtccaggctggagtgcagtggcatgatctcaattcactgcaacctccgcctcccaggttcaagcgactctcctgcctcagactcccgagtagctggtattacaggcacgcgccatcacacccagttaatttttttgtatttttagtagagatgggggtttcatcatgttggccaggctggtctcaaactcctgacctcaagtgatcctcctgtctcggccttccaaagtgctgggatcacaggcatgagccactgtgcccggccatgaaagcagtagttgcatttagtttatatatacgtatcattgcctttcttggcctagagaaaaactactgttttcacatgacctcttccgaattctaataatgcagagctatatgcctgttcgtgtattggttggtgtgtacagttgttttactttggtaccattgaatgccatgtattcagtctattttatagtatgtttttgtagtgttttcaaaaataattactaagctatttttttaggcatgtttaatgtgtttacaacaattgatatgaagaaaactgtacttgagcatcttaattctaaagggaaagtaaaattgtttgaattttataccctgaaatgtaattgtattaagtgaacaaattattttttccaggcagactccaggttaaaagcgcttaatgcaacattcagagtgaaaaacccagacaagtaaggttttgttttaataacagttacaatgttgttttgaatggtgctatcaatctatttaatttttcatttctgaatgtatgcactttatttgctaaatagtttacatattcacatttagtgaaatccttttaaagtctaaaactgaatttgaaatttgataacttgattgggggtatgattgtgactgaagttttataaaattaaaccattgcttttttctagaagggtttgttaagtgttgcagatatcagaaaaatgagaaaagtaattttaattttatagttttccttatatgattttgcttgttaaatatgcacagctcaagataagaaaattatatactttttacatatacttaataatgaaccgtctagtttgtataccaagaaaatttcacgaaggtatatgacaaatacttgattttattaatatcagctagtatttgtgagagcatttccatattaaaagaagccagtgtattcagaaattacttaacatggggtgggacctatgtatttaagattttggttttgcttaatctttaaatttggtggataattcaaactctacattatatggacctttacttggcaatttggttcagttagagttttttaattggatatgtgcttaggcagatgaggcttttttgttttggaggaccaaatttatgagatctgttagaatttctctagtgaatccttcagcactaatttctacattgtgtaaattcttatcagacaaaggtggggtctgcatattctgatgacctattatgcctgactttataaaccataacatattaacaaaatgcccctgatttttcatataaattttgaatataaaatctaaatgaatatttttaaattttggtaattaggaggttgtgatggtaacttgagttttttcattttcatttttttattttttgaggcagagacttgctctgtcgcccaggctggagtgtagtggcgtgatccctgctcactgcaacctctgcctcccgggttcaatcaattctcctgcctccgcctcccgagtagctaggattataggcaccccctacaacgcccagttaattttcgtattttagtagagatggggttttgccgtgttagccaggctggtctcaaactcctgacttcaagcaatccacccgccttggcctcccaaagttctgggattacaggtgtgagccaccatgcctggcctttttttttttttttttttttaatagactatttttttttttacagcagttacaggtttagtagagttagcaaaattgagtggagtatacagagaattcccaaataccttctctccacacccctccccattgacctgtcacagcctccctaactatcagcatcccacaccagagagctgtgtttgttacagttgatgaacctacattgaaacagcattatcagcaaagaccatcatttatgttagggttcacacttggtgttgggcagtttttgagtttggacaaatggataatgacgtgtatccaccattatcattttatacagaatagtattactgtcctaaaaatcctctctactgcacctgttcatctcctccctcaacccctgggaatcactgatctttttattatcgctatagttttgttttttttttttggaatgtcacatcatatacagtatgtcaacattgagattggcttctttcacttaatttgcatctatggttccattgaggtttttataagtattatactaacatgcatggtatataagaggtgttctctagattaagaactaaaattataagtcaccctcaaaaaaagctctggaaaacttagtaagctaagtgtatgactttggtggctgtacatccattagagaatcgtttttgattgatattttgataatatttttgattaatactagtattttgtcaattagtatttttcagttgaatgaaaaatattttgtcaattgaatgtttttcctcccttttctgacccagccaggttttctgaactgctgaattttatttactatccatattgtgtgtagaattttaagtttaatatgaccaataatgtcaccaaggcagtttttttgcccttatgttcttgctaaagtgtataattgctgtgtaattagtaacaggatttgtttgtcttaaattctggataattgtgtatattggtcattgttatatcagattcttaatatgtagaatctcttctagatctagctgttacaatagattttttatattattaaaatatattactaaaatagttttgttatttcctaaaattcagaaaaccagaaagattgttttagagggattacaaagtgattcttctagtactcgcttcattcatgtttatctttcctcaaactagactgttaagagcaagtgagtgggagggcctggagtcttctacttttatgtggccttaggtactctgtaaatgctttcttttgcatattggattgcatatacatatatatgtatacacacacatatatatatatttttgagatgcagtctcactgtgttgctcaggctggtctggaactgctgggctcaacaatcctccgcctcagcctctagaatagctggaactacatgtggatgccactgtgcctggcttgtatatttttcttaaaagagatgtgcccaaggtctatctccatttattgagcatcttatattgttgcaaataaactaaacccactaagtcaaaatctaggtggtaaactgaccagattatataagtaacgtactctctttttttgagacggagtctctctgtgttgcccaggctggagtgcagtgctgctatctcagctcactgcaagctccgcctcccagattcacgccattctcctgcctcagcctcctgagtagctgggactataggcacccgccaccacgcccggcaatctcctgtccctagtagaaataaacaatactaaccactcatgtactgtgctacattgcatagtagaagtttcatctaatgtggccagtttttcttggctgaaaaaaaaaaatctatgtaacttaacttatacgtaaagtgatagtttttttcttttaaaagaaaaccagttagataattgaggttgtgatacgttgaggttattcctcgagcttctaaatatcaggttatatcattttgttatgctgagtttggggcaggaagtatggatagagaaaaatctatatagtgagttttcttcaaggagctcgaggtacatcgtattaagaatgcttacagaggccaggtgcggtggcttacgcctgtaatcccagcattttgggaggccgaggtgggtggatcacgaggtcaggagctcgagacccacctggccaacatggtgaaatcccgtctctactaaaaatacaaaaatcagttgggtgtggtggggcacacctgtaatcccagctactcaggaggctgaggcaggagaattgcttgaacccgggaggcggaggttgcagtgagccaagatcgcgccattgcactccagtctgggcaacagagcaagactccgtctcaaaaaaacagaatgcttacagatagggaggcaagaaccaaagtgtagaaactagaagaagaggagggtggggagtggactgtcatttatgatttctcacagtcactcagactacagtttcttttctttcagggctttatcttaggtaatagttgcacaagttgtaaagaagcataagacaatctgtatggcttgatttattttcagtataatagctaggtagagaaaactacagccgtatgcaaatatgaactccaaataaggccgggcacggtggctcatgtctctaatcccagcactttgggaggccaaggcaggcggatcacttgaggccaggagttcaagaccagcctggccaacatagtgaaaccctgtctctaccaaaactacaaaaattagccaggcatggtggcacatgcctgtaatcccagctacttggggggctgaggcacgagaataacttgaaccaggaaggtggaggctgcagtgagtcgagattgtgccagtgcacttcagcctgggtggcagagtgagactctgtctaaaaaaaaaaggaaagccatataaaatagataagttataccccaagctgtgtttttgcctttgttgtttttgagacaaagtcttgctctgttacccaggctggggtgcagtggtgtgatctcagctcactgcagcctcgacctcccaggctcaaatgatcctcccatctcagcctcccatgtaactgggactataggcaagtgccatcaagcctggctggctggttttttgtttttgtttttgtttttttttggagatggagtctcactctcgccaagctggagtgcagtggcgtgaccttggctcactgcaacctccgcctcccgggttcaagcaattctctctgcctcagcctcccaagtagctgggattacaggcgcccaccaccacgcccagctaatttttgtatttttagtaaagacggggtttcaccatgttggccaggctggtctcgcactcctgacttcaggtgatccacccggcctggctaattttttgtactttttgcagaaacagggtctcaccagctcaggctggtctcaagtgatcctcccaccttggcctcccaaagtgctgggattacatatgtgagccactgcacctagccatgtttttgcctttaagattggagagaagcattctcaaaaagccttgatggagggtcttttcaacatgagtcttgagaaatggatgacatctgattaggagaggcacctgtccaggcttacttactaaaagtatgttaaagaatatggagaataaggccagacatggtagctcacacctgtaattccagcactttgagaggccaaggtgggcagatcacttgaggtcagaagttcgagggcagcctggccaacatggtgaaaccccgtctctactaaaagtataaaaattaaccaggtgtggtggcacatacctgtaatcccagatactcgggaggctgaaatgggagaatcacttgaactcaaggggcagaggttgcagtgagccaagatcgtgccactgcactccaggctgggtgatagaactagaccccttctcaaaaagaatatggaaaataaagggaagcataaagcctgtaatggcaataggtgtactttgaggagaatagaaaatatggctgattcaggccataggacatattgggtttggatatagacaacctcaaactagagtcttatcagagtctgcatttacacgttcacttttgcatgtctctaagacagggattttagatagatagtatttcaggagggaagttttatgtcaccatcttcctagtatggactgtcctctttttaaactccctgttttcaagtgaaactgcaacattctgacgttatatatgatttttagtctttaatatttctctaagaacacctaatcatttatgataagattcctcattttaatatgcagacattctagattttgacttgggctaagaagttataccctcgttttcagaaaattcattcctttatttcttaaacatacattgttatctaagacttgatgaatttttcactcttcacctttaggtcttctgatttcccagtaattgtgatttttttcaaaggtgcacatctgtctctgtcccctaggtgtttagaatcttttagctctgactttctggtgatgtgatcacctggggatgatttgtgttgtcactcctctcccctcacaagagattgtaccaatgtgttaatcaaacagagaaactttagtgtgccttttatgttctgtgaccaaaggtgttaagacctttcaactccagaaacctctgcttcacctaatttaagtattctgaggcttactgtttatattcttatacatttctcatatccaaatatgacagctaagaattttgtagtcatgccagatcctgagtatggaagctgacaaagaaacatttttaggggacctaatcagttctggagaagctccagaagacctgatctttagaatttctagctcctgggacccagcacaggaagatctgatcagagtttaacaaagtattagcctcttgaaacttaagttcaaatcataaaacttctaagggaaaattgtaccagctcagttgtaactggctctacgtaaagaaagccgctcacagttatctgagattttatatatttatataaaatacatatttatatatatttatatataaatttaattttatttaaatgttttggagtacataatatattcttatggttaaccagatatatatgtagattgataagtacggaaaagttgtacagtgaaaagtctcattcctgttcctctctatccatttcccctccccagagagtaacaccatgttagtttttaggtttatattccttcaaagttttatcctacaaatgcaagtgtacattttccaccttccatcttggatataaagggagatttgtactctacttaattgggagccaatcttgccaactcttttatccctaaattattttccttgctgaaaaacactgccctgggggagtaagagtggttaagtattttatctagtgatttgatgtcctcaacttcaccactgcctctttatttcaatgaaccacagtaactgaatacttggggactgtgaaaagttttttaagccacattacagagtttgaactttgtctcaggatcagcggataacctttgcagtagaaagctgcttaaaagcaagggggtggtatagatttggactttggaagatcatccaagcagagtggacagtagattagaggagtgtgggagtgggctaggaggccagtcaggaggactggtgagagatgatgatgctaatctgaatttagggcattggcagagagaccagagaaaagtgagtggattggggcaatgtttaggaggtagaatcaacagactgggcaattagtggaatgtatgaggtgaaggagaggagaaggaaatacagatgcactcaggttttcattctttagagtgcaagggagcacaagggaaagatttgaggagtagtggaagataggttgagctttggctatggaagcaagtacaaatgtctactaaatcagttggttttatagatctggagttaagagagatttgggctgatggtagaaatttggaatttagcaatatgtagatcataatcgtgaagctttgtgaatgacaagtcacataggaatgtatagattgaaagactgattggaagatagctgaggacccaggactgaaccttgaagaaagccagcactttaaggatgttttcaaagtataactacctgaggtcagctgggcatggtgatgcccatatgtagtctcagctgtttgggaggctgaggcaggtggatcaagggctgcagtgagctaggatcaagccactgcattccaacctgggtgacacagtactgggcctttaaaaaaaaaagaaggaaagaaaaataaagtataacctgaggactaccagcatgtgaatcctgtggatgagctataaaattcagattcagattcctgagtcccacgaggaccttgatgtattcacatccctctgagagaccatcagtagtgtttttaagaaacatttcgaccaggcatggtggctcacgcttgtaatcccagcactttgggaggccaaggcaggcgatcacctgaggttgggagttcaagaccagcctgaccaacatggagaaaccctgtctctactaaagagagacgggtgtggtggtacatgcctataatcccagatactcgggaggctaaggcgggaaaactgcttgaactcgggaggcggaggttgtggtgagccaagattgcgccattgcactccagtctgggcaacaagagtgaaactctgtctcaaaaaaaaaaaaaaaaaagatttcaggaattttttgcagactacagttggagatataagagatgggtgaaggaagtgagtactacaaaagaagcttcaggagtgaccagagagtgaaatgaaagccatgagaaaataatactgacaaggaaacagatttttgaggaggaggatgatgtcagctgttgcattgccaaaaggatcaagtaagaggagaactaagattgatcactggatattacaacatgaaaatagttggtgactttgtcaggaatatttccctactatatagtgctggaggcagaagctagattctcataggctgtgcagtatatgggaatggaagaagtggttattgctggggaagtgatgccttgtgaaagcttggctataaaaggggtggatattgacagggtgttaatagctgggtgtgttgtcaagggagtgtgtattttaatctatgagagacctgagttaattgatatgctgatgagaagaagtttatagagataggaagtcaggaaacaggaatatggggtgtagctggaatggaatctagagcgttagatgggaagaaatcctagtgggagggaaaaaatgatgtagatatggggaagtgtgtaagttgattggcaggaggtagaggtgggagtcgttcccatctgatggtttttgtttatctgtgaagcttggttgtttggagaatgacagatggtgcatcagaagtttttggtccttatggaaaatggcagttaatagatgagggaagcaaattacttgagcagaattaagattgaggttagagaccatgagtttatgattgcaccataatgtatcttttagctccttaaagtttttcctgttttgtattttcaaagtagtttttcataccaacagattttttttacctatctcagttccacgaggtaaattatgaagtgtgatatcttgactttcaaaatatcaacagaaaatatcattttattttagagttttttggatttatattggtgtgtaaatgtttaaggccagcatatggttaaatagaatcagttttgttattgtcgggaactactgtttttttctttcagtttttgactgcttgttttcatttgaaaaacgatgttttatttgtttcctgtttcaggagatttactgaccttaagcactatagtgatgaactgcagtctgtcatctcacatcttcttcgagtcagagctgtaagtggtccccaaaagctttttgatgcacatgcataaggaagtgcttctcatgtaatcattctgttttcaagtagtaggtggtatttaccatgaataactgatttttgcatttgaatttatatgttcatcatccaaactgcactttttaaaaaaatgtgcaatggtttctgtcataaacaactcacttagcctgttttctctccatggtttgtaatagaatagttgttttggatgttatcaaaaggcctgccatttcagtgctggaatgtaaataagtgtaggattttagatctacacatcatattctttcatgttttttttaaaggtccgtgaaatagtttataggtgttaggccatcctgtgtctgtgctcttaaattctaccaaataaactaatttcagataatagtctgccatgacaaaagggactagaaatcaaggaataataattatacttaaccatatagttcagctgtaataggcaaagagggaaatacttctcagtaaattaatgtacctggaaaatgtaccatccgctctggtctcttgtggcaacctagaaggaaccttagaacatgcctgtgccaaaggcattgaaagagactaggataccaggtaaggtcacattttatgctgattggaatctggaatcctctttgttgttattattattattattattattattttgagatggagtctcgctctgtcacccaggctggagtgcagtggcacaatctcagctcactgcaacctccacctcccgggttcaagcagttctcctgcctcagcctcctgagtagctgggattacaggcatgcagcaccatgcctggctaatctttatttttagtagagatggggtttcaccatgttaacgaggctggtctcgaactcctcctggccccaagtgatctgcccacctcagcctcccaaagagctgggattatagtcatgagtcaccatgcctggccagaatcctcttgaaatgaaatatattgcctggaatttgttttaataagagtccaccgatgagcagtggagagtgggggcagttttaggagaaatgagtttggctatatagtaattactgaagctgggtgttgagaaatggaggtatatccttctgttctatatgctttttgtatgtttcaagatttccatgacagtacagaaaaaatacaataaaggaaaaaattcttctgaaggtcttatattgtcttgatctcccgtttaactgttcaagagtatcgttggactctttgaataaattataagataccttctcataaaagttacctgcgagaattattaggctagagtcaagaactgggtattagaaaggactgtggattaatgagataaaatttgtggacctttggttgcctagaaattacccagacaaattaggcaatagttctcgtgggaggtgcagatgggggacaaacattcagagagtctgcatcgtaccctcacattgcttctagttttttttttttcttaagtggtttttcagcaacttctcttttcttccatgcttaatatcttagtagaggatgaatgctcagcttttaggaaggaggtttggtatctaaaagtacagggatctagaaaagttagtgttagaatgacattttccatcatatattctctggaatgctaaccctgtaagatgttccctactgcaaaccgtatctcccttgagcagtcatgattcatatgtggtgttaaaggtctaaaaggtcctacagaaaaaaaactgttaaattttattgtctcagtgtttcccaaccttacttgatgatggaaccacttaaaaaaaaaaaagaaaagaaaaacattcaacactgcacagactgctcaaaaaatacttgggggccaggcacagtggctcgtacctgtaatcccagcactttgggaggccaaggtgggcagatcatttgaggtcaggagtttgagaccagcctgaccagcatggtctttactaaaaatacaaaaactagctgggcgtggtggtgcatgcctgtaatccccactactcgggaggctgaggtgggataatcgcttgaacccaagaggcagagattgcagtgagctgagatcgtgccactgtactttagcctgggagacagagtgagactccgtctcaaaataataataataataataatagtaataataataagaagaagaagaaggaggaggaggaaatgacatcctagagaaattagtttagaggtctggggacaacctgtaagagtttcaagtaggagtaggactatgaactttgtcctgaaagctggttctaatgtaggggccagcatcttgtttctgaaggccagatgggaggtgttttcagctttgttagctttatggtttctgttgcatctattcagctccactgtgaacctgacagtgctccagtgagactctgtttacaaaacaagtggcagacctgtagtgtgttaacccctagtctagtgggtacgtgtttcctcagagcaggccaacaatagatggaaaacattttatgatcctcatacacctacttgaagtatttgcagtggcggttctgtcactgtaagatgagatcttgaaagggttgatttgttctatcattaatgtctaattcctcatactcatgtttgagtaaggaatcagggagctaatttatccttagagcttatacttagaaactgtataccagaaattttttctagagctttttgtaggatgagcctttggtcttccagtttgttttcataatgctttgggggaacgtaaagcaaattaattaccatattgaggttttgttttaacttgtaaaatttctgtgaatggctaggcagtacacatttcagtgatgtaaattgtaattctgttgttattaaaataatgtgttcgttggttaggagttatcttttgacaaagtagcatagaagtatatgcatgtattcagcatttatatataaaactatatctcaatagaattgaaaatgtatccgttcccttggttaattccactttggggattttattataaggaaacaatctgagggaaaaaggcttattctcagagataactttttataatactgaaaaattaagaataactgaatcccaacaagattattcaacaaggaatgcttgtatgtcttatatactacttagtggaattttatgcaactatttatagtggtatttattaaatacctgatgggtaagcatattaccactcttgctgtaggcaatttaaaaacagtaattaaaaactttgcagaaaaagaagtacaaaagtataagatatgataaatatggtaagagcactggttttagttttagggggatgggatttttggagattactatttttcttttttctatttccaagtttattgtagtaagcatgttttttgttttttgggtctattttttagatgaggatataactttgacctaaaagcaatttctattaaatatttatttcagagagtagcagatcgactctatggtgtatataaagtacatgggaattatggtcgagttttcaggtaagcatcatacaaactttaaaaataattagctttaattacctttttgcctgaaaacaataattcttgaacatttatgagtgtggagagaagattatttctttttttgtttgtttttgttttttgagatggagtttctttcttgtcacccaggctgatgcaatgatgtgatctcggctcactgcaacccccgcctcctgggctcaagtgattctcctgcctcagcctccccagtagctgggattacaggcatgcgccaccacactgggctaattttgtatttttagtagagatggggtttcaccgtgttggtcaggctggtctcgaactcctgacctcaagtgatctgcctgcctaggcctccgaaagtgctgggattacagatataagccactgcacccagccctttttttttttttttttttttttgagatggagtcttgctctgtcgcccaggctggaatgcagtggcgcaatctcagctcactgcaacctctgcctcctggtttcaagcagttctctgcctcagcctcccaagtagctgggattacagacacctgccaccacacctggctatttttttgtatttttagtagagatgggatttcaccatgttgaccaggctggtcttgaactcctgacctcgtgatccacccgcctcggcctcctaaaatgctggattacaggtgtatgccactgcacccggttttttttttaatacagggtctcactttgtcaccgaggctggagtgcagtggtgtaggtcttggctcactgcaacctctgcctctcaggctctagtgatcctcctgcttcagcctcccaagtagctgagaccacagacacacatcaccatgctctgctactttttgtatttttttgcagagatgggactttactatgttgcccaggctgatcttgacctcctgagctcaggtgatccattggcttcggccccccatagtgctaggattacagacatgagtcaccatgcctggtcccctacttcggattattaaaaaattttctcagccaggcgtggtggctcatgcctataatcccagcactttgggaggccaaggcgggtggatcacctgaagtcaggagtttgagaccagcctggccaacatggtgaaacctcatctctactaaaaatacaaaaattagccaggcatggtggtgggctcctataatcccagctactcaggagactgactcaggaaaatcgcttgaacccaggaagtgaaggttgcagtgagctgagatcacaccagtgcactccagcctgggcggcagagtgagactccatctcaaaaaatgaaaaaaattttttctcaggtggtgggttctaggtgggaaaaaaaattctcatttcttctgtattttgtggtttcataaatttttgattcagctataatttatttgaatgtaagatgtgagatagagatttaaatttatttaattcatttattagagtagtaggttatccatatgtctttggttgatcaatacattaaaattaaatgtcagttgagacagatcaaggttatatgacttttttaattaaaagaagcttattgatattataaaaatgtaaactcttcataactaggaccagggtctatgaaaatatatggtcaactgtaaaagaatagtataatgggaagaaagacaaatagtattatacgttttgaagtctacctcatactgtctgacttaatattaattgcttttagttttatgcacaagtcatctctaatttttagtattactcaaactggaacccaattaagcttgggaacaatgcttatttaaaaacaaaaattatatcccataggagacatgtgggggggaattaacataaactaaacattctcaaaggtagcacatttattatagttaataaatgaactttttaattaatttgagaggcaggtagacaaaagatcaattggttgaatcaaactttaaagaaaattatttgcattaatgccacatgataaatattgtacaggtttgttttttttgccagcttaataaattattagaaagccactttacatttaaaaaatttcatgaggctggatgtggtggctctcatctgtaatcctagcactttgggaggccaaggaaggaggatcacttgaggccaggagttcaagacaagccttggcaacatagcaagaccccatctctacaaaaatagtttaaaaattaggcatggtggcacatgcctatagtcctagctgcttgggaggctaagatgggaggaacacttgagcccaggagttcaaggttatagtgagctatgatcacaccactgcactccagcccaggtgacagagcaacaccctgtctctcaaaaaaataaaaacaaaaatagataataaataaaaacatcttacgacaactgagccagaaagaccagaggtggttgaggtaatttaatcaagacctgaactacagcagttgccagtgaagaataaagagacctaaatgatagacttaccagtggatttttttcagtcattcagcatacggtaactgagctcctgttaccatggtaggtgccaagaataccaagatttaatttagggcagttgagtgcctaaggatttgtgatagagaatgtaggtggaatggtgggtttgagggatgaggttgagggttctcatgtggataaattgcattctaactaaagatttttattaagcagttagaaatttggatcaggaatttaagaagctagtgagaatatgagttgtatatataaagtgtgtccttatagagtgattttttaaaacatagagttagttgataatattagagggttagagcaagtctacaagagactcaagggaatatctgcgttcagggatcaggcaagaaattgatgaggaacatggagtattcaaagtcaagcaagtgaagggaacacttcaataatgcttggagttatactgtagagaaattgaatttaggccaggcacagtggctcatgcctgtaatcccagcactttgagaggccgatgcgggcagatcacttgaggtcaggagttcaagaccagcctggccaatatggtgaaacctcatctctactaaaaatacaaaaattagccgggcatgatggcgtgtgcctgtaatcccagctacttgggaggctgaggtgggaaaattgcctgaactaggaggtggaggttgcagtgagccgagattgtgctgctgcactccagcctgggtgacagagcaagactccatctcaaaaaaaaaacaaaaaagagaattgagtttagatgagaagggggaaaatgggtaagtacatctttggtgttaatttggaaagcagtttaagtggtatgatgttatgtcctagtgatctaggaataagaggaaaggattaaggaaggaaagacagcaagttattgattagtcttttaagaaagtccctactcatggatgtgaagatggcaacagtagacaccgggaactgccagagcggggagggagggtggaaggagacaagggttgacaaactaactattgggcgctgtgctcactgtgtgggtgatgggctcatttgtatctgaaatcttcacaccatccagtgtacacatgtaacaaacctgcacatgtacatgtacttcctgagtccaaaataaaagttgaatttttttttttcaaaagtgcctgaggaaaaagatgaactgtggttatttttgaagggtaataagacttttttgagaagaggctggggctggggtgggatggtggacaggggagggataggagcatggacaagggagaagatagggaaggtgcagagctgtcttaaggcaggggagaggtgagttgtagaaggcaccgtgaagtaggtatcttttttgagaacaagtttgtgtaattgtgtggttgtggggattgaggggaatgacattgggcagtctgtctcaaacagtgcagagaattctcttttgggggattggagggaggggtgccaataatacttaaacttgtcctactgcaaaacctcctttacctcccttcaccaattcacatgacattggccagaagcagctgtaccaagtgcaggaactctctgaaggcttgagttttatcaattcatgcaaaatctacattgtatggatactttaatatttatttttaaaagtttatttttccccactaatgtttaagtaaaatttattcttcagaaagagtgtgccatgtctattatatggcttccaatatccatgatgaaaacatcccagcttgagaagcactgatgaaggcaacacttcggaatgtggaaaggattgctgagcagcgccagtttgtgggagatggtttttatctttttggtgctgctgacctataagagtaatgaaaaaattcaaaagttgggggccacataatcggaaaaaaaattaatttgttctttggtttgcagtttgagaggggaagaaatacaaagctggttttatcagcttttttttcttaattgaaattttttcaatatattccttaagtaatttttgtaaaattatggcaattggaggttggagtgaaagaatggactaagaaaaaagactgagctgtgactagaaaaggactgacatgaagcaacagatgttatgtaggtgagaaatgagcaggaattaggcttacagagaagaaacagggaagattttgtagtatgttcatggtgctgctgatgttatgtttgttttatttgtttgttcatttaagtagaggagtttattttgtgcccttacatccctaggccttttgcagcctccttcccttattaatagcacctgacccaatttaggataagcctaaaaaagggctattccccataggggcttataggactagtttcatgctcagacaggaactttcagatccacctgtgcagaaatggactaaatacataggtggggttcactctgcaaaagacttagagaagaggaggaaagagttttaagtaccagtaactatgcatttaaagctgatgaaagcagtgaggagctaatagcctaaaatgttgtgttctgttaattgaacattttaaaatattcatcttaattcataggttgtgaatccatatggaagcaaccaaaagtaaccgtctctcccagattcagtgttacagttcctttcaagagattccaggaaaatagacacatttctttcaaaaagctatgtgcaaaggcacaccaacttgttatgtacctcagagctcaaagacacaaagatgtacttgtgtttaataattctataatttttaattttttaattacatgtatggtaagtggtgaaaagctttttttttttttttttttttttttttgagatggagctttgctcttgttgcccacactggagtgcaatggcgcgacctcggctcaccgcaacctctgcctcccgggttcaagcgattctcccacctcagcctctcgagtagctgggattacaggcatgtgccaccatgcctggctaattttgtatttttagtagagacagggtttctccatgttggtcaggctggtctcgaactcccgacctcaggtgatctgccctccttggcttcccagagtgctgggattataggcgtgagccatcatgccttgccaaaaagctcttttgactaagacaacaaaaaaagttaagtgccttaagttgggactggtagatacaggactctgttggaggttggttctaggctcagctctgtctctgatcagctgcctgactgagtaaaccatgttaggtttctgggcctgagtgtctgttcttaattgttggggtagatgaggacagtgattttcaaacctttttttagcttggaactcttatgtttaaacaaagtctcgtacagaaatataaacaaatagaacctatttgcacagacctgtttggggctagagattttatccttgatgaacaccagactgggttactaaatttagctctaaacctttctttttgttgtaattaatatttttcattcctgtccaaaatcttgactttcaggcattcttggagtcttttcttttttttaatttcatggagctacaaaatactagagcgacccttgtggtttttcagttcgagttctagatccaagaggtgagggtggacttcaggttgtctgaagtctctgaaattgtacacaaaatgttgtgttttttgtttttttttttttaactttttagggaaaagatacatagttttcatctatactaagagtataatactattttattttttatgatatgttggaattgaagatgattattatacattctttaaatagcagaaaaattggaaacaacctgtatagccaggaaactggttaaaaagattgtgagttgccatttaaaatgacatttagaacaaattattttaatagtatgggaaaatactatttaaaaaaagcatgacacaaactcacatataccatatgatctcagccactttaaattacgcaaataagactagaaggaggtgtatcaaattatgttatctcttggcatttgggattatagatttattttcccagtttactataataagcatatataacttccataaaaagatttttaatgtaaagcatttcacagaaatgacaacaaaatgatctgtggctctagtagctttcttgtgtaatatgattattattattaaaactttactctgcacctactgtttctatacagttgtctttttctgttagctactagaacagtggcatgtaatcaggtatgttcatcagagccgtacatggagtatttaaaaatgtacatgtctcactctatccccacagcttctgattaagtagatgaagagtagggctagcatccgtattttttaaaagctttacaaatgatttaaatcagccgcctaactgagaatgtaatctataaccagaagctgttgagtatgatacttaccttccgcttagcagcaagcatcaacgtttgaagccttcacttcacatttagttgttaaacttaaggggaaaacagcatatttgagttatacaaaataaacccaaatacgggtgctatacattattttaaagctagctagacaagaatcttgaaaagagtccatttaatactattccatatctctaatgcatgttgcttttggttttatcttttactccctagtgaatggagtgccatagaaaaagaaatgggtgatggactgcagagtgctggtcatcatatggatgtgtaagtacctcgagaacttttgtgaagcctgaggtgaagtcctgtagtgaagcattagtgactcttctattcttctgtttttatcaagtttgctggcatttatattgcgctctatgtgtacatatctgacttaaatttatctcaggaatgcaaagttagtttaacatttgaaaatccatctaattcatattttaacagaatgaagatgaaaacattgaaggtatgttcatttccatacatgtagaaaaagcatttgatgaattttaacacccatttacagtaaaaagtctcatcaactaggaataaaagggaattttctcagtctaaaatttatagccaatattgtacttaatagtgaaatattgaggctttctcttaaggtcaagaaaaaggcaaggttgtttgctcttgccgcttttagtaaacattgtactggaggtcctactcaatatggtgagacaagaaaattaaataagagccctaaatattaggaagaagcaaaactatattttcagttgaaaggtcttttacacagaaaaccataaacaatcaaccaaaaacattgtagaactaacaactgatttttttttttttttttttttaaagagactaggtcttactttgttgcccaggctggagggtattggtacaatcacagctcactgcagcttcaaccttctgggctcaagcacaccttccacctcagcctcccaagtagctaggactacaggtgcatgccaccacgcctggctaattattttttatttttttgtagaggcagagtgttgctatgttgcccaggtcgatcttggactcctggccttaagcaatcctcctgccttggcctcccaaagtgctgggattacaggcatgagccgctgttcccagattgaattaaatttttttttttctttttttagagatggggtcttgctgtgtttcccaggctggtctcaaacttctggcctcaagggattctcccatctcaacctcccaaagtgctgggattagcggcgggagccagcacacctggccaacaactgaattaattttattttttccaacttctattataggttcaggggttacatgtgcaggtttgtaaattgcctgacatggggatttggtgtacagatcatttcatcacccagtaagcttagtacctgagaggtggtttttcgattctcaccctcctcctaacctccacccttaagtaggcattgatttctgttgttctcttctttgtaatccacgtgtactgaatgtttaactcccacttataaatgagaatatgtgatacttggttttttgttcctgtgttaattcacttaggataatggcctccagctgcatccatgttgctgcatccttattgctgcatctattctcttacatggctgtgtagtattccatggtatacatgtaccacagtttctttatccagtccaccgttcatggcatttaggttgattccatgtcttcgctattgtgaatactgctgcagtgaacacaggcgtgcatgtatccttatggtagaataatttatattttgggggatatagacccagtactgggagactgctgggttgaatggtacttctattttaagttctttgagaaatctctagactgcttttcacagtggctgaactaatttactttcccaacagcagtgtgtgttcctctttctctgcaaccttgccagcatgttattttttgaccttttagtaataaccattctggccaggtgcagtggctcacgcctgtaatcccagcactgtagaaggctgaggtgggcagatctcttgagcctaggagttcaagaccagcctgggaaacatagcaagaacaagtctctgttatttaagttaaaaaaaataataataataaccattctgactagcgtgagatggtatctcattgtggttttgattttcatttatttaatgatgttgagtattttttcatgtttgttggccacatgtatgtcttctgttgagaagtatctgttcatatccttccccccactcctttatttttatgtttatttttgttttcattttttctgagatggagtctcactctgtcacccaggctggagtgccgtggcgcaatcttggctcactgcaacctctgcctcccaggttcaagcaattctcctgactcagcctcccgagtagctgggattacaggcgcccaccaccacacccggctaattttggtatttttagtagagacagggttttgccattttggccagactggtctcaaactcctgggcttgagtgatctgcccaactcagcctcccgaagtgcttggattacaggggtaagccaccgcacctggccctttttttttttttttttttggaagacagagtctcactctttcacccaggctggaatgcagtggcaccatctcagttcactgcaacctctacctcccggggtcaagtgattcttctgcctcagcttcccaagtagctgggactacagacatgtgccaccacacccagctaatttttgtatttttagtagagacggggatttgccatattggccaggctggtctcaaactcctgacctcatgatccgcccacctcagcctcccaaagtgctgggattataggcgtgagccactgcgtccggctttttttctttttttaaacagagtcttactctgtctcccaggctggagaacagtggtgctatcagcttactgcagcctcctcctccccagttcaagcgattctcctgcctcaacctcccaaaagtgtgggattacaggtgtgagccaccacgcctggcctcctttgcccatttttaaattgagctgttttttgcctgttaatttgtttaagttccttatagattctggatattaaacctttgtcagataacatagtttgggaatatcttctcccatttcgtaagttatctgtttactctgtttatagtttcttttgctgtgcagaagctctttagtttaattaggtcccaactgtcattttttgttttgttgcaattgcttttggagtcttcatcatgaaatctttgccatagcctatgtcccaaatggtatttactaggttttcttttttttttttttgttaatagttataggttttacatttaagtccttagtctatcttgagttgatttttgtatgtgataacaggaaggggtccagtttaaatctgcatatggctaaccaacaactgaatttaattaagatgcaggatgcaagtttaatatctaaaaatctattatatactagcaacaatttgaaaataaaaaatttaaaataatgctatttatgataacatcaaaacataaaacttaggtattaatttaatgaaagatatgaaagacctctacagtgaaaactacataaaacattgctgagagaaattaaaacctaaataaatggaaagataaactatgttcatggattggaaggcattgttaagatgtcagttctccccaaattgctaattctaaagtttacatgggccgggcacaatggctcacacttttaatctcagctgtttgggatgccgagacaggtggatcacttaaggtcaggagtttgagaccaggctggccaacatggtgaaaccctgtctctactaaaaatacaaaaattagccgggtgtggtggcgcatgcctatagtcctagccacttgggaggctgaggcaggagaatcacttgaactcgggaggcagaggttgcagtgagccgagaccacaccactgcactccagcctaggtgacagagtgagactttgtctcaaaaaaataaaataaaaagtaaaagtttatatggacatttaaagaacctagaatagctacaacaatcttgacaaagaacaaaactggaatatattactttcaagatttactaggccgggcacagtgtatcacacctgtaatcccagcactttgggaggctgaggcgggtgaatcacctgagaccaggagctcaagaccagcctggctgacatggcgaaaccccatctctactaaaaatacaaaataaattagccaggtgtggtggcaggcgcttgtaatcccagctactcaggaggctgaggcaggagaatcacttgaacccaggaggcggaggctacagtgaatcgagattgcaccattgcactccagcctgggtgacaagagtgaaactctgtccccacctcccaaaaaaaaaaaaaagatttactataaagctaagttatgaagatagtgaggtattggcataaagttaaacagattgaccaggtacagtggctcatgctgtgatcccggctctttggcaggcaaacgtgagtagatccctggagtccaggagtttgagatcagcctgggcaacatggcaaaaccctgtctctacaaaaaactacaaaaattaggcccggcatggtggctcaagcctgtaatcctagtactttgggaggccaaggtgggtggattatgtgaggtcaggagtttaagaccagcctggtcaacatggtgaatccctgtctctactaaaaatataaatattagccaggtgtggtgatgtgcacctgtagtcccagctactcaggaagctgaggcaggagaattacttgaacccaaggaggcagtggttgcagtgagcctaagattgcaccactgcactccaacctgggtgacagagcaagactttgtctcaaaaaaaccaaaactacaaaaattagcagggagtggtggcatgtacctgtactcccagctactcgggaggctgaagtgggatgatcacttgagcccagaaagtcaaggctgcagttgagtcatgatcctgtcactgcattttaacctgggtgagagtgagactgtgtctcaaaaaaaaaaaaaaaaaaaaaaaaaagaaagataaatagatcaatggaacagaattctgtacagaaatagactcacacttctatagctcatttcaacaaatggtgttggaataactggatatctacatggaaaaaaaaaaaccttgagccttatcttacacttgacacaaaactaattcaattcggctcatacacataattgtaaaaggtaaaagtatagcttatagtggaaaacattgttaagaaggatatgaaaagaaaaaattactttaaatggcaaattggtcttcatcaaatttaaaatttttgtttaaattttgatgaccaatttaccatttgataccattgaaggagcaagaaattgagagttaaatggggtgcagagtttcagttgcagacgatgagaaaattatggaggtgggtggtggtaatgattatgcaacagtgtatatatacttaataccactgagttgtatacttaaaaattattaacaaggtaaattttatattatgtatgttttactattttttaaaattttaatataaattgatacagggtctcactgtgttacccaggctggtctcaaactcctgggctcaagtaatccaccgtcatagcctctcaaagtgctgggattacaagcatgagccaccccgccaggcctttactattttttaaaaagcgacactattaagacagtgaagaagcaagtataggagcaaacatttctaaccatagtatagaaagaactcctgtgattcaaaaagacaaaaaatagatcttaaatattctcaccacaaaaataatgccaagtatgtcaggtgatggatatgttaattagcttcatttaatcatttcatgatgtatacatacatcaaaacatcacattgtacactgtaaatacatacagttctttaattatactttaaagctaggagagaaaaaagaaaaaatgtgtttatctaaatattacttttccttaggccatgttccaaaccaactagctacttttttcaactattttgtttaaccctaagttgtcctgtggtctcttgatttggcatttcaatgtttccaagaatttaggattatcccttcagttgatttatgaaagtgttaaataaaattctgagtactgagatctaaaaatctttatcatttatacttccccaccctaggatgttccagtttctccctacactgtgtttcctatcttcaggccacaagtcctctttgttttcttcacattaactcttccagaatcatagacttaggaactaaaggcaggttttcctactcttaatagtgattctcaagacttttttccagtcacatataagaaattattcactctcatagctgtaagtttgtacttacagaatgtatatgttcactgcttacataaatcctgtaagcacattgcttttcaaatgacccttagcatagttttgtttattttgtcttacaacttcaataaacttgatgaggcaggtctagagacataaagtgtgtccatgcgaaggaaccagaattaatttgaaagaaggatacctgttgtatcacacagaagtagtacatacacatagcccctgtccttatggaatttacaatgctatcagagaaataaaaccaacacacgaggccgactctaggtgtactgcctatgagttagtcctgctcctcaaggagcagtgctcttcaataaaaggtttccacctgacaccaccggctcacccttgaattctttcctgggcgaagctgataaccctcctgggctaacctccaattttggggctcacttgtcctgcattatctagatctggtaattccttatctaatgtcaatctaaaaggaactaaacagtggaatggtgtgtgtaattaaatgtatctgataaactgcaacttgccatgtatttcatacaattttatattaaattacaataccttgtatcagctatggtttcttctctctttttttttttttttttttttttggtgagacagagtctaactctgtcaccccagcttgaatacaatggcacattcacagctcactgcagccttggacctcctgggctcaggcattcctcccaaattagcctcctgagcacctgggactataggcatgcactaccatgtccagctaatttttgtattttttgtagagacagggtcttgccatgttgcccaggctggtctcgaactcctgggttctagtgtacaatctccagttacagcttttccatctgccctggctttagtaccgagttttctcttgtcactagatttgtcacagtcagcctatcaattggcacattgtagatgctcaacaaatagataattcaaataaataagaatcacttttaaaaaaaccaacacatgggatatgactttgataaaatttaagttcaaattgttgataagggaacgaaagtagaatgatgactaaagactaaagcagtctgggaaaatttcctagaggtgttgagacatgtgcttgtatggtttggagaagcaatgtgggagccatcacattctgtacaaatgaagactcatgcgcaggaatgaaactgggatgacattgagggagtctcccaatcaaagcagaggttgctattaagaattagtataaaatggccgggcgctgtggctcacgcctgtaatcctagcactttgggaggctgaggcgagtgggtcaggagatcgagaccatcctggctaacacggtgaaaccccttctctactaaaaatacaaaaaattaactgggcgtggtgacaggcacctgtagtcccagctacttgggaggctgaggcaggagaatggcgtgaacccgggaggcagagcttgcagtgagccaagatcgcgccactgcactccagcctgggcgacaaagtgagactccgtctcaaaaaaaaaaaaaaattagtataaaataagcttctaaaattttctccaacctttatttactctactttttcttttgtagctatttggcatcattataataaataattgcaaccaagaacatatgtataccaattataccaaactcttattctttctacagattttgtagcccttttatgtatgtctttgaacaaaagatattacagtcttacaagcttcttaaactgcctatgaaaaagaccatttttttgtttgtttatttctaagtcattgctgaccaaaacattttggtaaaattcaataaaatcatcatggtaattacacattgctgtcagtgattctaaacgctaattctcactgtctgtacttacaacatcactgatgggtagcaaattatctgtgggccacacttagaattgctgttttttgtttgtttgtttgtctgtttgtttttgagacagagtcttgctgtgtcacccaggctggagtgcactggtatgatcttggctcactgcaacctcctcctcccgggttcaagagattctcctgcctcagcctcccaagtagctgggattacaggcacccgcccccacttccggctaatttttgtatttttagtagagacagggtttcaccacgttggccaggctggtctcgaactcctgacctcaagtgatctgcccttcttggcctcccaaagtgctgggattacaggtgtgagccactgcgcccagcctaattgcacttctctagaaccctaatactttgtattccaatgaaagtaactctatgcaatgtgtgtttttttttttaaaacaggtatgcatcttctattgatgatattttggaagatgaagaacattatgcagatcagttaaaagagtatcttttttatgcagaagcattgcggtaagtttaataaaagttccaggtgcagccacagggttgttcaccactctcctcatatgccactgtaaagtacagatagtagagtgttttttaaatgaatgcattccctcagataatgaatgaggtctcattgtatttctctgtgttgcagagtgctaggcataaacatgtaagatgaggcctgccctcgaagcatcattttgataaaacctgccagcctcaggcatcaagtgtgcctgtatgttgttgtttccactttttccagtttgaagattggaagcaaaatacagattcagtgtgtgtaacagtatctgttactatgttgtatattgctatttttattctgtgtgtcttatcagtagcttgtacaacgtccttatgtaacaaggactttcttatctgttcttatgttatcttttacagagccaaagggaattctcttttagatagtcctacgtgactaggaaaaagttaatatatttttttctgatcagtttagaaaaaggaattattttcccagaataggtggcttttggtcagttgtcctgtcacttttttttttttttttttttgagacagactagagtttggctgtgtcacccaggctggagtgcagtggcgtgatctcggctcactgcaacctccacgtcccgggttcaaactattctcctgcctcagcctcctgagtagctgggattacaggcgcccgccaacacacccagctaatttttgtatttttagtagagacagggtttcaccgttgttggccaggctggtctcaaactcctgacctcgggtaatccacccgcctcggcctctcaaagtgctgggattacaggcatgagccaacactgtcctgtcgcttttaaaagcagtataagaattctgttaggaaaacaagagcactattcccttacctctgtggtgattggtgtgaaatcatctgcacattgttagctcgttttccttctagggctttgagtagtaggaagtctcaccaatgtattttcaagtcaccaagcaaaagaaagttggctaggtgaggtggctcctgcctgaatcccagcactttgggagcccaaggcggatggatcacctgaggccaggagttcgagaccagcctagccaacatggtgaaaccccgtctctactaaaattacaaaaaagttagccaggcatagtggtgggtgcctgtaatcccagctgctggagaggctgaggcagaataactgcttgaacaggggaggtggaggttgcagtgagccgagatcgcaccattacactccagcctgggtgacagagtgagattctgtctcaaaaaagaaagttgctgagtacagtggaattctctgcagctcttaaaaattataaaagggattaatgtatgttgacatggaaagatggccagggtgtatagccatttgagaaaagatgtaggaaccatttggggtgcatggatatggtatttgtcaatgcctagctaaattctgaaagattatatactatctggtaacaccgattatatctggatagtgggattggaggaaagagagtgttcttgaactttcttgttgtattttgttttttttatttttttgagttggagtttcactctgttgcccagactggagtacagtggcacaatctctgctcactgccacctctgcctcctgggtacaagtgattctcctgcctcagcctcccaagcagctgggattacaggcatgcaccaccatgcccggctaatttttgtatttttagtagagatggggttttaccatgttggtcaggctggtcttgaactcctgacctcaggtgatctgcccacctcgacctcccaaagtgctgggattactggcatgagccaccatgcccagcctcttttttttactttgtgcattgctgtattagaatcttttcttttctttttttttttttttttttttttttttttttgagacggagtctcgctctttcacccaggctggagtgcagtggcgtgatctcggctcactgcaggctccgccccccgggattcacgccattctcctgcttcagcctcccgcgtagctgggagtacaggcgcctgccacctctcccggctttttttgtatttttagtagagacggggtttcaccgtgttagccaggatggtctcaatctcctgacctcgtgatccacccgcctcggcctcccaaagtgctgggattacaggcatgagccaccgcgcccatccgaatcttttctttttacagtgaacatggattacttttatgatcataaaaactaataaacatttctaggccaggcgacatggctcatgcatataatcctagcactttgggaaactgaggtggatggattgcttgagcccatgagtttgagaccagcctgggcaacatgggcgagaccccatctctacaaagcacaaattagttggatatggtggcacatgccttagtcccagctacttaggaggctgaggtgggaggattgcctgagcccaggaggcagaggttgcatttagccgagattgcaccattgccctccagcctgggtgacagagtgagaccttgtctccaaaaaaaaaaaaaaaaaaatacctaatagacatttctaaatcacaaagaagaaaactttgaggtattatcttttctaagaatactcagttgctatgtgagattacagcattagttcttacattatgtaagaactaattatgtatgtagttcattatgtatgtaattatgtatacatatgtatacattatgtatgtagttctcacatacattaaaaaatgttttatgtatgtgataatggcatgtttattgaaagaaatgttccaagtatatggaaaacaactttttttgtgttaagaatatatgacgtttttggccgggtacaggtggctcatgcctgtaatcccagtactttgggaggccgaagtgggtgggtcacctcaggtcagcagtttgagaccagcctggccaatatggagaattcccatctctactaaaaatacaaaattagctgggtgtggtggcgcatgcctgtaatcccatctactagggaagctgaggcaggagaatcatttgaacccgggaggcggaggttgcagtgagccgagatcgcgccattgcactccagcctgggcaacaagagcaaaactctgtctcaaaaaaaaaaaaaaaaaaaaaagaatatatgaagtttttatggttaggttctgctagattccattagattccatttttaatgttgggctactacattttaaacttgaaaattctgggcacacacattctgccctagcgagacattgtgaatggttctcctctacccttgaaaaaaatgtttgacatgttaaaggaaaagttaaatggcagcacattttttcatctgtagggctgtgtgcaggaaacatgaacttatgcagtatgacttggagatggctgctcaggacttagcatccaagaagcagcagtgtgaggaactggtaactggggtgagtattttccttttggcctctgatgatactgtagcaacacggaatgttcctcacaagcactcactctgagtgagtaactcactcctgtagaatcagttccagttacaatactcaggacggctgaaccttttacaggggaataatttgtgagtaactttataattcttttattattatcttgatacaaaatgatgtaagccattaaaaccatgtactgtatagaattataagaaattttgccaacatttctctggtgtaatcagtatcatccggtttcgttttaaaaaaaaaaaaaattattgggctgggcacggtggctcacacctgtaatcccagcactttgggaggccaaggccagtggatcacctgaggtcaggagttcgagattagcctggccaacatggtgaaacccgatctctactagaaatacaaaaattagccaggtgtggtgcctcacgcctgtagtcccagctactcgggaaggtgaggcagaagaattgcttgaaccagggaatcggaggttgcagtgacccgaggtcacgccactgcactccagcctgggtgacagagcaagactccatctcaaaaaaattgtttttattaatttttattttttgagacaaggtctggttctgtttcccaggctggagtgcagtggtatgatcagggctcatggaagcctcaaactcctgggatcaagtggtcttcctgcctcagcctcttgagtagttgggaccacaggcatgtgcccccatgcctggctaattttgtttatagtctcatcatgttgaccagggtggtctcaaactcctggactcaagtgatcctcccacctccgcctcccaaagtgctaggattacaggggtaagccaccatgcctagtctatcatctggtttctaagtccaagtgaaaaaacatgcagtgacctttatcaggtttaactttgcaaggtactttgcagaaattttagttgactttgaaaagccttacccacttagaaccagtgcatctcgcctaacagggagcttttgatgtactttattctttaatgcttacagtgagtacttgtgaggaaaattctgtacctgattgcattagtcttggatcatttttataatcagctttctactccagttatttcattgcaataaatcagccatcatggtgagcaacacacattctgaaagtagtaaaccagcagcaatgtctctacttagttaataagcactgtagtttttgtttgtttgtttgtttgtttttagaccgagtttcgctctgttgcccaggttagagtgtggctcactgcaagctccacctcctgggttcacaccattctcctgcctcagcctcctgaatagctgggactacaggcgcctgccaccacgcccgaccaattttttttttgcacttttagtacagacggggtttcaccatgttagccaagatggtctgaatctcctgacctcgtgatccgcccgcctcggccacccaaagtgctgggattataggcatgagccagcgcgcctggccaagcactatagttttaaaagtgcttttcacagagattacccactggctacatctgtgaaaagtcacagatatatgtggggaaagacttgtgaccaggacacatgtataaactaggcccttggtttatttttaaaactcagtgggagaagttcccaggccattttcagggagcttggttctctatcctacatgtcaagggaaaagtgttttcttcagtaaactccagagagtgaggaaatgttaaagcagtgaagcttggggttgccttcccatgcttggatttaggtatcctgttttattaatagatgcccaagtttgagcgttgagttatgcagattttaaatatgcttctttagtttggtttatttccatagttgcctagtgaatttatcgactttttttataacataaagtaatttttaaaatatcattcatacagagtaagaaataacgtctaatatttcacgtggaagttttccatttgattatgaaattcaagccgggtatggtagcttacaatggcaatcccgacacctttagcagcagaggcgtaaacccagaattgcttgagcccaggaatttgagaccagtgtggattaatatagctagaccctgtctttaccaaaaatttaaaaattagctgggtgtggtggcatgcacctgtggtcccagccacttgggaggcagaggtgggaggatcacttgagcccaggaggttgaggctgcagtgagccatgattgtgccattacattctagcctgggcaacagagcaagaccccatttcaaaaaaaaaaagaaattcagttagaagtgtcttctttttgactactccatattatttcagtgttagaaattctattaggattcttggctatgactctgtaaaaataaataaaaactcatataagagatccctggttgtgaagcttatggtggttttgtctgacttaggggaaatatggcaaatgttttctatttcctttgtgtgtgtagtgaaatatatataacataaaatgtaccatcttgtccatttttaagtatatagttcagtagtgcagtcatccctcagtatcttcagtgagattggtttaaggatccctgggataccaaaatcctcagatgcttaagtcccttctataaaatggtgtagtatttgcatgtaacctgtgcatatccttttgtatactttaaatcagcagtcgccaacctttttggcactagggacctgttttgtggaagacagtttttccatggaccagggcagggggtgctgaggatgatttcgggatgaaactgtttcatttcagatcatctcaggcattagattttcacaaggaacacacaacctggatccctcacatgcgcagttcacaatagggttcgtgctcctaagagaatctaatgcctctgctgctgatctgacaggaggcagagctcaggtggtcgcttgcctcctgctatgcagcctggttccaaacaggccatggactggtatcactccgtggctctggggttggggaccccctgctttaaattatctctagattattaatacctaatacagtgtaaacactggtgtctcatataagtggaatcatacagtatttgtctttttgtatctgtcttatttcacttagcataatgtcctgcaggtttatccatgttgtagcatatatcagatttgattccttttaaaggctgaataatgttccattgtatgtgtatgtgtatgccgcattttgtttatccattcatctgtttctgtttccttttagactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcaggtaaagatgctgcgatgtttaagtaagctaggcttgtagactatatggtagattattttatttatttatttatttattttggtaacaattcccagcttcattggcatccctgaatacagcctattcctttaaaatgcattcctaagaaatttgagttatcacgctgggtgtggtggctcacgcctgtaatcctgacactttaggaggctgaggtgggaggattgcttgagcctgggagtttgagaccagcctgggcaacgtaggaagaccctgtctctacagaaataaataaataaataaataaataaataaaaataaaagaaagttgaattatcaaaaataatgttatagaaacagttgtttcaatgtgggggaaagagaaataaaagtttcaacttcataatattattttcctgcactattcctgatttctaccctttgtactttccctccaccatttcttctcccctcccctccttcagtacccagctgaagtgttacttcattgtgaagccttctcaggctatcacggcatttaattcatgccagtatggtatggcagttttgtattagatgattgattgttctgtgtgactatccctggctaaatttaagcccttcaaagtcagtgattgtatcttttccacattcacatcccagtgccttacatagggcttagcatgtaattgttacataagtatttctagaaattcagttctcagagacccactatcactgtttgactcatttttcttatttttgttttcatctgacagtcagtgaatagaccaaggcagaccaagagtgtattttgggttttgaggtggttttgttcatttttagaactactagcaccaaatatggcaaagtaatagatagaattaaaaaagacaggccgggcgcggtagctcatgcctgtaatcccagcactttgggaggctgaggtgggtggatcatgaggtcaggagtttgagaccatcctggctaacatgctgaaaccctgtctctactaaaaaccaaaaaaattagccgagcgcggtggcaggcgcctacagtcccagctactcgggaggctgaggcaggagaatggtgtgaacctgggaggtggagcttgcagtgagcggagatcacgccactgcactctagcctgggcgacagagtgaaactctgtctccaaaaacaaatacctctcgggattttaatttttattattatttttcatttttttgagacggagtctcaccctgctgcccaggccggagtgcagtggtgccattgttgctcgctgccacctcaaagtccagggctcaagtgatcctcccatctcagcctcccgaatcactgggactaccggctaccaagcctggctaaaaaagtttttaaactttggttgtgatttaaaacaagtacatgcagctggccgtggtggctcacacctgtaatcctagcactttgggaggcctaggagagtggattgcctgaggtcggaagttcaagaccagcctggccaacatggtgaaaccttgtctctactaaaaatacaaaaaattagccgagtgcagtggcgtgtgcctgtaatcccagctactctggagactgaggcaagaaccctggatgtggaggttgtggtgagccaagatcacgcctctgcactccagcctgggctacagagcgagacttggtctcaaaaaaaaaaaaatgctaaacgtgattcataatccatcttgtcaaaagagtgtatattttccagtgacccctggaaggcacttacttcattgtgactgacacctgttaggtttgtgagctggcttaaggagtcatctatgtgtattttataggaataatttaaaggtagaatccttgtggcaaaaacttagattattaggccaggtgcagcggctcacgctgtaatcccagcagtttgggaggctgaggtgggcagatcacctgagctcaggtgttcaagcccagcctggccaacatggtgaaaccctgtctctactaaaaatacaaaaattagttgggcgtagtggcgtgtgcctgtaatcccagctactcaggaggctaaggcaggagaattgctcaaacccggaatgcagaggctgcagtgagccaagatcacgccactacactccagcctgggcaacagagtgagactctgtctcaaaaaaaaaagaaaaagtagattaaaaggtacaagaatatatgactgtctgtttgctttttccctaactataatttttaggaaaataaaaaaactgtcttatacaagcaataactcttccttctacataggcaattaaaaaccaacgccaatgagaactggttaactttttagtacacagtttatttaacttaaataataataatggctataccttttatttcagagaatttgtgaaaaacgcatgggctgatattgaacgcttcaaagaacaaaagaaccgagacttaaaggaggccctcataagctatgcagtcatgcagatcagtatgtgcaaaaaggtagggtttttcctgtttcagtgaagatatatgtatattcagaagtgcttatacatgtatttaaattacctgaccaaaaaatttttcatttttattcttctcttgtagaatgtttaccaatttctctattttaattttgtaggatttctgttttattttgttttggtttttttattttaaaattttaaatatttaaaaaatagatatgggggggtctcgctatgttgcccaggctggtctcgaactcctggcctcatatagtcctcctgcctcggcctcccaaagtgctgcaattacaggtgcgagccaccatgtccagcctctactggtgttacaaccagtatgcccattactgagtctccactcatctaaagtccaaatttgtatctccatttataacttgtatttgagaatatataccaagattatttagatcatatggtactcttggaccagacagtaaaataccattccaggtatatgctttgattggaaaatagcttgaacattatttcgtgaagacctggttatgatatgcttcctcataaagtaaatcatttgtgttgctgatatccatagtgaaagatacaaacattgaagcttattctagttaaaataaatgtttgacaatgatggaagactttctaaaacgttggtttaagaacaaaataggaaacattccttaacctcttttttataacctaagatctgccagtgtgactaccagtaccagtgctttgatttgtatcacctgtcataatttatcaagcacttttacatgcattatctcagtaaattacatggtaagatgaattctcacatttatagggcaaaatcacactcatataaatatatatacaattcttatgctttagtttgtcccaaaattttattttttggctgtgggccatcactgagagaacaaagatattttgaggcataaacaccatacgcactcactggttaagtgggctccatttggtttggacaaattcatatttatgctcagtgaattataagttactgtataccgtggatctttggagtcacttaaaacaagtttagatcgtgactgttgagtctgcaggtgctaaaggttgagtatgttgtagtttggtagcatctctatcttttttttgccttcattctgtcacctcttcttgcctgcagctaggtgctagatatttacaatccattgtctttttcttttttcttctttttttgttgaaatggggtcttactgtgtcacccaggctgatcttaaactcctgggctcaagcagtcctcccgccctggcctcccaaattgctgggattataggcatgagccaccacacccagtagtacagtcctttttccaatctaactttttaacctcaagaaatctgaaagaccagataacaaaggtttttagtttttttgtttttcctgtaaaagactcattaataagctccttgtgatctctcattcacttctttccaaagtaaagtgcaagacctttatataatgtctcaaaggactttccccctccgttttgtttaggctgcagtggttgagggtgctagaaatttaatctgtgaatataaaagatactactatagctgtatttggacatactgttggatattttgtaggtttattcacaaatccttagataactagtaaaacaaaaagtttaataagagtttatgttcaccttgtttcccaagaatggtactatgcaattttgtcgttttgttttcttgcctaagtgatatagatttttatatgtgatcctagctatttgggaggttgaggcaggaggatcacttgatcccaggagttcaagactaggctgggcaacatagtgagaccttctttctttctttctttcttttttttttttttgagacagagtctcaccctgtcacccaggctggagtgcaatggcatgatctcagctcactacaacctccgcctcccgtgttcaagcaattctacctcatccagccgagtagatgggattacaggtgtgtgtcaccatgcctgactaatttttttgtatctttaggagagacggtttcaccatgttggccaggctggtctcaaactcctgatctcatgatccgcctgcctccacctcccaaagtgctgggattacgggtgtgagccaccgcacctggcccgagaccttctttcaaaaagaaaagagaagaaaaagaaaattgttcaaaaccttaataaatgacacactttaatgattaagtattaaaaagttcctttctcataaatgagtaattattggagaatatgtatcttattgaaaaaataccttactgaaaaaaacccttgccgggtacagtggctcactcctgtaatcccagcattttgggaggccaaggcaggtggatcacgaggtcaggagatcgacaccatcctgcctaacacacggtgaaatctcatctctactaaaaatacaaaaaattagctgggcatggtggcaggcgcctgtagtcccagctacttgggaggctgaggtggtagaatggtgtgaacccgggaggtggagcttgcagtgagccgagatcgcgccactgcactccagcctgggcgacagagcaagactctgtctcaaaaaaaaaaaaaaaaaaaaaaaaggaaaaaacccttaagttttactgttacatctctataaacatgtatttttgcttatgcatattaggccatctataactgtgctaagtaacttcaggtactaagagggattcagtaatttagtacataattagtttttatcaaaactttagttattagagtgataatttaataactcaatttatatttgttagactaatgaagttttttgtttcaaatattacattgaaaaaaccgagccgggcactgtggctcacacctgtgatgccagcactttgggaggcagaggcaagcaggtcgcttgagcccaggaattccagaccagcctgggtaacatagtgagattccatttctacaaaaaaaaaaaaaaatacaaaaaataagccaggtgtggtggcgtgcacttgtgatcccagctacttggcaggctgaggtgggaggatcccttgagccctggaggtcaaggctgcaatgagccatgattatactccagcctgggtaacagagtgagaccctatctccaaaaaaaaaaaaagactgaaaacttgtttgatttacaaatagaaattactcgagtatgtgatatgaaatgaattaactcagttttccaacaagttgtaggagttctttttccattttgaagataagttcgtattagagattctgtttctcttttcagaagcattagacatttgcttatattagccacttcccaaaatagtgtcatattttctcgacttcttaattattccaaaaagcaaaacttagtgtaccactaagccaagtacttgggttttcagattccttccaaactcacattttaaagtttttatttttatttttagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctg

SEQ ID NO: 36740 - DNA, 7921 bp, Homo sapiens
tttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgtgagtgcggcggcggcggggggtgatgcgggctgtgatggagggcgggggtgttaaagcccgggtggacttctccgaagcttcgtgcagcagagtcacctaaaggcgctgcgtccttatttggggcccccagagacatggagatgtggcacccaggactggaggggggaatattaggggagcgtggcaggcctggcttcccagggacctcacccacattctttattaataacctcttttatttctaccgtccttgctcctgcgcccatcctagaggctgagcagcacggcttgatttaaaaggggaggcaggcgcgtcccctcccccacctagcaggtctgggctggaggagatcctcagacccgggccctgtccctctgggggaggtaacagggtgatggaagagagtggagcaaggcagggcctcatcatcattccgcagctcagagccatcaccaggccccttggtctctcccttccactcactgtcaggagactggggacgagggcatatgcccttaggccccctagggaggaagtctgggtatcgggaagcagaaatgctcggaggacaaagtgtgagaggtaactgggagaggggatgtgtgtgctcagcctgggattgtggaccccgctgggggaggacgctccgtggccttcattccaggctgccagccacactgtggagctgtgtctctggcacctccccgggccccaggagggaacacacaccattccccacgagcccagactttgtccttgaggattctgctccgcactccacttgcaccagccggtttggaagtatccctcctgtccatgtggaaacaggcgacagccacacattgtcaaggggctgagcctgacaggggctcctcgtggttctcggagctatcccctgccctaatgaggacactgcccctcggcctccaccgttggggactgacaccggcagccccaccctgctcccttcttcccattcggtacagccgggccggccaagtgcttctgtcctggtttactctagactccttctcttcccccacccatcccagggggaatggaggggcctcacgcctccatgtggccttcagggtggctgcttctctcttgcctgggcaagccccaaagggcatcggtcctcttctttcccggcctgtgtcttgtctgcattctgtacttggatcaccagcggggccctcccctgagccctgtccctgtggtgtttacatgggggaataagcctctttgcctctctcagggcctcctgcccctgtgccctctgttccctagggccccagggccacagtggtacctctgcctgccaggtagggtgccctgttaggtggtgtcaggttccctcgcagagcctggctctgagggaggtggagggtaagggcagatgggtgtgaatgggcatgaggtcaagaaggaagacaccctgtggcagtgacctgactcccagtctccatgacatatttgtgtgtaaccaaggatcatggcgcaagggactacattggaccctctggcctctgggcctttccctgcctccggggctagagaaaaactgaacagtggagcggggagggggcatcaccctacctggctgggcatgttccatgctgctttgaccttaacccctgacctgagttcatcagtccagcggggagttctgtctctcttcccattacttacccaggggctgatgcggagctgggagggagaggccactgcccttggctgagaggcccagtaaccatgcctgcctccctaggctcatctttggcaccctgtacccagcctattcttcctacaaggccgtgaagacaaaaaacgtgaaggaatatgtgagtggatgacccttcaccccctacccaacccacatggcacagagaggggagggcactgggtcctattacagatgggggtgactttgcaccaacactgtcagccactaacaagacccaccagcaaaggagggccctgggtgtcccacacagcgcctccaacatggctggcaggcagaagtggggtccttggtgttctccccagcccaggcatgttcaacaggcagagctggggtcctgggtgtccctggcccctcagccccgtgccccagccagcgcttccctctgtccctcaggtgaaatggatgatgtactggatcgtctttgccttcttcaccacggccgagacgctcacggatatagtgctctcctggtgaggtccagcgtcccctcctgtatctcagggcccagggcctctgcctttctctacccagccagccaaacaaaagactgggcctgggggtgaagctcctcccattcctgacaatttcatggggtccttgatatctcccctctcatgcctaacttgacctgcagaagaacagacatagtagtgccaggcgagggggctcacacctgtaatcccagcactttgggaggtctaagtgggtggatcatttgaggtcaggagtttgagaccagcctggccaacatggtgaaaccccgtctccactaaaaatacaaaaaaaaaatagctgggcatggtggcgcccctgtaatcccagctactagggaggctgaggcaagagaattgcttgaacccaggaggtagaggttgcagtgagccgagatcgcgccattgcactccagcctgggcaacagagtgagactccgtctcaaaaaaaaaacaaacaaacaaggagtaagaacaaacataatccccatgtttctttctggcggcagccagagcccctcagtggaattcaggaaacccgcttctgccatgctgcctgcgaccttaggcaggtcacagctctcgaggcctcagtttccttatttgtaaaataggcatatgattcactcctataaatgctggatacttgcatttccaaggcattttccaggctgtactagactacgtatgtatgagcactttgaggacagggaatatgtcttaatcatctgtatattcacagcaggaactcaaaaatgtttactgaatgatcagatacctcttggaagaggggactaataacacagttcatcggaactcaagaagagaattttaccaagggggagaggacaagagatcattacatttatagataagacccttgcatttgagaaaaatagttttagaagaggaaagagatggagagatgggttaaaaattgagggtaaaggccgggtgtggtggctcacgcctgtaatcccagcactttgggaggccaaggcaggcagatcacgaggtcaggagatcgagaccatcctggccaacacggtgaaaccccgtctctactaaaaatacaaaaattagctaggcatggcagggcgcagtggctcacacctgtaatcccagcactttgggaggccgaggtgggcggatcatgaagtcaggagatggagagcatcctgtccaatacggtgaaaccccatctctactaaaaaacaaaacacaaaaaattagccgggcgtggtggcgggtgtctgtagtcccagctactctggaggctgaggcaggagaacggtgtgaacccaggaggcggagcttgcagtgagtcgagatcgagccactgcactccagtctgggcaacagggtgagattctgtctcaaaaaaaaaaaaaaaaatagctaggtattatggcacctacttgtaatcccagctacttgggaggctgagacaggagaatcgcttgaacccaggaggcggaggttgccgtgagccgagatcgtgccactgcactccagcctggcaacagagcaagactcagtctcaaaaaaaaaaaaattgagggtaaaggccgggcatggtggctcctgcttgtaatcctggcactttgggaagccaaggcaggaggatcacttgagcctaggagtttgagatcagcctgggcaacatagcaagacctgcctattaaaaaaaaaattggccaggtgcggtggctcatgcccataatcacagcactttgggaggccaagggggggcagatcacctgaggtcaggagttcgagaccagcctgaccaacatggtgaaaccccttatctactaaaaatacaaaattagccgggcgtggtggcacatgcctgtaatcccaactactcaggaggctgaggcagaagaattgcttgaacccaggaggcagaggttgcagtgagccaagattgtgccattgcactccggcctgggcaacaagaacgagactctgtctcaaaaaaaaaaaaaaaaaaaagatgagagtagggcaagggtggtgaggtgaaaaacaaaactgagggtagtaaatatagatgccttttttttctttttctgagatagaatctcactctgtcattcaggttggagtgcagtggtgtgatctcggctcactgcagcctctacctcctgggctcaagtgatcctcccacctcaacctcctgagtagctgggaccacaggcacacgccaccacacctggcttattttttattttttgtagagatggggttttgctgtgttgtcaggctggtcttgaactcctgggctcagatgatcctcccaccttggctcccaaagtgctgggagattacaggccactgtgccaggcctatacatgtgtcttgacacagcaaaagagagagctttgatgaagactttgtgaggacataggtgacctgaaggagtttgtgaccagaggagaaggcactatggggactgaagggcaatcctggagaagtgagggtcgtgtcacggtggggcaggagggtccagagcaagctagagaagtcccaggcctctcgatgatagggagggcagaaagggaaggagtgaagacccaggtgtaggcctgcacagtcaagagtttcccttggtgttgaccctagggcagaggaaggggggttttctctaggagtgagagggctggggcttggggagaggatgaggccaggagagtcgctgctgggggaaattccttctagtgtcactgcttaccttcctgtttggagcttcagctgagccctccagaccctttcagattagaaaggagcagtcccatgagccccatggggaccccagtgcactaagagtgaggggctgtgcagggtcacacatggggccggtgctgctggacacagggcacctcccaactccctgccctgtactctgcgcttgcccctgtcccaacaggttccccttctactttgaactgaagatcgccttcgtgatatggctgctgtccccttacaccaagggctccagcgtgctctaccgcaagttcgtgcacccaacgctgtccaacaaggagaaggtttgcccccactctcagctcacctcccagcctgcccccagccaaggcagtccagagcctgcagcctcatacagactggccctccctgtggggcccagagcccaaagtgacttggcagggctgccgtggcctcccggagcaggcaggggcctctgtccaggggtgaacaagggtagggcaggacctctcctcttctcccttcccctccaatcccataggagatcgacgagtacatcacgcaggcccgagacaagagctatgagaccatgatgagggtgggcaagaggggcctgaaccttgccgccaatgctgcagtcacagctgccgccaaggtgagatgggggcaggctcagactcccagggcccctaccttgtacaaagggccctggccaggcccctttgcatccaccctgtactcggggctgtagagactctgggctcatgcagctggaggctccagtccaggctctactgctatctggccgagtcactttgattgtccggccatttccccatctgtccccagaggcaaagtgtggccctgccccagccctcagctctgtctgtgtgggactgggtgaggacagtgtggggagggcaccgagcctggggctgctgccagcaccatggtgacctctatctccaccccgccccttccccccggctctcccggtgcgtggtggtgaccctagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggtacaggcagggcccggggttggggtggggccccaagggcaaggagtccagatgggaaagattcccccacctccttttctccctgcacccaggagatgaccctgccctgagtctaaggtccagcacaaacccggcagattcccggacagaggcttctgaggatgacatgggagacaaagctcccaagagggccaaacccatcaaaaaagcgcccaaagctgaggtgagggcactggccagagcttggggaaacaggcagggggtggcggctccaggctgagccccatcttcctccttctttccacagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctgtcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattt

SEQ ID NO: 36741 - DNA, 29701 bp, Homo sapiens
gacgggaccgcgagcacaggccgctccgcgggcgcttcggatcctcgcgggaccccaccctctcccagcctgcccagcccgctgcagccgccagcgcgccccgtcggtgagtgctcccagcaccgcagctgtcgcctcccgacccccgcccaagcctgccctggttcctcatgcctgacccctgctccctgccaccctgtccccagtctgtaacggtctccccaggtgtcccccagtcttcaccagtccccccagtctgtaaccatgtcccccactcttcccactcctcccactcttcctcccactcttcctccagtctttcgcagcctctcacactcccccagtctcctccatcctcccccaacacccctccctatcccctgggctagaagagatcctctctgcagggtctccctccacgccctcatccatatcagctaacttggtccctccagccactcaagagcccctctcctgcctcaccagctccatcggccaccgctgatagcattctccccagctctctctcagggccctccctgcctgggacaccgcccagagccctctccctctgcccacatcccagatcctgcctctcttttccattcttgccactcctttacgaactccttttgcttttatctcccctactccctggccaccccttttaagtctcatgattttatggattttagcatatttgatttgcagttattttgatgctcaaattgccccatgtttggccactgggcacccctgcaagctgggtcctctgtccctgtaacatgccctatcggcctttgagcacttcctcaccttctgacccaggctcacttgttcttccctgcccccgccctggaatccaccatttctctaaggagtcccaggttcttttagtggggaatggtatttagagactcccatctcaccaaaagttgattctttgaaaagatcagtaaaatcataagcatcaacggggagcaatcgtttttgtttttcttttttaaaaaaagcaaatacccacacctgtggctgatatcgggaatgaaagaggggacatcactacagatcctacggtgaataaaaggctagtaagggaagatagagaacacagtctgggtgctggaggtgctcattgctcctgggttggtcatggctaacctccctaactcagatctttagacctataataggattgcaacctctgaggtcaggctgcctgtgtttgagtcccagcttgagcattttccagctaagtgatcttgggtaatttattgctgtcttcctgagcctcctttgccttgttaaaaaagcagagatgagccggcatggtggcacacacctgtaatcccaacaatttgggaggctgaggtgggtggatcacctgagctcaggagttcgagaccacccagggcaacatggtgaaacccatctctactaaaaatacaaaaaaaaattaactgggtgtggtggtgcatgcctctagtcccaactacttgggaggctgaggcaggagaatcccttgagccccagaggtgaaggctgcagtgagctgagattgtatcactgcactccagcttgggctacagagtgagactccatctccaaataaataaataaataaataaataaataaataaataaataaaaagaaagaaaagcaaagcaaagcagggatgataatagacctactttacagggttataaatgttaagtgagttagtacagtacctggcatgcagtgatcataaatgttgcattatttttcttgttaacacccaacagccctcatgacctgggtgcacccaggcaaccttctcagctccatttctcacccctcctctttgtgcccctgtgtctggccacctacccagatgtttcatggctcccagtacaccaggacctttcacatccccagacctttgcacgcaccgtcctctctgcctaaatccccttgtcttgcctgctcttcatggagcagctcaaaagtcaaccctgccctgagtcttactggtgctgtggtctgtttctcatgccctcctctggatgtctggcatgtgtctgggtccttactgggggccctgggtgggtaggggatgatctctggctcatttctgggtccacagtgcctgaagcatggagtgagtgatttcagtgaaaaggtgtcaaatgatggaagggagaagggaggaagaaatgaatgaagcgattaaggaatccgtttcttccaggcagcttctgcatccttcgccttgtccatctcttggtcttccactaccaccatcaatcccccttcttcaaccatgtcaccattaatctttctcctccttcagctggttcgctacgatctccctattttttttgaaatggagtgtcgctctgtcaagtgcagtggcgggatctcggctcactgcaacctctgcctcctgggttcaagtgattctcctgtctcagcctcccaagtagctgggactacaggtggccaccaccaggcctggctaattttttgtatgtttagtagagacaggattgcaccatattggtcaggctggtctcaaactcctgacctcaggtggtccacctgcctcagcctcccgaagtgctgggattacaggcatgagccactgtgcctggcctttttttttttttttttttttgagatggggtcttactctgtagcccaggctggagtgcagcggcatgatcatagctcactgcagcctgcagccttgaactcctgagctcaagcaatcctcctgcctcagcctcccaaagtgctaggactacaggcatgcaccaccatgcccagctaattattttttttgtagagatgggggtctcactattttacccaggctggtcttcaactactgacctcaagcaatcctcctacctcagcctcccaaaatactaggattacaggtgtgagccatcgcgcctggcccaattccattcttcctcctgccacctgccatccatgctctgtgaccacatatttgtgaccacaaatatctgtgctcctcctcctcctccacccatcctgtcacccagacagtctacactcagacccctttcttcctccttggctgggccgcctatgctcatgccctctccccctcccacaggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggtgtgccagccgcgagcccagggcgcatctttctttttctttttgttaagacagagtttccgctcttttcgcccaggctggagtgcagtggtgcgatctcagctcatggcaacctccacctcctgggttcaagcaattctcctgcctcagccacctgagtagctgggattacagacacccaccaccacgccaagcgagtttttgtattattaggtacagttggggtttcaccatgttggcctggctggtcttgaactcctggcctcaagtgatccacctgcctcagcctcccaaagtgttgggattacacgagtgagccactgcgcccggccctgggggcacgtctttctgtcccaggggtgcatcttgctgtcccccttctctgtcccctccctgactgtgtttccctccttctcagccccaattcccttctctctacccagttcttcccatgcctgtctctgctctcttatccaggggagcacctaggctagtgaagtcagtatgcctggttcaaatcccggccagctgggtggcctcaggcaaatgacttgacctctctgcccttcttgtagcctcatctgcaaaaatgtggatcaatcaccttgggccaggcccggtggctcacacctgtaatcccagcgctttgggaggccaaggcaggtagatcacttgaggccaggagttggagaccagcctggccaacatggtgaaaccccgtctctaccaaaaacacaaaaaattagctgggtgtggtggttcgtgcctgtaatcccagctactcgggaggctgaggcagaagaattgcttaaacctgggaggcggaggttgcagtaagccgagaccgtgccactgcattccagcctgggcaacagagcgagactctgtctaaaaaaaaaaaaaaaaaaaaagggatcaggatcaccatggtctctatgccatggttgctgtgaggacttggaatagcacctggtggccgggcgcagtgtctcacgcctgtaatcccagcactttgggaggctgaggcgggcagatcacttgaggccagaagtttgagaccagcctggccaacatggtgaaaccccgtctctactaaaaatacaaaaattagctgggtgaggtggtgcccacctgtaatcccagctactcgggaggcttaggcaggagaatcacttgaactcgggaggcggaggttgcagtgagctgagatagtgccattgcactccagcctgggcgacaacagcaaaactctgtctcaaaaaaaaaaaaaaaaaaaagaacagtacctggcacaaattaagtgctcactgaacatgagctgtggctggttataactctgagatggtcctggttgccctttttctgtccggtgtctttcttcgcccataaaggatgctttgccatgcggtcccgagtccctcttcatgttttcttcgtgttttccctccttctgtccttccctgttgacccctgaccctccctctgcccccaggttcatgtgtgcccagctccctaatcaggtcctggagagcatcagcatcatcgacaccccgggtatcctgtcgggtgccaagcagagagtgagccgcggtgagtggggccagaccctggggtctgagggaggaggggctggggcctggactcctgggtctgagggaggagggactgggcccggactcctgggtctgagggaggaggggctggggtctggactcctgggtctgagggaggaggggctggggtctggactcctggatctgagggaggaggggctgggcccagactcctgggtctgagggaggaggggctgggggcctggactcctgggtctgagggaggagggactggggtctggactcctgggtctgagggaggaggagctggggcctggactcctgggtctgagggagaggggctgggcctggactcctgggtctgaggtaggagggcctggggtctggactcctgggtctagaggaggaggggcggtgtctccgctgggacttgggcctgtgtcctctggccctggctggcggggcagccgcagggagctagtggaagctgtgactgctccatgctggctcgcattgatgggtgggggaggtgtgtgggtgaccacgtggtgggagcgggcaggagccgcacgtctgggcaggcaggaaggatgggaagggagagatgaagagggacagggattccgaggcagtgagacagcgacgcagggagacacaaggcctggagatgaggcagagcctgggcaggggaggcagagcccgggcaggggaggctgggccctgcgagctcctggctctgcgtctgggccacagatggggccgagaaggggatgggaagggaatctgggtgggggccaaggccaggcctggaatttataaacagctgtgcaaggagagtggcggggggtggattccagccggggcctccgggcgtgctgagccctcaccacccctgcccagcccagctcagcatctgtggtcccccagccccacagatctgtgtcccccaccccccatggccttggaggcccagaactggggcaaaggaggctgctatgtggggcagagaggatgggaggccctggcgagaaggctgggcctggggtggggtggggacgctgggggtgaccatgtctctggctgccgtccagaggccccacgggagaaaggcaggaggcagctgcagaaacgattgggaggacacgctgccagctgagggggaggaattcctggggctcccaccccagggcctggacctgggacagcgggagggagaggctctctcagccagggcaggggtgccggcaggggggttcaaaggccatgggtggtgggggagtggggaacggggtctccctccctggccttgaggatagaggaagaggaggagagagtgtccagctgttggtgtgtatatgtgtgtgtgtgtgtgtgtgtgtgactttgtgtatatcttgggaaagtgtgtcattatgagtgtactcctgggtgtggtggttccacgcatttgtgtatagcagtggacgtgcctcattgtggccatggctctgaggttgtatgactttgaattgtgtacatgcctctgtgtgtgtgtgtgtgtgtgcgcatgtgcctataattgtggctggaagactttgttttgtttgtttttgagacagagtctcactctgtcgcccaggctggagtggagtggcgcgatctcggctcactgcaacctttgcctcccgagttcaagtggctctgctgcctcagcctcctgagtagccaggactacaggcgcccgccgcacccatgtccggctaatttttgtatttttttttagtagagacgggatttcaccatgttggccaggctggtctcgaactcctgacctcaggtgatcctcctgccttggcctcccaaagtgctgggattacaggtgtgagccaccatgcccggcctgctggatgactttgtgtgactctgaagggctgtgtagggctatgagagactttgtgggatagtgtgcaactgattctgtccctatatactgttatattgtgacgtgtgtgtgtgagagagacagacataaagggcaacttttgtctatgtgtctatgtggatttagtgtgtatcattgtaggtgtgagtctgacattgtgtgcctgtgtgtgagatggtctaggcatatatgtgtatctgggctgtgggctgtgtgtgactttgtgtggctgcatggggcggtcagggctgcggggattttgtgggactgtgtgtgactacctgtgattgtatctccggatacagttgtgtgcttctgtgtggtgttgtgtatgtgagaatgtgtgtgtgtgcaggagtgcatcttttgtgtaactgtgtgtgattacgtctgtgtgtgtgcctttggatttgggagggcatgggaggttatgtgtgtgcgactgtgtctgtgtgggtgtgcatgcatgtgtgcctctgtacctgtgtgttcgtgcaggtctctgtgtctatgccgtgtgtgcatctcacattatctttgtgattgtgtgaccacaaacatctgtgtaggtcccagattgtgaacacgggtatgtctgggagcctgcatcttgtagtaattggctatgtttgtgtctggatgtgctactgggggtgtgtgtgtgtgtgtgtgtgtgtgtgtgtgtatgcgagctcatgtgtgtggctgcctctgcatgtaagatgtgtgaacacacgcatgtgtgattgtagcatagtaaagccctcaaatctgggctctgctacttttatttatttatgttatgctacttttttttttttgagatggagtcttactctgtcttccaggctggagtgcagtggtgcgacctcggctcgctgcaacctccgcctcctgggttcaagcaattctctgcctcagcctccggagtagctgggattacaggcgcctgccaccatgcccggctaatttttttgtatttttagtagagacggggtttcgccgtcttagccaggcaggtcttgaactcctgacctcgtgatccacccacctcggcctcccaaagtgttgggattacaggcatgagccaccgcccagcctattttctgctgcttttaaactgtgggaccttaggcaagccacttaacctctctttgcctcagttttcttacctgcaaaatgggaataatgggctgggcgcagtggttcacgcctgtaatcccagcagtttgagaggccaaggtgggcagattacctgaggtcaggagttcgagaccagcctgggcaacatggtgaaaccctgtctatactaaaaatacaaaaattagctgggtgtggtggtgcttgcctgtaatcccacctactcgggaggctgaggcagaagaattgcttgaacccaggaggtggaggttgcagtgagccgagctcatgacactgcactccagcctgggcgatagagtgagacttggtctcaaaaataaacaaacagaaaaacaaaacacacacacacacacacacacacacacacacacacacacacacacactgggaataataatactagcggcctcatagttgtcctaaaggttaaattagttaaaacatacaaagcacttagaaggtgcacacttgtgtgtgcacacagtaggcgctatggaagtgccaacaatgcctgttttcgctgggtgagtgccgttgtgggcccaaggttcctttttgccacgtctcccatcccacactgactcaacctctctcccttcttccctccccgccccatgagacacactttccgaatctgggccagtatgtgtgtttgtggagacaccgggagggagggggggctccagttgctgtccctccagtgacttggcccttcctcccccaaaacaacggcccccaaccccatcccggtccctgcgttgcccgcaaggaggctgcttcctctcaggcaggatgggtgcaagcaccagctccccggaggagcataggggcccatgggactcctcttctgtcgcctcttacctgtgtgtcttgagtaagtcccctaacttctctctctttttttttttttgagacggagtttcgctcttgttgcccaggctggagtgcagtggcaggaccttggctcactgcaacctccgcctcctgggttcaagtgattctcctgcctcagcctcccgaatagctgggattacaggtgcccaccaccacacccagctaatttttttgtatttttagtggagacggggtttcactatgttggtcaggctggtctcgaactcctgacctcaggtgatccacccgcctcagcctcccaaagtgctgggattgcaggcgtgagccaccacgcctagctagtcccctaacttctctgtgcctcagtttcctcatctggaaaatggggtcagaacagtgcccacctcctggggttgttgtgaagagtcactgagtgagctctagctggagggcatgaagtcagtaaatcagggctagctccttgttctgccagttaactcttcgtcctccgggttcccactctgccttccctcctcctggaagtcctccttgacccccaggctgggggttgggtcaggcactggccctgggctcccacagctccctggatccccctgcccaccctgggctgaccactcaggggccaggtctgtgtccccagtgggctgagagatgtaaggacaaagctgaaactgcctcagcctccacacacacagcagggaccacagagggtgcttcccagtgggtgacatcaccatgacttgctgagtgcttaccgtacatccagcactgtttttaaaaaaacagtttcattgaggattaacgtacacgccataaaaactcaaccattatggccgggctcagtggctcatgcctgtaatctcagcactttgggaggctgaggtgggcggataatgaggtcaagagatggagaccatcctggccaacatggtgaaaacccatctctactaaaaatacagaaattagctgggtgtggtggcacctgtaatcccagctactcgggaggctgaggcaggagaattgcttgaactcgagaggcagaggttgcagtgacctgagatcgcgccactgcactccaacctgggcgacagcgagactccgtctgaaaaaaaaaaaaaaaaaaaagctcaaccatttttttttttaaagagacaaggtcttgctctgtctgcaggctggagtgcaatgacgcaatcatggctcactgcagcctccaactgctgggctcaagtgatcctcttgcttcctcctcctgagtagctgagactacagatgcatgccaacatgtgtggataattttttattttatttttttctgtagagacagggtcttgtcatcttgcccaggctggtctcaaactcccaggctcaagcgatcctcctgcctctacctcccaaagtgctgggattacaggtgtgagccactctgtctggccacttccatcatttttaaatgtacagttcaatgccaggcattattttaagctctttatatatattagctcatttatattcttttaatcttcacaacagtctttttttttttttgagacagagtctcactctgtcgcccagactggagtgcagtgatgctatctcggctcactgcaacctctgcctcccaggctcaagcgattctcgtgcctcagccttctgaatatgtgggaccataggcatgagccaccaacaccgggctaatttttttgtatttttagggctaggctggtcttgaactcctggcctcaattgatctgcccacttcagcctcccaaagtgctgggattacaggtttgagccatcacacctggcttcacaacagtcctatgatttgcattttacagaaaagaaaacacaagttcagagaggttaagctacttgcctaaggtcacacagtggatgggggcagaggagggactcaactccaggtcttccagacagctaagtcagggggtctcaatcgcttctctctgctctcctcagcattgcttgttggtgaataaatgagtgaagaagcaaaggtgagaatgagtggatgaaggagtgaatgaggaaatgaatggtgaaaggaatgaatgaatgagcatgggaacccatggctgggatgggtgcttcataagagcaagaatcttgtctgtgtgttctctgcggtatcccaggctcccaggacagggcttggcacacatgagactctcagtaagtattgctaaataaatgcaaaatatttaacttctcagcctggccaacatggtgaaaccccgtctctactaaaaatacagaaattagccagggtggtggtgcatgcctgtaatcccagctactcgggaggctgaggcaggagaattgcttgaacctgggaggtggaggtggaggttgcagtgagccacattcatgccactgcactccagcctgggcgacagagtgagactctgtctcaaaaaaaaaaaaaaaaaaaaaaaaaaaaaaaaaaaaaattatcatctgctatggcaagagcacagctatccagcatgaactctagttgctggatcgtggggagatacaacaggtcctggggaggagctggggtgatagaggcatgtggcaggcttgggggttccatagaagcacagggggatctcttagcaaacatgtcagtatttttaacaacctatatgtacataccgacgcacacctgtaataactgcttaatgaatgagcaaatgaaaaaatggaggccgtgaggctgggcgcggtggcccacgcctgtaatcccaacattttggaggctgaggcaggaggatcagttgagctcaggagtttgagactagcccggcagcccgggtaacatagtgagatcccatctctactcaaaaaaaaaaaaaaaaaaaaaaattagccaggtgtggtgatgcgcgcctgcagtcccagctactagggaggctgaggtgggaggatcacctgagctccgggaagcagaggttgcagggaggcgtgatcccgccattgtgctcgagcaaaggaaaagggggatgattgccccctgtagccagatggcttgaggggctggggccagagcgaggggggaaattctgggcactggagagccagagcagtagtgcccactgagggccttggctattttgcccagacaggatttggacagccaacaacgtgaacatctttacagtccaatatgcaagagaatgggatactactgagaatggctggagggtgggggtctgatttctgccccttgcgcccctgtctctccactcccactccaggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagtgagtagtcctgagggctgggcgcgcattcttggaggaggtttcctcggtcctctcctaccagtgctgtgagtccctgacttatcagggcccaggttagttagttctcttgaagttgggtcattctggcacagagtgaagccgggaggaagaactgtatggagagactcattcctctgcctttggatttctgtgtcaactccgtgtcaccctggcttctctgtcctggtatttctatttcttcttcctcttcctcctcctcctccttctcttcttcttcttcctctttttcttctttcttctctctttcctcctcctcctcttcttctccctcctcctcctccttcttctctttcttcctccccttcctccttccttccttccttcctctgttcctctctcccttcctccctcctcccttcctccttccttacatcctctttcgttccctcttcttccttcttttttaagagatggagtctcgctctcttgccctggctggaatgcaatgatgcaatcacagctcaccacagccttgaactcctgggctcaagtgatccttcctccttagcctgccccaagtagctgagaccacaggcacgtgtcaccacgcccagctaattttttattttttgtagagtcgaggtcttactgtgttgcccaggctggtcttgaactcctgccctcaagtgatcctccccttttggcctcccaaagtgctgggattgcaggcatgagtatgttgaatttttgaacttcctataaaatatagacagacaaatactcattattctaccctctttattttttgataatttataagattgtggttcaaaggtttccaagttcattggtttattccacaaatatttctttttcttcttcttttctttttttgagacggagttttgctcttattgcccaggctggagtgcaatggcgtgatctcggctcaccacaacctccgcctcctgaattcaagcgattctcctgcctcagcctcccgagtagctgggattacaggcattcaccaccatgcccggctaattgtgtatttttagtagagtatttttagttggtcaggctggtcttgaactctcaacctcaggtgatccgctctccttggcctcccaaagtgctgggattataggcgtgagccaccgcgccaggcccacaagtatttctggaatgctttctgtacacatggtgctggggctggggatggagggaacagacaaggttccagccctcctggggctcatctttttttaaatttaattaattaatttatttataagctagtcaaatttagcagtgggggtggggagttgcatgccaactttactgacactaataagttctgataaccaaggccaggtgcggtggctcacgcctgtaatcccaacacttttggaggattgcttgagcccaggcattgaagaccagcttgggcaacatagtgagacaccatttctattaaaaaaaaaaaaaaaagttctgataacccactaccattggaccagccccggggcttatcttttgatggagggagacagaataagtaaacagacataaaataacaatgaaggctgggtgcggtggctcacgcctgtaatcccaacactttgggaggccgaggggggagcagatcacttgaggtcaggagttcgagaccagcctggtcaagatggtgaaactgcgtctctactaaaaatacaaaaattagccaggtgtggtggcgggcacctgtaatcccagctacttgggaggctgaggcatgagaatcacttgaacccgggaggcagaggttgcagtgagctgagattgtaccactgcactccagcctaggcgacagaacgagactctgtctcaaaataaaaaaaaaaaaaaagatgaatttattacatcttaggcgcttcacagcacccgtctcccatgactcttgtttgattgtggccacagattgtccccttctctcactcctttcctctgtcctcatctcccattcccttcccagcgtcccctgcacttcacgctggtggcctcagtcctgtgcacttgctgctccctcttcctggaaacctcttctgccttcttccccctcccacctggccatccacaaggctcactccctcctcacccctttcaagactctgctcaaatgctcccttctcaggaaggctgtccatgccctcctttgaatgaatataacttcccccatatgcgtccttctttaccctaaccctgttgtcctttcctttcctttcttctcctctcctctcctttctctctttctctgtttctctttctctctttctttctctttctctttctttttctttctttctttttttttttttttgagacagggtctccctctgttgcccaggctggagtgcagtggtgcgatatcagctcactgcaacctccacctcccgggttcaagcgattctcctgcctcagcctcctgagtagctggggttacaggcgtgtgccaccacacccagctaattttttgtatttttagtggagacggggtttcaccatattggtcaggctggtctcgaactcccgacctcaggtgatccgcccgccttggcctcccaaagtgctgggattacaggcgtaagccaccacacccagccaatcagggctctttgaattccttcactgatttatccccagtgcccggaacagaattggtgctctgtaaatatttattgaatgaatgacattgaacaaacagttgcattgaacaaaatctcctctatgcctggcctggtgttgggtggtgcaggagacacaacagtgaccacgatggttccagtcctgtcctgctggggctcccagtcctaaataatgaaggcagttccagggctcagtcctcactggggctcctggagaggagacagatccatccccaggcaccgatgacccagtgtggtcagagctggggcggggtagctggggcaggcagagagggcttctttggaggagagggcatctgaggggaaatgtcagtgttgaacccagtgtagacagtgtgctaactcaattagaggctgaggatgtggctgagatcagaggtggtgtgggctgtgtccgggaatctgtgctttgtccctagggcactggggagccatgaaaaagttcggagcagggaaaggagataattagactcaagctaccttttggagggtggattcaaggcaggagagtctaggagcctggagaccaggcaaaaggcttggaggttcctggatcaggacaggccttggggagggagaggagaaaggagagcgcgggtttcagagcgattttggatgtcagatggaactttctcagggggaggctgccagggtggaggcggggcaggaagctgggcaggcagggaggccaagaaggttctagggggtggaggagcctgaggtgttggtttaaggagcagcgagagtgggtgagtcagagcccccacccccaccccaggaatcctccttcggagggagcggcccactgtggaccaggctgccactcctggaaccttcggaattcaccttgcgctcctctgcccaggcggctctgcagtgtctctctctctctttttctgtctctatgtcagtctcctttctacctctctctcagtctctttcttctccatttttactttttcttttattctaactccctttccttttctttctcgctctgcctcctcctgtctctccatctctcccccgctccgccgccgccctctctctgtcttcctcctggtcttgcttagactcccccaggttcgttcccgcgggtcccttggcgggagctggagcacaaggcccagggacagaggggtgggtccgggccagacacctggtgcccccgccgggctgggggcggctccggaaacccagacaaaccccggagtcagggacccagccccggcccagcccgccctctcaccttatctcttcctggcaccttcccctgcttcctctctggaaaagccatcagcgccctcccgcctaccctcctttggtccctacggagccgcccttcggccctgccccctggctccattggcccgctctcacaggccccgcccccagcccggccacacccctgccctgattggtccttcagaccattaggcactccctccccctcttcctgcaggttcatccatggctccccagtgccgttcaggacacaggagcatgggatttagggtccgctgtgaccaaggctcactgcccctcctttgccccgtgtcgcacccccacccctgctcctcacatatgagtccgccacacttggtcgtcaccaacaatagccatactgttaacctcccctcatgctctcctccaaagataccaggccttcctggactctctgggaggaggcattcaccctcctcccagtgcctcagtttcccatctgtacgatggagggtgtggacgaatcctctggctctaagtcctttggctgaagtgatagctgttagaaggggagattttatgatgctgtgatacgtaaggccaagatcttgggagggtctgattctatagacgccaagatgccctgaaccttcagaccacattctctgcagtggcccagtgacattcattcagcagttgccgatcgcatgtggtactcctctaggctctggggatacagcagggaacacagataaattccttttctcatagaattactttttagtggggaagcaaacattaaacaaatcaatggttatgaagaaaaatgaagcggaggaaagaggggctggcgagggactattttagagcgctctgaaggagaggaaggggtaagaggaaggggtgagccgagtggcgatcgggtggaagagcagtccatgcagtgagaacagcatgtgcaaaggccctggggcagccatgcacttgatgtgtttgaactgagagcctaacggggctggagacagggtggtggtggaaggtggaagagatgaagatttagaaccagtcagggaccaccaacgttctcagcagtctaaatttgtgattctttaaaaaaaaaaaaatatatatatatatatatatatacatatatatataatttttttttttttagatggagtctctctctatcacccaggctggagagcagtggcatgatctcggctcactgcaacctctgcctcccaggttaaagtgattcttgtgcctcagctttccgagtagctgggactccaggcaggtgccaccacacctggctaatttttgtatttttagtagagatgggttctcaccatgttggccaggctggtctcgaactcctgacctcaggtgatccgctggcctcggcctcccgaagtgttgggattacaggcatgagccactgtgcctggcctaaaagaattttttaactagtcttttttattgaacatttaagaccatctcatggaaaggcattcatactttatcagacatgattctcccacacctcaccccaccagctcccagggcctcttttctagaggcaacccccataagtagtttcttgtgtgtctttccagatatactgcattttttttttttttttttttgagacggagtctcgctctgtcgcctaggctggagtgcagtggcatgatctcggctcactgcaagctccgcctcccgggttcacgccattctcctgcctcagcctcccgagtagctgggactacaggtgcctgccaccacgcctggctaattttttgtatttttagtagaggcggggtttcactgtgttagccaggatggtctcgatctcctgacctcatgatccgcctgcctctgcctcccaaagtgctgggattacaggcgtgatatactgtaatcacgcccggccaatatactgcattttgtaaaagcatttatttattattattttgttttgagactgagtctcactctgtcgcccaggctggtgcaatggcacggtctcagctcactgcaacctccacctcccaggttcaagtgattctcctgcctcagcttcccatgtagcttggattataggtgggcaccatcagcccggctaatttttgtatttttagtagagatagcatttcaccatgttgtccaggctggtctctaactcctgacctcaggtgatcgacccgcttcagcctcccaaagtgctgggattacaggcgtgagccaccgcgcctggcctatttattcatttttttagagacaaaggctcgctgtgtcgcccagactggagtgcagtggcgacatcatagctcacttcagtctcaaacctctgggctcaagtgatcctccctcctcagccccggcaattcactgggactataggcgcgcgccagtacacccaactagttttaaaatttttttttagagaccaagtcttgctatgttgcccaggctggtctcgaacttctggcctcaagtgatcctccccccttggcttcccaaagtgctgggattataggcatgagcaatatttaatttgtgagcttcctataaaatatagacataccaatattcattattctgctctccttgtttatttttcgataatttataagattgtggaccaggtgtggtggctcacacctgtaatcccagcactttgggggaccaatgtgggcggatcatctgagatcaggagttcaagaccagcctgaccaacatggagaaatcccatctctactaaaaatataaaattagctgggcatggtggtgcatgcctgtgatcccagctactcaggaggctgaggcaggagaatcgcttgaacccaggaggcagaggttgcagtgagacaagatcgcaccactgcactccagcctgggcaacagagtgaaaccccatctcaaaaaaaaaataaaaaataaaaaataaaaagattgtgtttcaaaggttctcaagttcattggtttattccacaaatatttcctgagtgttttctgtacagattgtactggtgctggagatggagggaacagacaagtttccagcccttctggggctcctttttttttttttgagacagtgtcttgctctgtcacccaggctggagtgcagtggtatgatcatggctcactgtagccttgacctccccggcttcagtgatcctcccatctcagcctcttgagaagagaagattaataaatcaagacattaggccaggcgcggtggttcatgcctataatctcagcactttggaagactgaggcgggcggatcacaaggtcaagagatcgagaccatcctggccaacatggtggaacccagtctctactaaaaatacaaaaattatcatggtggcgggcgcctgtagtcccagctacttgggaggctgaggcaggagaatggcgtgaacccgggaggtggagcttgcagtgagccgagattgagccactgcactccagcctgggcggcagagtgagactctgtctcaaaaaataaataaataaataaataaataaagtcattatttgcaccactgcactccagtctgggtgacagagcaagactctgtctcaaaaaaaaaaaaaaaaaaaaaaaatccactgtccatttgggagaaaaaaagagtgaagaaagcaaaaagcgaataacgtcttagtattgttcttaaaataattttgaccacaggaacccccgaaaggatcttgaggacccctgggtttccctggaccacacttcgtgaattgctgctgtagggctttgtcggcttcggtagaaattttgaacttcaataagcaaatagagagttatgagcagcatcccctgggctcatgttccttcctgaaaaatgccctcttgggccactgctgcatggagcaagggttattggggcaggatggggagctgggagacctgtcgggccaccttgggtgtctccccaggcaagagaggatgacgctcgaatggacatggtggccactgaggtggagagaaatgagaagcaggggagaggctgggcgtagtagcgggtgcctgtagtcccagctactcaggaggctgaggtgggaggatggattgagctgggaaggtggaggttgcactgagccgagattgtgccactgcactccagcctgggggacagagccagaccctgtctaaaaaaagcaaaaaagaaaaggaaagtaggggagagagggagagacataggaggaggcaaaagggactcattgataggttggatgtggctacttaacaggaggaagaatcaaatatcaaatcaataatgatttcaagagctgggtaccgtggctcccgcctgtaatccagcactttgggaggctgaggcaggcagatcatttgaggtcaggagtttgagaccagcctggccaacatggtgaaaacccctctctactaaaaatacaaaaattagtggtggcgggcacctgtaatcccagctactcgagaggtagaggcaggaggattgcttgaacccaggaagtggaggttgcagtgagccaagatcatgccattgcactccaccctgggcaacagagtgagactccctttcaaaaagaaaaaaaaagtgatttctagagccggacggggtggctcccgcctgtcatcccagcactttgggaggccgaggcgggtggatctcttgaggtcaggggttcgagaccagtctggccaacatggtgaaagccagtctctactaaacatacaaaaattgaccaggcatggtggcacgtgcctgtaatcccagctactcgggaggccagggcaggaggattgcttgaacccggaggtggaggttgcagtgagacaaggttgcgccactgtcctccagcctgggtgacagagtgagtgagactccgtctcaaaataaataaataaataaaaataaaatttctagatttctggcctcaactgggaaggcagggctggggatgcccttttcagagatgggcacagctgagggcgacacagctctgagggctaggctcaaattccacttagggcatcctggtatggagctatccaggaatgttgacagggcaattagctctgagtcctgagctggagggagaggcttaggctggtatgcagattcgggagtggacctcttggaggggtgtttaaaactgggagggactcagctcacttagttagcagagaggaggagcccagggtgagccccagcaggaggaggccatgaggctcacagtgtggcacctccgcctgcagcacctgtaacttgtcagaaatgcaaattcccatctgggcagtggctcttgcctgtaatcccagctacttgagaggctgaggcgggaggatcccttgagcccaggaatttgaggctgcagtaagttatgatcgcaccactgcactcctggctgggtgatagagcgagaccctgtctccaaaaaaaaaagaaaaaaaagcaggccaggcgcggtggctcatgcctgtaatcccagcactttgggaggccacggcgggtggatcacctgagattaggagttcaagaccagcctggccaacatggagaaaccccgtttctattaaaaatacaaaaaaattagccgggtgtggtggcgcatgcctgttaatcccaactacttgggaggctgaggcagaagaattgcttgaacccaggagttggaggttgcagcgagctgattgcaccactgcactccagcctgggcaacagagcgagactctgtctcgaaaaaaaaaaagactgggcacggtggctcacacctgtaatcccagcactttgggaggccaaggtgggcagatcacgaggtcaggagtttgagaccagcctgaccagcatggtgaaaccccatctttactaaaaatacaaaaattagctgggcatagtggcgcatgcctgtaatcccagctactcaggagcctgagacaggagaattgcttgaagccgggaggcggaggttgcagtgagccgagattgtgctactgcactccagcctcggtgacagagcgagactccgtctcaaagaaaaaaaaagagagagagagagagaaaaagaaataaaagaaatacaaattctcatgccccagcccagaccaagtaaatcagaatctctgggagtggggcctgcagcctgtgttttaacaagctccctggtggaccctgatgcaggctgaggtgagaacccttcccacaggttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggtgggaagctgcccaggagggaatgttgggggtgggtgatgggaaggttggtttctggaagctctgagatgggacctcaaaagccagagggatggatggcaggttctggaaagcgcctccctcaaatagttccgtgggagcatggttttatgagtcaggctaggggagtgaagagaaaacccaaaataacagtggctaaattaagatagagagtttttctttctttcctccataaaaagtcccagaaagtgatccaggactggtttggtgctttacagagccagggatctagtccccttctgtcttatttctcttccatgcctggcctccaggcccaaggaacttcatggtacaaaagggctgtgaaggctccagccattgtgtctgcgttccagccagcaagaagttgggaagggggccaggcatggtggctcacgcctgtaatcccagcactttgggaggccgaggcgggcggatcacgaggtcagcagatcaagaccatcctggctaacacggtgaaaccccgtctctactaaaaatacaaaaaattagctgggtgtggtggtgggcgcctgtagtcccagctactcgggaggctgaggcaggagaatggtgtgaacccgggaggcggagcttgcactgagccaagatagcgccactttactccggcctaggcaaaaagagcgagactccgtctcaaaaaaaaaaaaaaaaagaaaaggaagttgggaaggggaagaaaagagtagtctctttaagaacactgtttattttattttcatttatttatttgagacttaaatatttatatttgtaaaatataaatatttaaaatatacacagctgggtgcagtggctcatgcctgtaatcccagcactgtgggaggccaaggcgggtggatcacctgaggtcaggagttcgagaccagcctggccaacatggtgaaaccccgtctgtactaaaaatacaaaaattagctgggcatggtgttgcgtgcctgtagtcccagctactggggaggccgaggcaggagaatcccttgaacccgggaggcagaggttgcagtgagctgagatcacaccactgcaatccagcctgtgtgaccgagtaagattctgtctcaataaataaataaataaaataaaatatatacgtttaaaaatttatttatatattttttagagatttatttatatatttttcagagactctgttgtccaggctggagtgcaatggggtgatcatagctcactgtgtacttgaactcctgggctcaaaggtccttctgcctagcctctagagtagctgggactacaggcacatgccaccatgcctggctagcttttttttttttttttttttttgagacagagtctcactctgtcacccagaccgaactgcagaggcgtgatcttggctcactgcaacctctgcctcctgggttcaagcagttatctcacctcagcctcccaagtagctgggcctgcaggcatgtgccaccacgtacagataatttttcatacttttagtagagatggggttttgtcatgttggccaggctggtctcgaactcctggcctcaagtgatcctcctgccttggcctcccaaagtgctgggattataggcaggagccaccatgcctgaccaagaacactttctagaacagagctgtccagcagtacgttctacaatgatggaaatgtttcattctgcactgtccagtatggtagccactagccacattcaaatggaatgttaacgtgtatttcttttttctttttttttgagatggagtcttgctctgttgcccaggttggaatgcagtggcaagatcttgactcactacaacctctgcctcccgggttcaagcaattatcctgcctcagcctcccaagtagctgagattacaggcatccgccaccacgcccagctaattttgtatttttggtagagatggggtttcaccatgttgtccaggctggtctcaaactcctgacttcaggtgatcctcctgccttagcctcccaaagtgctgggattgcaggcatgagccactgcgcccggcctgtatttcattttaattaatgtaaataagcacatgtggctagtggctgccatactggacaggctaacagtagaagctgcacatgcaacctgtgcttgcctcagtggacttgaacttagtcatactctggctgccagggaatccaggttgcaacctaggatccccaacccttcagagtcgtgatcagctggcctctctgccttggctcaggaaattcacatagggctgtgaaaggaatccattttcgcagagactgtcctggtgcagtctgggccacttagagtagcccgtgtgagaagcagtgtgacgccaagtccacccctacaccccaaagtgacttcttcggtggggagggggtggtcccaggaacccctgatgatctgatcatctcaaatctcacctccaaatttggcagccagccactcagtcctttctgtgtggtgtggtagcactgtgacaggaattaagctttcttaactttcttttttctctccccccctgcacacttttttgttttgagacagggtcttgctctgtcacccaggctggagtacagtgtggtgctatcttcgctcactgcaacctctgtctcctggggttcaagagattctgtctcagcctcccaaagtagttgggactgcaggcgtgcaccaccacacctggctaatttttaatttttttttttttttttttttttttttaagaaatagggttttgaggccaggtgcagtggctcatgcctgtaatcccagcactttgggaggccgaggtgggcagattgcctgaggtcaggagttcgagaccagcctggccaacatggcgaaaccccatctctactaaaaatatgaaaatcagctgggcatggtggtaggcgcctgtaatcccagctacttgggagtctgagccaggagaatcgcttgaacccatgagacggaggttgcggtgagctgagatcgcgccattgcactccagcctgggtgacagagcgaaactcgtcaaaaaaaaaaaaaaaaaaaggaaagaaaagaaaagaaatagggttttgccatgttgtccaggctggtcttgcactcctgggctcaagtgattctcccacctcagcctcccaaagtgctgggattacaagtgtgagccacccaagcctgctgagtttttttttttttaacttttaatgttgtacgtgctggctgggcagctggagttgggtagagggcggttagggttctaggctggtgtggatgctctgagaaagctatacttgatgcgaaaatattgaaatccttctctgctagctggcaaagggccgctgctctcactcatcagaggggccccagcctccccaccctccagtaattctggggcacaggagaaagcctctgggaccttgttgcccaagtatcttctcattggtgggtgcccgagcggaacaggttgttcagatgttcaaatacttctgcatgtgtcagtaaagagctgccactctggctgggtacagtggctcacacctgcaatcccagcactttaggaggttgcggtgggaggatggcttgagctcaggagttcgagaccagcctgggcaacatagcaagacttggtctctacaaaaaatttttaaaactagttgggcgtagtggcgcacacctatagtcccagcgaattgcgggggctgaggagggaggatcacaaaaatttagctgggtgggtggtgtgtgcctgtggtcccagctacttgggagactgaggccagaggatcgtttgaggctgggagttggaagctgcagtgagctatgttggcaccactgcactctagcctaagtgacagagcgagaccctgtcaaaaaaaaacaaaacaaaacaaaacaaaaatggctgggcgcggtggctcatgcctgtaatcccagcattgggaggctgaggcgggcgaatcatgaggtcaggagttcgagaccagcctggccaacatggtgaaacgctgtctctattaaaattacaaaaattagctgggcatggtggcgcatgcctgtaatcccagctacttgggaggctgaggcaggagaatcgcttgaaaccggaaggcggacgttgcagtgagccgagattgtgccatttgcactccagcctgggcaacaagagcaagactctgtctcaaaacaaacaacagtaaaaaaaccccacaacagctacccccgagcttctccagtgtcctgataccaccttgcagcctgagggcctcagggatggcgccgcttgaattctgggtgcccctgtcccccaccacaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctcagatgggcccctccgcagccccttcccttgctcggggaaagcccccaattctgcccacacccatttatttccttccttccttccttcttttctttccttccttccttcttttttgtttttgcccccaattctgcccatacccatttctttctttccttccttccttcttttttgtttttgcccccagttctgtccacaccccttccctttcctgtcctgtcctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgccttggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttccc

SEQ ID NO: 36742 - DNA, 3063 bp, Homo sapiens
cgcgggaacgctaacctggtccggagcgagtctgggtctcagccccgcgaacagcctttcacgagtcttcaagctttcaggtgaggacctgcggcctcgcaggagccagaggaccatggggatgggaaggcgtcagggttgcgaggcgggggatgccgcgccttcgggagccagaggagccgaggttggggctggcgcttcgcgtctgcaccgccgcccgggcgagcgagtccgcgcctttgtcttccagggggccgccttctgcgctcgatgccgagccctcctgggggccggtccctggaaacaaggccccggggttgggaggcggggagcgcggacccttaaagggacctgtccgcagtagctgcaggtcggaggcttagaggatgaggagtttggaggccgcccggaatgggccccctggggcttggtcctcattccttctcctcccgtggccgttaggctgggcgccagaaaaagctaatagttatttttaaaagtatgcaaactgctcttgacagactggcctacgcacccggccctgctattatttatttgttagttccagttttccagctctgagcttggcgtctaatggcttggcagaggagggtcttagggtaaactcgacggaatggaggcatgttcggcacttctggctgcttgggggcctctccattctaccccaagcactagacatagtatcttactgcacgagggtggggctgggcttgcgaatgagaactctgccctccgatttctgggatatcctattgtctcttctggacaaactcgggacgcttacagggcaccaggcatttcgtcaggtccacagccatgcacctctaagcctcatctctttacctctctctttgcagagaaaacatggtgaaacaagactcgcttttatttggtttatcccattctgctgaagtcctgggtttgatcctagttagctgtcccttcttacaacgtttatacaccaatgccacaaggagctattatgagacgtgtattgtaatgccttaatgtactgtcatctttgggcatttaaaatagaaagaaattagtacaacttatgccactctttttttttttgtgctgctccccgtctcctaaaaaaaaatgccaaaaaacaaaagtaatttaatagaaagtgaagatgctcgaatagtgctatctcctgttacaaaatcattaactggttaaagccagtctttattttttattctgtccctgtctgctcttgtgcttctatcacctccattttacccttgctgtgattttaagagtcagacatattggctctgggtttctggagaatcttggtttctggtgcgttctgatccaacggcatttactgcatatcaaaatgggctaatgatgtggagttaaaattattctaacaaaaatataacttttctaagatctgttgctgtttttctgttgaaaatgagcgggtagaatatacattgatatgaaatatgaaaatttttgcttgtgaccccttagtccgaagacagttctgccaggtaagttttcttaaaaatgtttattcttttcaggctatcttctagtcaagatgagtgataagccagacttgtcggaagtggagaagtttgacaggtcaaaactgaagaaaactaatactgaagaaaaaaatactcttccctcaaaggaaagtaagtcatggggggttctagtggaaacacacagtagagaaagttaataggttcagtaaataaacctatcttctagtaaatttttgccacaaagtaagcaataattagagtaccatggtgtttaatgtaacagttaaaaacatcaaatagtcatcttcctacttgggttatataagtagttctcacataagtcttaataggaatgggggggaaaactagtttcttgttggaaaattactaaaaaccaccttaaaaatcaatcttggaatattggatttagcactagaaaaatcttagttttgttcactttatgcttattagacatttttctgcatccatcagtttgggtcagtggtcttatacctaaagatccatgcaaactttgcagttttggccttctctacctgatgatgagataaagacaatgaacaagtttagatcttgggtgcacgtagggctcacagactcaagggataagtgatcagttttgccctccagaaatacagccttctggagaaactccaagtgtttttgcaaaagttgaggggaactttttgtcttgttagctttgagagttccaaagttagtcaaaattgtctgaaaaggtataacttcctagttgtatatggatagataaatccgaagaaattgcttcgtatctcagtcttgaatcatctaagaaaaaatggcaacagcatgtctctatctcttaaatgggagaaaatcctccacagttatagattgtagtgaatattcaggtagttaacacacacacatacatgcacacaccctaatgtgaggatttgtggttaatgccttggcattctaaatttaaggcatgtatgcagacttcgatgacttagcaaggagctcttttgaaagaaactgaacttaatcttaggtacatacggttaatgatttttgtgtttgtcttcccagctatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcttctcacctatgttccctggctaagaagtcagaggtagccaatgtttccttaaattcatttttaaacttaccattggtgcatatgttccagatggcagatgctgtcaataatctcaccattgatgacctttgtgtatgtagttcttgcatcctatactggataagcctgttttaacctgctatgatgggtgcttccattgcttcataatcttcatgaagttgcatgcttttgcagcttttcacagtttatttgcatttctaatgtagtaataaagtaaccaatataatcatt

SEQ ID NO: 36743 - DNA, 325870 bp, Homo sapiens
agactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggtaaactggagcgggatgtcgccgctccccggacggccgcctccgcacctctccccaaccctccccaccccggtgtcgtctgcgctgggaaccaggctggagccgaggcccctgcagccgcagccggacccttgtcctggccccctgcccaggctcctgcgtgctccgctgagcccgaaggcggccaaagccccccagtgacacccccctctcggcagagccgagagactagggcagagaaggaagggtcgtggtgtcaccacctggtcgcccaccttgtgggctgggaagggcgtcccagtgcgccccgcctcggtcttccccgggggagcagtgggcgagcggcgctgaaatctgcacccctctgggccaccggctgactgcccctggaggagggggaaagctgcagagggaggggaaaggatgctgtttgattacatttcgagctgtctgcaaagctcttagatgctgtcactaccctgcaagtcggagggagcgaattcacttccagcagggcattaattaaacacttcaaagcgagaagatgccagtttctctctgctgcgaaaaagtgtggctgggggatgttgttttggtaaacaccttcacggccgcctggctctccttcccccgctcccattcggaatcgctctggccttataaatccgtgcgtcgtcatcataagggcagtgatcctggcagcgctgatgggaactgagtgtgcgggagtctcatgacttgtaccttggctaataagattaaacagaagcccaggatcaggacaggaaattacataggagatcagagactcaacaacatgcagaagatggaatatattcgctattctggcctctactaatcctaggtaaggggcaggaacaagtagccagccattttcttgcttggaatgcctttcaagtgggcattgtagacttattgtagttcagagttgtgaagaattgcttccaaatattccagattagcaaaaagtatagctaacagtaaggcataggcaactgcaggtgacaacccaacgcctgatgttaacacagacatgggtaaccagtctgtgtacatactttaattgtggaaattatagagatatacgttgatcagtgttagtaaatttgaaaagggaatattcagtgcaatttgcaagctgagggtactggtgagaatgtaatactacctctaattatttaaaatgccaagtttgttcaaaaaggtttggtgtggaaaaaggggtcctaactcagctcttttgatcatatttctcaataaaataaaatctgaaacacctgccactgagttaccacatgttctcttcataagaactaactctcgaatatttgtttaggtctgaggatccagtgctccaagacccattcctcttaaaacctctagcaccatccttgggaagtttttagaatacagttgggggtcgaatgcaggcttttccagcctgtcaagctcttagccctgtttctggcccacagcatctcagcattttactttgtcttccttgtctcaggcctcagatacaaatgcacttgcttcctccttctttggacctctgagatgctgcagccgctggtgcacagtcccctggaggaggaggggctggcttgcagtccttccccacccccagcctttcctccctctttgctattgaaaacatgcatgattgttttactgttaaagctttaggtaaatcaccagtagggatatgagcagagaaaataaactcgacccgcaggaaaaggggcagagttcttaaagtagtggtccatggtcttcagtttctgactaacttcgaagagagtaagaagtcacttggcatttcagtcaccatgttttatatctcagagaaggctctagggtctttcttcccaatccctctgcttccaaaaatactccttcccgagtctacgtttaataaatgagccttgcctttgatgacagtgctgagtcaaggatccagcctgggtgctgctctgtccataaaaacagcgatgtagaccagtcttgtaaaatgcatgccaaatctgaaatctaggtacccctcttagtacagacagtgtgcaccggcttcatcctgttaccgttttctccagtttctttgttgtttaacgtagcatcaaatgaaaaggtcacatgcatctgtttcaaaatctgtttcaaacaaatatattccttcattactttattctccctacacttgaaacaaagattgataacagtagctaaaatatattgagcactttaccaggcattgcattttaaaatactttcacaggtgttaacttatttaaacatcacaaaaatcttatgaggcagatattgtttgtaatcctgttttacagatgaggaaactaagacacaaaggtgtcaagtaacttttgctcagctactaagttgagcaaggcagcatttgaatcaaggcctgactccaggccaggagttttaacctctctcttccgtactatgaaacaattacactggttaattttcatatattgaataccaagctcttctcttatctcattttaattcttatattaatcctatgaagtagacattattatccatattttccaaataattaaatgagttaaatgacatactcaacatcatttaataaatggcagaggtaggattcaaatgagatctctccaaagactctaaaactaggacccatccattttggctattgtgctgtgtgagagacaaaaaagcgagtgtatgtctgtatctttcaggtttgctctccaatttcagtgtgatccattgttattttcttaaagccacaagtatagccgcactttttgccagttgattggtaactgtgaataatatatgcacactcaaagtagacccatggccccttaaaataaattatggcattgtttttgtctccttaatgaaagtagctgttatactttgtggatctcaaatgctgtgtaaatagttgctaccttaatcagggatctcttttactagaaatctttgtggcttctgcatcccctagagcatgtgagaacatatattctcctgggaactgtgctggaactaggaacttctagagttgacttttttgttttgagagttaactcaaattaattcaactctcatttttcttctttgcaatgtataaacccttgacgaggtccatgtaaaagttattcctcttgactgggcacagtagcttacacctgtaatctcagcactttgggaagccaaggcagaccaatcacttgaggccaggagttagagaccaggctggaggctcgtgcctgtaatcccaggctactcgggaggctgagacaggacaatcacttgagcccaggaggcagaggttgcagtgagacgagattgcaccactgcagtccagcctgggcgacagagcaaggccctgtcttaaaaaagaaaaaaattattcctcttgacagagacttttcatcaatatcctggacttgtgttccttgattcctctctgagtgaggcctggccccagaatctcagagtgaagtttccatcgtaacatagatacctctgcctaggtgctaatcctcatgagctcacatattcataaaacatccttgattctttgttggaggaaccttcttaaacaaaaacccatagatactgtaaaagggaggcatacgaatggttttcagatggtcattgaacccactaaaattgaggcaaattttcatgcatttgtgcataaatgtagttttctagggaaaaaatggggatattgctaactaaaaatacaggaagaatcactggtttacatatgctgtttaaaaaaggggagaggagcagaggtcactctgctgaaatgtatcgaagacaaagccaagctatcctaccagtggcagccaaaaataaaatgttcttggctatcaggacatttttgtggcatttcaccaggagtccaggtggcaggtatagcaaacatcaactgacactgagtcaggcctgcaactgagtcaggcctccaggcgtggcaggcagtcctagcttggcttgtcattcattgagaatctcccctgtgcataatcagtgctttatagatgtgttagttcattgaatcatcccaacatccctgtaaggtggacatttttctctttctttgacaaacaaggagatgcttggagggattaagtcacttggtcaaggccatatggagccagatagtggaagggctggatttgaaatgcaggtgggcctgattccaaagtctgtttcttctcttcctaccatagctcatagtttctctgcctgtgtgggacaccaaaaaaagtattgtttagtgtagctttttattgtggcaggactaagagtccctcaagaaatatgttcacacactgataggaaaagcctaaaatattatcaaaggaacaacaacaagttgtatgtctcccagagtggcagaagaaaagcaagccctgctttaacttaaggtgagttgaaactccacacttttgcttcccccatcgccaggtgtcttgccgagtaccaaatgcacagcagcccccacctaacacagcctgaaaactatcttgcaggggtaactgtaaatcaaaactttattcactgcaaagatgaatttactttaaggctgttctgtcctctgaggcttccctgatacagcagctgtgtcatgatccggaacactgacttgcttctaaatcctgggaggggcactacttaccagatgacttacgtgctctttagttttcagttcatactggtcttgaaatcctctttagcagctgttcttgcttccaaattattatttaagcgctaacagttttccgcttacctatattcttgctatgatcgcatagaacaacccactgtttcattttgggggttcagaacagctaatgccatcaatgtggcaaacacacaaagcagaaatttcggtcagagttgagggtattcataataaaaataatgaatctcaagcactatagaggacgattgtacttgatcaacagacctgcctggtaaccgttccagtgtgcttcattatgctttaactcagtgctcttccaacatttttttttctcttttataatccctcaagaattttttaaaaattctgcagctccatcacctccacacatttaaggttacatctaatgcttttcatcataaatttatagaatcacaattaatgtgattttcagaatgttgtaaactttgacagttaaaaataaaaccgtgacatcattctttgaatccaattaaaatctaaataccaacttcaatttaaaatgtatgtgaagaagctcttttcacaaagggatgtttttatatcttgcagttaagcaccacagtaaaatttgggatttcttggggttttgtttgtttgtttagtttatatttgtctttaaccttatatggcagaaggcattttgtgaaaatggagatggaaaaaggggccccgaataattctacaaccacaggcacattctccggtagatagttttaggaaaacatacaggcaaaagctgcggatctggaaattaatgccattaacttttcccttgcctgcaggctctttagaaagccactgtggaggccaggggtatgcaaatgccagtttgaagattgcacatttatctagcacaggtgctgtgtgttatgggtcagtgtggcacagctactggcagtcaggcccattgccttttgtgtatgggactcaaattagaggtgagtagggccagaaggagctgcacagaggctggtcccattttctgctctcaagtagtggtgactgggaatagctgtcttttatctttcttctatttaatgattttcagtacaagatgggctaattccagtgctttcttttctttttagttttatttatttatttatttatttatttacaaacagggtcttactctgttgcttaggctggagagcagtggcatgatcataactcactgcaactccaactcctgggctcaagcagttctcccaactcatccttccaagtaactgggactacaggcatgtcccaccacaccagctggttaaaaaattttttttttcatagggatggagtcttgctgtgttgcccaggctggtcttgaacttgtggcttccagcagtccttctgcctcagcctcctaagtgttgggattacaggtgtgagccattgcacctgaccccagcaagtttttagatcagttgttcttagccaggagcaattgtcttctccaggggacatttgacaatgtctggagacattttttattatctcaattggggaaaagggctggcatctagtgggtagaggttgggactgctgctgaacatgccacaaagcacaagacagcttccacaacaaagaattatctgacccaaaatgtcaatgatgccgaaattatgaaactctgctttagaagttctagttttctcattgaaatcttccctgtttaaataatttaagtcaatttttttgtctttacaagatagtaaaaagcacaacatctaagagcatctaggaggcatgataaagtaatgagaagaagagatcagatatcccacttactgactgtgtgagcctcagtttcttcgtctgtaaaatggggaaaatgatgcctggcttgcaaagttattgtgaggattgcagacaatcagtgtacaggccccagtcatggtacatgctaaataccataattctttttacgatcaaacagcaattatgtcactctctagtttatctgggatgtgtgtgatcttgccttcctttgaaccaaaggtatgctttgtttttttataacaaaaaattgtcttgatttgaatttactcattgacgttcgtatttctcctagactttaggctccttcagacatcattgtgtcttccagcagagaaccttactcatggtgaatactcaacaagcttttgttgacctgaaatattagccagaataaatcctacttaattttccttttcttataagactgagttctttttccccttggagcattttaatgtgtttagtaaaaacattcacttcctgaaatgtagcgcccattttgtgtctgtgcccaagatgaatgtgtgcttggtaatacctagaatcctggaagtcttgctttcctgaatcaggatcatgcagagcatttctgctgggggaaggggagtcttgaggaggacaatatttcattgaagaaatgacgggcagcatggtttgaatctggtgttttcctttttgaaccccttaggctaatccttttcgtctggctttggtctgacactgtccgatgagcagtccagtacattggcttctttctggtagaagggacattttgattccttaccaggtttatattttattctaatgtccaaagtgaagcgaagtaatgagtatattttcattgaataaatgaaatattcattcattctaatgaataaatgatgacacaatgttatacatcctttgcctacaatcacttaatcacttcccccactttttttttttccttttgagacggagtctctgtcgcccaggctggagtgcagtggcatgatcttggctcactgcaagctctgcctccagggttcatgctattctcctgcctcagcctcccgagtagctgggactacaggcgcccaccaccacacccggctaatttttttttttttttttgtatttttagtagagacggggtttcaccatgttagccaggatggtctcgatctcctgacctcgtgatccgcctgcctcagcctcccaaagtgctgggattacaggtgtgagccaccacgcccggcctcactttcccttttagaatacatgctagattgtttactctgacctgaaatagtacccatttctttgtcaagatgaagacttcactaattgtaatggaaagaagtcctctctttctgaatgcagttttagatcctacagcacaccatgtggaagtctttaaatgtttatcaagttgttgaatgttaaaatgagcctgagtgcaggggatgaccctgagactctgtctcagaaccaacttgtggaatgtcagttggtgggtttggatgatggaaaaggaagcaggccctgtggggaatgtgtgttttgacacaatgttcccttttaaaacgaccgtgcgtctactgtttcaccatctgcccgttagtatcaatatagcaagaggttgtgggaattggtgtgtattttgtggaagaaagaataacaacaacaaaaaaaaaaaccttctctgccggcttccttgaaaagtgtgactttgttcactttcagaaggtataggttacagctgatttggaaagaggatcctccctctttgaatgccttcaggctcagaggaaaatgagaatctatttgggtaagttaaaaatgccaaactaaatctcccaatgcaaatatggaccacccagggacactgtaaaaggccagatttggggttttgaatatttacacattttcttgcctcctattttaagctttttaatatttgtcaaatgctgctgaaaagtaattggcatatcaagcaagggtgaaatcccatatcttatgccagagaatttaaagccaggggaactgtgctcattttccttgagtatcccttgtttttaaaaatgaagaaatgtgagttcaaaaaattctaagacaataaattagagaccttaaagtagatagaaaagttggttacaaaactattgtcgaggaggaggaagatatactatctttgagtgctccctttccctggtatagtctgccctgactgagccatttttctcagtaaattgggcaaaagttcatttttgacgatgggtcagggtactggaaacatcaccctataacactgtcaacaccaccgctaccttcccaaatgctggaaaggcagatctgggcagcacatggaaaaagtgttttctaaacttcctggaggaaaatacagaaagttgctttaaccagggcacatgctctggagactgtgtggttaataatgacatttagtactttcttattctttacaccctcctcacggggcattccatagcactttaagatggggatggtaaaggaggggtgcttgaagatgtcaacgctgtcagggaaggtgaaaagtaaccagaattccgactcattggagtgaatttgatcaggctaggctgtgtcatgatgcaacaaaaaataactgccaacctcagtggaccaacacaacaaaaaaattttcttggccacgttacatgtccagtgtgggtcaacaagggtctgtgttcaccatgttcactcagaggcccatgctgcatgaggcttcctcttgatatatacttttacaatccctgtggtaaattgcatactgcatattaaacctcctggaagtgacatatgacacctctactcatgtttcatgagccaaaagcagttgtgtggccattcctgactacagtggcatccttaagtgtagtcctatgggaagggaactggaattttcgtaataaactcaaatgactatggaagggaaggacttccatgaagtctgcctattcctgctaataactacagtctctatggggcacccctagggacactgactgatatgtaaccacatatgtagtggtttcagccaccaactctacaagttaattgggagagttccctgagccatttgtgggacttgcaatagaggtgttgctcatttgctcagccactgcatgctcaaaccctgtatgggatggggagcatgcagacaggcaggtgcaggagccagaatgagcacttttgggccccagccccatggtagcatcgagggatgcattgtaattaatgctcttttagcagttattgtccgtagatggctaagtattaaaccagcttgtgcagagataaggtgacagccttttaaccctgtcctcttggtacctgcatacttgtccggcatccaggaagaatcaggtcacacatggacttgaaggatggtgaacatagtggttttattgagtggtggaggttgctctcagtgggatgaatggggagctggaaaggggatggagtgggaagatgatctgcccctggagttcagccatcctgtggccagtcagctctctgaccttccccagccgaactcctctcgatgttcagatgtcccttctcttctatccttctctggtgctcctctctgccactctgccactcttctgctcatggagcctgaggtttggggtttttgtgggtacaggatgggggcatggcagaccagagtggttttagaaaaggcgacatttgggcatgaaaacagaaatgcctgttcccatttagggccgttggtttccaggcttgagggtggagcgtttgctgggaaccaccctcttctacccagtatttccttgcctcctgtccatatcactaacacctgaatgaatgcccattaaaatataaaatgcatttgcatgattttagcatcataaggaataacaggttcccagaaaactgagcttacaaatataaattttactgataatgaataaaagaaatacatatggggtgcaaattagcttccttccgtagttgttcaattctagtcaagaatattcatttagaacttatggaatgccagccatgagtgagactgagtgcttggtgggcacatgaaaatgaaaaagttacagatcgtaggggccaatgtctaatagagggaaaatagaataatttattacctacaatgtggttatatgttatcagatatcaaatgattatcacatatgttaaaatgggataaatgcctcagagatataacaaagtacaatgtggattcaaagaagggtagtgattaataattaagtgaataatcacttctttcaatttgcagactgaccagacatcagtgttacacagacaaaaacatttcaattaatgttttaccttcatcctcctcttttgtttttggacctgatttgataacagaaaaaatgtgattatgattaagaggtagtataaaagcatgacctctggaaataagattcgaagctgagtttcaccatttactagctatgcaatcttgacaagttaactttgcttgcctgtacctaattttcttcatctgtaaaacaggattcataataatagtatctacttcctagtgttgtgctgtggtttgaaagaataaatcccacttaattttccatttcttacaggatttaattttttccccttggatcattttgaaatgcttagtacaaacattgacttcctgaaatgtaccacgtcttgtgtgtctgggccccaaatggatgtgggcttagtaattcctgggattctggaagacttcccttcctgaattaggatcgtgggagtgtttcagggtcagatgttcagtcagtattttccctggtctagagagctctagagtgtcaatctggcttctattctgatagatctggtaattcaggtctatcgggggtacatttcctaactcccctgttcccaccccagcacttcaaagtcatgttaaattaaattaaaatttaatgtggtataaatgaattgtgactgaatcatggaggcattctgcttgtttgattccagaatgttaaaatgtccatgtgcttggggccagtgccgtagcaaaggactgacgagctagagtctgggtacgatggaggggagtccgtgaagctcatcttggtagatgctcaccttctctcccctctgttttttctttgcctctcccacccactccttgaatgcaaagtgggggcaacttgaggtgatgctgcagagcttgtgggctgtaaactggtgaaggggtgggcatgaagactctgtctttggcaaatagttatgaggacacttacctgctgtagcccaaacttgttgtgaaaaacagagttaatatccatgtaatagagaacctttgattggttcaagctgttcaaaaaatgggctgggctgtctgtgaggtagggagttcccaatgcctagggaagttcaagcatgtcacctcctgtgaacattgtctgtaaacagacttatcagtgagaggtcagagaagctctggtaatttctacataattttcctcaaaatttaagaatctctgatcctttgtaatgagacagaactttgtattattctttcttttggccaggttctgccattcacttggggccagcataaacaagggggcaggtgccaaattgggaaaatgtaacaacttttgcctatttcctttcccatgggactgtttaaattgtaacattcattcatttgtgccttcaaaaaacatttataaattcctcctgccagacaatgggaatgctatagtaacttcagggagtttaacagcctgtgacagccattaaaaacaaataagaggtctggagcagtggctcatgcctgtaatcccaggctgaggcaggtagattgcttgagttcaggagttcgagaccagcctggacaacatggtaaaaccccgtctctaccaaaaaatacaaaaaattagccaggcatggtggtgcgcatctgtggtcccagctacttaggaggctgaggtgggatgatcacttgagtctggaaggcggaggttgcagtgagccaagattgcgccattgcactccagcctgggcgacacagtgagactctatctcaaacaaacaaacaaacaagcaaaaaccaagaaatgttgctaacttaattccaacttgaccaagccaccatgcatttaatggctcattctttcaccaaatcctttattcattcattcactcagtaatctcctaatgtactctgacggtttttataatctgatcctccttcccaaaaacagagagtagacaaatatgccatttcaaaggtatgtgccagaaacccccaataccatatacatatatattgtatataattaacaaaatctatgccttcattgcaactttatatatatacactgttgtatatatatgtgtgtgtatgtatatatatatgtgtgtatgtatatatatgtgtgtatgtgtatatatatatatatatatatatatatatatatatatatatattatatataacagtatgaggaacagaaaatggagagattactaggggtatggagttctcaccctgaatgcatatcttatgcaaagaatgtatgtattgcaaatgctaaggtatctattttgaacacttaatttctcactcattctatacagcaaaagtgtgatatgtaagaaaagtgttaattccagtagtttgccttgattagcacatttgaatagactgaattggtttaacatggaaattcttgatattttttcaagactcttacatgttctaaaaataaataactttcttctgaagcagggcaggaccaaagggcagaaaaaaatagccctgggtcagttatgtcctgagagtgtggcaccaaacattcccctttccaacttgttccccattgcgccctgccacctcaaacccatttgaccatatgctacagtcccattgaactgtgctattccccaaacatcggccacttccataggaaatgatccccagttcgcatcctactcgcatgtcaatgtctggctctcactgctcctcctttaggaagccccctctgtgctccagctcttgcaagcactctttagtacgttatacctttgtcatgcatgtatcccatttcacctgcaatgttgttagtgttttcagaccctcccatattacatgctttttgagacagactctatgttgatcatttgtgtaagtcccacagtacccagaacagcactgtgtgctttgtaggggctcagtaaaaagactcattataccgaattaacataaagataaatttagcatcgtggagccaactacttaggcttcctgactcttagcaaattaaaaattttggttgattagtgtgcttctccctgctttagaaacatatggaggaccttgctcagaaacccaaggtagtctcccatttccttccatcaaggtaaattatcccatcctccttccccttggccccaccactccattcctgcaaagtgtcacagtgtagcagggactggagcagtggggagaaatgcgctctgatctgctaaaggagtttggggttatgtgactgtatatggacatgtgtgtgggtacacactcgtgctgaaaataacccggtgacactcttgagcatcaacattcttacctgtagtcagctatcatactgcagctgatcaggaccagcagttagctatacagatgggcagaattaaggtctgaatcttacttttgagtgtctagatgttagattgttcttaggtagcccacattctctagcaacttactgatgggtaaacatgcaacccaatgtaagtatatgttatatgttaggtccccaacataaaatgccaacttactaactttgccaagagaaacctaacttcccactggatcacagtgcccttgcttataggtcagtattctgaactctgctgagaacttgagtttctgggcccttggtttgggctaggcatggctgggacaggactagtgtgaggttattaaggataatcttaaaggctgagtctagaggcaacctgggcattgaaaaatcaagctggtggtccaattatgttaatacattcaaaaggactgggaagggaggcagaatctaggtgtggcaataatatggcaattgagggcaccaaaacaaagcaaaagggttgagagggagggtggggaaacagatctaggggaatcctaaaaccaatggagcgttgacactttttatagtacataaggctaggaacagggaaaggagttcactcagacacattttttgcagccatatttattcattcattcaacaaatattatctactctgaccagtcactatcctaagtattgccaatacatcggtgaacaatatggacaaaatctatgccttcattggaggttaacgtctaaaaggagagacaaacaacaaaaaatactgaaatgttaagtctaatatatataatgaagaaaaacttaaggcagcagagaagatggcaatgcagggacagtgggtggggaatagtttgcattttaaatagaatggtcaagtaagacctcaatgagatgaaatttggactaagtcttgaagaagcaagccattcagatatgtaggggaaaatgcgtaacaggcagagggaataggaggtgcaaagaccctgaggtgggtgtgtacctgatgtgtttgaggaacagttagtaggccagaatgtctggggatgagatcaggaaagtgatagggttgtgttgtgtagggccatggaggctattacaaggaatttggcttttactctgaaatgggagccattggagaactttttgcagagaagtgacatgacttgacttgtgttttaatgcattactatagcagctgtgtgggaatgggctgcaagggaggccaaagatagaaatgagaagacccattagggggcttctgcagaaatatggatgacagatgatggtggctttgacagggtgatagcaggggaggtggtgaaaagtggacagatcctggaaatgtttggaaggaagagataatttgctgatagattggatgtgggtttgatggaaagggaaatcagagatggctccaagacttttggcctgagtagctggaagcagttgcctttgaagtggggaagatcaaaagctggatgcacatgaagccagagtccagggaacatttgtcacagctagtgcttccaggtggtgtgctggcgccattgaggtgactctcctaccagacacacaggaagggtgatgtgagttggtcagggcgatgtcagttggtcgggacaccttttcgcggcacacactggggaaaacctgaaaacttcatccccgtttttgtatggtttaagactctgttctccttctattgtaataggttttgcagttgattaccactaattatgtggtggtggagaaatagcttttatgtctccactctgctacttcccaaggctgtgattgggtgggaaaggtataattgcagtaccattcaataaaggaatgttctggaatatggggcaacctgacaggtagaaaaggaggcagatgtattcatgtaaattattacatactttggatattttgtgaccccttagcatgcatggtcttgaaaatttagatataattcttcctccattttaattctttcttccagaattggttttctttaaaagctaatgtatacatgcctgcatcctattttcactcaaagtgacagatggttgaaaccgactctagctacattttttaaaaagtcttgaatttaaaaaaatacacatgagtatcagaagggtttaagccttttagaactggttgagaaatctgctctgaatgctgcttcataccactgagttatccattcgtgtacaaaatgctgtgtgctgggccagggtagggaatttgcagccaagcttttcagatgggtatttgctttctaaaaggaatataaaggttgtgctgatggggcaaatagcaaatatccaaatccaagagcggcatttagcatttgtgttgacatggtctgcagggaatatgtgatggtcctgcatttcaggcagtattgattttctacactcttatctgcatagtaaggtagctggaaaagttgattaatctttcgagaacacccactttgatgtgtttgtactttggagtattgagggacttattttatgtttttttctctttaatcgtctggtagatttaaacaaatagagtggagtttgctttggtcattctgtgatacagttttcctgccagtgctctgtgaatacattacaggttccatgtatacccaatgttaatttcttggcagcactcaaggtaatcagagcctggtaagtctcctgtggtagtgaacacctttctctgttcaccctaacataccttgcaaatgtcatcatgatctgtgggtgtcatgacatgcaaaatgttggctgagaaaggataaaggtagagataaatttagaattaaaaatttttcagtttaagaattgatgtagctcaatatatttcaaaagtttaactgcaagtaacaattataaataatatgtgtatgtaacagtaaatgtatgtatgtgtgtccaaaacaagtttcttaccatgtgcagtacattctaataattctaagctgttacatcacagaaatggctgcctgtgaccactgacttgattttgtaactcaccagtgggttgcaacccatgttttaaaaggctgatgtagagtgaattacacactaggaattaattatcttgtcttgtgcttgctcagatccttctgtgtttcccttctgcgtacagagaagttcagacccccttaaagcatggcatagccaacttttggctatagggtgaccaatttggccaggtttgcctgggactttcctggttctagcactgtacatcctgtgtcctgtgtacctctttatttatgtgcaaactaagatggttgctcactcagtctttggaatctggtctctgactgcctttccatttgcgtcttcctccaccccattttgtactcactgttccatccatatctcattacttgtcccacaaactggtcattcttcttacctcccacctttgtccatgcttccccctctgcctgggagcaccactcacctgtgctttcctcaggtctggtcttcctccattctgatttgttgagtcaacctactttttggaaactttctttcactgctttcttgtgagcaaggtggtaaccacagactacatggacttatggaatctttagtaactctgtgttttcctcagctgttatattctttatcatctgttgaacaaacattagaaggaaaactgctgacataaagtgggtgactatggcgaagaaagaatacaagataagtagaataaatcaatagagatgatatggccaacagagtggggcaagagaagatgcaaaaaaacacaactacaggcttatgcagtggctaagtggctgagagcatgtgctgtggagaatttgggtttgaatcctggatcttcacatgccaaagttgtttgctttggttgtgaggatagagtattaccttagaggcctcttctctgcatgtgcttttccactcatcatgaccccaacagggattggtggtccttaaaattaggtaggcttaattacaaattcatacgtattttgtagtaaatttgagagagaattaagtggtcttaagatgtgaagatattcttaatttatagttttagaagattagaataaattgattttttgtgagcatgtgtaatgctgatctattttaggaaaatctaattttactttattatctgaattaaataatatttaaatttattattgaaattaaaattattccttcattgtgattaatgtatcttgatagaaatttcctttaatatgatagtttaaatttgtgctcacttgggggttgcaaaaacagctggatggcttaaatttgcctgcatcctctatcgagagagagtgcccatttcaggcaggcctactggcccatgttgtcttgatttaactttgttgcacagagaatctggctcctttatcatacagcaggccaaggactcagagtcaaagctaaagctagtcatatctaaagatttgcttgttatcagttattttaaagatcagtctgccaggttacctgagagtagtttatttttagacatgttcatttatcatcttagcaactcagagaaaacagctccaagcgcaatagatggctctgttctaaagcatagattatttttacatcactgttaaagagaaagcccagccatcaacatgataatttatcctcaaggaatttggggcaataaattcaagactgctgaatttattcgttgagataatcaatagagattgtcaattataaattaatggattttgctaaatcatccttttagagtcggaaaacagagattaaaaatgtaaatcaggcaggaaaaattatatcaatagatatataatggtagtgatttagtaaaagatagttgaatggatgagacaatgttaggagtatgtgtttgttgcacatttgtactaatgagtgagacaatgactctcccccgccattccctatgggaagaaagatttgttgcataatgaggaaaaatttctctgattttcgtcctttaaaagcatagaatgctgagtcaatttattgatgattggaaagttctcaaaattttagtgaaaatatgcacaatatggacataatgtctccaatagttgtttagcaattcaagagacatttattgagcactcagtgctaggcactaaggtacagaagtaaattagacatggcccctgtcttaagagctttaagtctaacaggaggagaagaatcacattaacagagtgtagtcatgcactatggtacatgttccagcagaactacgtgcagggtactctaacagcaccggtgaggggtgcatgatccagtcttgtgctgggatttagacatggtaccccaaaataaggcaccttggcatattgaatattttaagctgaaggaacttgagaaatggcatgtgcaggaaggtctctctgaccgtcccctccccttctctgaagcaagtcaaaggaccctcatgtgagagggagggtgcatccttatctctgaaaacacaggatacagagaggaatctgaatgaagaggccaggctatgcttcccctagttgctactcttagataatacttgttttggccagtcaatgttttccccacaactcttcattcttcatgaagcctactacgaaagcattcaggtttaactgtttctttgggtcttcatttccttatgaagcctcccataccatgtaaaacttacattaaataaatttgtatgattttctccttctaatctgtctttcattacaggagtctcagccaatgaacctaagataagtagaaggaaaagatatttttcctcctccacactggatgccctaggaaggctttctggaggggatgtgattgagttgagacagaaagatgaatagggggcatcaggttaaacatggtgagaataacatttctggaatttgcaaaggtacaaaggcaaaaaaaaaccacttggtatgcgccagtaaattgtgaactagggagtggaaggatatatggatggagaggtgggaaataagagcatctcatgtgcccatggtaaggagttgggacatattttctaacagtgttttaaacagtgttctgtcacccaaatctgatgggtacactaccatcagatttggtgatagaaagctcaccctgatattgcgtggaggacgtatcatcagggcgcaagtttagcagaggaagatgagttaggagagtattgcaattgtcagaagcaatgatgaagactggcctcatgcaatgtgaaaggacatggatcagagagggcaagctggtaaatattaggtggtcaaattgggaggacttgaaaattggttgtggggtgtggtgagttcgaggatttggggctgaccaaggaaaagacaagatggcagcattacaaaacagctttattgggtggtacttggacaggactggatgagaggaagtctctcgtggcagacctcccaaagacagcagcatgaggccaccacccagaagtggaagaggaaaagggaactcccagggcagaagggaatggaagttgcggcctataggtctaggtgatgttgctcagctgcaaggtggggagtctctgggtcagagagttccaaagagcaacagcagtttagaattatttctatagccacagggtttgtattatctatggctagcagatgttggttgcacacagagtctaaatggctaaaaatatgcttatttgaactctattttaaccaattggatgtgtgagaatttgtgttttatgccagtgggttatgagctaatggtcccagcctgctgtgaagaagtaaacagcatagggaccaatgtccaggggccatctttaactcgtttacgtaacaggcaatgtttactcagtgcctactatgtgcccaatgtgatgctgaagagccaccgtgtgagttccaaaggaagctgtgtgatgctctatggaggatccacccctttctatgtgctccttgggagtgccgcttgagatggagcagctcctttctactcaatgaatgttttagaacctctaggcgcacagatgcataatttcctgttatataaagtgcagtcatggtagctttctttgtttggcttctttgcctgatacttggcctaagtatacgatttatctttcctatctgttttgacctaaggttgtgtgtttcctgaggatcctgttgcaagtccttacttctttcttcatgtagttatccttgtgacagtgcctagagggctcccatctcctttcttctgattctgttttccggttcctcttctgccctaatttccagtgacccaattccaaaatactgctctctagttgtccaaactgttccatctttagttttatactctttcaaggattctacttgagattctcatttcctaaggactcttgatatcatctgagtgtttcttgaaggaagatactctaagaaatgaatggctgattctgttaattggggaacagtttcctttccaaagagaagcatattgaatctctaaattggtggaatgcaccataggggtcagaaattaaacaaaaattttccaaactttttggcaaagacgacagtggcttttgagtcctttaagatttaagagctctcatctctactctgttaactagatgagagggcagataccctatggattgatttttctctctagcataatgggcctctgtactgagggctcgagagcctctcctgtttaatgtgctgcaattgccaatgctcaagttacagttaaagtagtacaatttgggtagctcagaatcataaaacagtgaaaataggactagagacaatatgtagacacaacagtcttaaatacatgtcacaaattcagcaagagtgatactaaaggcttaattttagaaaaatttctgaatttcctagtcaagaatttacccaatatgaataaaattgagaggaacctagaaaaatcaacataatgtttcaactgtgtgtatggattgagatagtttttcctccaaaatagtagttctctacagccacaaataggtccttcctatgtaaatgaaactcctgcagtgcttgggactacccagtattggctttgatggggtgtatgggaatttcagaggaatgcttttccttctggtgtcagctctctcatgcaatttacatgtgatgccaccaggtggtgatacagagggatagcaagactggaccggaagtagactgatcagcatccatcataacggctttttgtttaagagctttctttggatttaaattagtaaaatcttgaataagtaaacactggaaggaaagcattatttaatgaaagtgcccaataatgaggaagtctgacatttccattttaactcttccatttaatggttgtaaatgtgtatgactatatctgtttccctatttatgggtaaaatgctggtactggattatataatccttgaagttcttgttttgaaatgaacatgtataattgtaattattaaagcagtctattaatgctattcacaatagcaaagacagcgactcaacctaaatgcccattaatggtagactggataaagaaaatgtggtatatgtatgccatggaatatgatgcagccataaaaaagaacgagatcatgtcctttgcagaaacatggatggagctggaggccattatccttagcaaactaacgcaggaatgggaaaccaaataccagatgttcttacttgtaagtgggagctaaatgatgagaaggcatagacacatagaggggagcaatacacactgggctctgttgaagggtggagggtgggagtagggagaggatcaagaaaaataactactggaaattaggcttaatacctgggggataaaataatccataaaacaagcccccatgtcacaaatttatataagaaacctgcacatgtacccctgaacttaaaaataaaagttaaatttaaaaaagtaaaatgaattaaaaatgcctctgtgaacaaagatgatggtttgcaaactcctcagtgatatgaagaagcctactagatataattgaggtctgtaaaaatcaccctttgttttctcttgtaaaattaaatataattaagaccaaaaaaaaagcagcctacagcaaaattaggacaaaggaataaaaaaaatcacacaaacataaatctatagttcattaacaactgtcttacttcactttacaaccaggctaacgcccatttgtgtgtgtgtgtttagtgaggggagaaggagaatggggaatgaaaagtggcttctcagttagtcttccttacctgttacctggcttaggcaagtgagaaatctttcacacattgttctatggggtctctctctctctctttctttccttctttctttcttgacggagtttcactcttgttgctcaggctggagtgcaatggcgcgatcttggttcactgcaacctccacctcccaggttcaagtgattctcctgcctcagccttcccgagtagctgggattacaggcgcatgccaccatgctctatagggtcttttctttaaggcctcactttcctcctaactctagttttctttatgctgtatctagaagtcttactcagatctcccaggtatttttaaatcatagtttgtggaatttttgactctaacttgaatgtttaatgctgagtgattttgttagtctgcctttcactatttcttttcctaaaaaaagcctgaactccctctgtttagattatttatataaacacttagcaaaattttgtcaagtaaatgtctctgtaggctttagaatcaactctatcttatcagaattaggttaagtcacagttgacttaacctaagctggggaacccctaggggttccccagaaacattagggatctgtaaggtcaaagctattttcataataacactaaaatgttatctgtcttttctactgtgttgacatttgcaatgatgatattaaagcaatcatgggtaaaactgctggtattctaacgtgatttgaggcagtagcaccaaactgtactagtagtggcccaaatttcactgctacatgcacagtttttaaaaaaataactcagcttcacttaagaatgtccttcataaagcagaaaaaaaattagttacattaaatgtctactcttgggtatatgtcttattgtgtgacaaatgggaacacgcaaagccttctgctaccaaccaagtagttgtcttgaggaaaaacatttgtacagtaatttgaattgtgagctaaactagcggccttaaaaaaaaagaaacactattttttacatgaacaactgacaagctagggtgattcagacttcagtatttggtagacattttctcaaaaatcaatggtgtgagtttgtcacttcaagaacacaactgacaatatttgttgctaatgataaagtttgagctttcaagcaaaaattagaattttgggccatcctgagcttgacagttttatgtcacctaaagacttctgaaaagattggcgatgaagttactaaatttgattttcagatataatataatgtgtcaatatttggaaggtctgcatgatttattattttccagttacattttccaagtaacctattcatgacattataaaatcatacatgagtaaaagatcgattcaacgtttaggatagaccaatggattttaatgtaacagagtacaaaaagttcattgattgatatggtttcatattcacattgccgctaacctttaagaaactgctatttgttgacttttggtataatagtgaagaatatccacaattacctgaagaggctgttaaaatattcctcctttttcagattacatatctgtgtgaggccagattttcttcatatactttaactaaaataacatatcacaacagattgaatgcagaagcagctataagaaagcatttgacttctattaaaccagatgttaaaaagatatgtgaaaatgtaaaagaattacactcatcttactttttttttggtcttggaaattgtatgtttttttcacaaaatgttaataaataacatgtatgttgttattttaaaataattaaatacttaaagttttatcagttttgatttttaacatgattaatgttaatagataacctacataaaaacataaactaaagctctttgaagtccttgataatttttaagggtataacagggtactgagataaaaatgtttgagaactgctcttctgtggtattagtagaacagtcctgagcatcgtcctactataaggtggattttatttaaaattttgttttcatagtgtactgatggctgtaaaaatttagaaaataaccctcctttcactggccaactccctcctgagatgtctatcaccctctttttttttgactgagctatagctgtaaaagtgggctcacggtggtcgtctgtatcatcccttggcctcccatccaagtggaaagaggcagctgcattttatgagacactaagcaggtgaaatggggctgtgaaagatcaaatttcttacacgtatctgtggcagatgaaaagttcaatatatgatagtgaagagctgacaagagcaattgttttcaggcaggaaaagaaaacttatttctgggtattttttcaataagtctggcaacagctgggcagtgatttaaacctcctaggattctgactttaagcttaaaaatacatttgcatatgccagcattaggaatggaatcccaaacggctgccaacttagacaaccgaaaggaaatagagatctatattgttcaaaagctaagctttgggaggtgctgttactctgcagctgtgtaaacagaactaaaccctttgcatctcctctgctagacactttgttctaaataggaccaaactataccatgatgatatgtgcagaaataaaatgaaggtgatagagctcattgttgggttcgagaaaagctggacattttcctttctctatggatatatgcagacataagaaatgtaaaggagatgtaggggaacctggcaaggcaagagaagatgtgaaattgattttagttttatttcctccctcctcagtatccacatttctttctctcatgttttcctgcctccctcctctccccattttttcctctattgaaactgaggggccgggtgtggtggctcatgcttataaccccagcgaaggcccaggtaggaggattacctgaggtcaggagttcaagaccagcctggccaacatggcgaaaccccatctctatcaaaaaatacaaaaattagccgggcccagtagcacccacctgtagtcccagctactcgagaggctgaggcaggagagtcgcttgaacccaggaggtggaggttgcagtgagccgagatcgggccactgcactgcagcctgggtgacagagcaagactctgtcccagaaaaaaaagaagaaacttaggaccgtgagccatttgtataatggaatagcaggagagaccttccctgtaactaacttcctaactagagaagaaaccatgtcttcatataccaacccatcctctgggggaagtgggtaaggtgcaggggatgcctgctggggacagcttgatatgtaattcttatgttcagaagaaaaaattgagaagttttctttttttttactgttgagttaaatgactacacttaattttttaaaaagtttttttttttttgagtcgcatcccttttcccacatgccttccattttataacccatttagatagagaagctcctactacttgctctgaagtgttttagaatggctaggaacacagattggatttccttactttaaatgtattgctattaaatcagtaatgtcccatgtctttcatgtaattctcacagtaacactttttaaatgattgcagtgaactttgagtgatgacatggttattgaattagggtgcaattggtgatgtgggcaagagtgggcagggtaaactaatggtaataatgatagaaaaggaagaggaggaggaggagaaggagaaacaacttttcttgggtatttagtatttgccaggcataatgtttagctctttacttatattgactcatttgtttggatcaaaagaatgacagcttactagatcagagatgtgctgaagccaaagtgatcaaaactgagacatttgggaggataagtggagatgagctgtagtgacaacactaagcagaggataaagggtaaatcaaagaacaaaaggaaaatcagtagtagagagctgaaatttgaaaaaatgtagcaggctctagggatttgtgtatggagtctagggtaaatgtagtagctgatttgaactttgagacatctgttttggggtgagtataacttggcttgacaaagaaagacaaggggtgaaatggggattgtgttcagtgatagtaaagctggagggtttgcaggagaacaagggctatgatgtgggggtggagggagataagatgtgtgaatttggcaatgaagctgggtgacagtgagtgaggaaggggagatgccactgatggaaaaagagttctgaatatgggactctgctccgaggatgctgagcaggaggtgcaaaagtgcaactgattgcagtggatggggctggggagagactgagctgtgattgctcctaaatctgggtagagtgaagccgagagttggctggtgtgtggtggaacatgtagatgatcagacagggaggagccctatacccagaggtgggtttgatttacccacttgatcccttgccatttgtaaatgagagagcagttttttatgtgtatgaagtaactgagcaataattagcagcaggtagctttgactcttattttcttagactgagagcatcagaattgccttagcaataacctgcattagccacaggaatctctataactcatgtccctcatgttttgctcctcgatttgctttctttgatgtgcagggagatttagtgggtcagactagcaagccccccaggaaatcctacggagttcactgctgacactgcatttaatgctactatttaagccattttactatgtgtaaagtctcgttcattcactataatgtatactttccaaaccctttatgaggcattctcttgaggttccttattctcctagaggttgatgctaagcatctgctttggaatggatcaaaaaatcaataaatggaaagccctttacagttgtgtcttctaacattgtaacctactgcatttaaagacatattatttggatcatcactacctaatataatctttttttaagttccctcaatgtttttattgtttatttttaaaatattgactctccggctgggaattccaacttaaatgatcaactttgtaagacatatttattatttgcaagaaagcctttgcactttgaagaaattttctgagaatacattttacttcccttttgtgattgaaattctttgcaagaaaatcataacaaatacaagactttcttatattatggtttcctccttaataaccataaatattgctgaagttgcacgagacagttttgatgatttggaaaaaggtaaataaatgttggggaaaggtcaagtaaaagctggggaaatgtggaggaggggaaaactcacattttctaagaagattctcctggctgctttcagcttagaatgaaacagctattgctttaacagtgatttttctgatcatacatttcatttttgactgtcaaaaaatttccagcacactagttagatggaccctcattggtcaagggcatttataacttctcagatgacttctggaattcctgccaggaattttacccattggtgttgaaaattattggcaacctgtatttcagtgataaacttcacttttgtgaagttctgcgacttctcttggaaagaaaaagatcagaagatctaacttcataggtctgtgtccttccgtgtggaccctcagtcggacctggtggatctacctcctgaggacagggcatttcctctctggctggccctcagtcacggctctgcttgctcaattactcccttggctctgttaagactttgaattgcatctcctgtttcaacagccctttgtagggggatgactccaaactctattcctcaacttcagtcccccatcccacttctccccccatctgtagtgttgtatttgtgcattctgcccagaagtcccactgatacccaaattatgacatacatgctgcaaggagttttttcaccattttcctctttgccttttcttcctaatttcactgccatcccctttgctttctcaaagtcaaattgttactggaccttccttttttgcttccatatttaaaggctactaagagttccttggtccctcttggctgtgctctcgctaatgcacattctctacttctgtctccacattcgcctaccattcccgtacaggtacagttgaatcagagagaagttggcattagtttcccagcagcttgccttatttctagtttttgctccagtctgttatacaggcagggacaagaataggcttaagcaaattccatttttattttgtcacttttcttttcaaaaatctgctatgatttcccatcacccattacaccaaatagaactcaattttctgttttgtccaggctttccaggttgcctcaacatatccattcttgtcaattaaactttgttttcttttttcttttttaaaacagtctcactctgccacccaggctagagtgcagtgcatgattataactcattgtaaccgtgaattcttggcgtcaagctgtcctcccgcctcagcctcccaaagcactggggttacaggtatgaaccaccacacctggcctcaactttctgtttcttgagttgaatttatccacatctcttgcactcaatctgtcagttccctctttgacaggtcttcacacatccaaatatgcccttctcttgctagtttctgacctcattcaatacccagtcccaattttacctattcctcaatgcttcccctggcatactccaccaaaccttggttagcattttgctctgcattcctctgaacttgtacactgggtatcacaaagttgtagtaggtcagagcacggacaagcttgaatttaggttctgccatctattgggtaggcagtctcagttcttgctgaacctcctttgtcttaattatgaaaaggaattaataataagaatggtgtacttggattgatatgattacatgtgataatgaatgtcaaaggcctggcactgagtgatcaataagccaagatctcagagaacatctccatccacactgcatgtccacaaatttgagctatacgctctttgaaggagagaatctggttttgcttatctttgtatccctattcattataaagtgcctagcacagattaaatacagcaaatatttgttgaaaaatgaagaaacagtgtgatcatgagtggcacagattggttattgcaatcattctgattatttcacaaatctccgctgtcacactgtgagcagaaatgtgtatagtagaaaaacagtgtatttcccaacttgtgtatttgtctgaaagtgtgtcccagagtgactgtagattcatgattaccgtctggggacaacgacaaaaaagttgagaatttttcattgttctgtattctttggtatttttttccttccattgctctgtcatctacttcaagatacattatatatttatcctagttgcatacaaatagtatgtgaatgaatactcatgacatttacggttagtcaatttttccccattattttagaaatttgggcgagggcagctcttcatttctcaaggtttccattttgttagttttcatttgggagcacaaaagactcaaatatataatcattggtaattagtaagagtcttcttcaaactgattttatttaaaaatgttactggcaccatcactaccagcatcgtcatcatgattaacattaaaattaaatcttgtttggataaattttcccaagaacttgccatggtgttatctcccgtttcatgtgctcacaaacaccctttgctttggaaagtgaaggtgccagaataagcaatattacattcagaatgcaaatgaaagctttatagaaatagggttgtgttagagatgaaattaactgtgacacttcaggagttttaccgagaaagaagattaacatgttcggtcttcagcggctgtcttccctgatgcaaataatgttaggcaaaatgaaatctccatgcatccgagctcagtggaggaatgtttattgagtccatagaaatttgagcagggcatatctctaggggtttatgacaggctgttttcttttctcagtgtggggatgaattgctccattatcatctaaattggaagtcatgatgatggttcttttttgattctcttatttatttttgtttatttgttaagaaacttgtatagaaaatgtgttgcttatctggaagttgcgattcttgcttaggccacataataaccttgtatttcttcagatatttatgtatatatacctaaaagggaaatattttatatccttagaccagatctaacttaatttgtttctttgattctttcacataggctaaataatacaacctcttgttgatcatccaaaagtcacattgttaagttgcattttctttaaaatgatttttgcaatgatatacagaaaagttatttatatatatgttcactttttttttctctttctccaaggaaaccaacatgtctgacaaaagtgacttaaaagctgagctagagcgcaaaaagcagcgcttagcacagataagagaagagaagaaacggaaggaagaggagaggaaaaagaaagaggtaaatcctgggtgttggggtgttgtgggggaaaaaggaaaatcacttgattctgaggggctggtcaaatggataaataggactccctaaaagaatccttttatgatatctgaataaaatgattatcttcctattctgcatggtaaagttgttgccctctgctatgtgctggtcagccatcacctaaatgggggataacatttggtccagaggctccagaggcctgcagactccaggcttatcacagacttgaagagaactctaaggatggtctctgatcttgttattgttagaaacttcttaacctttctgtgcctcagtttcctatttttaatatgagaacaataatgcatttattttgtggggttgcacttagcagtatctagaatatagttagtatattctaactataagtgttagttttaagaaaagggttttttgaaaaatctaccagcaggaacattttaggagaaaattagaaaactatgccaatggatttctattgtttccaaaatggtatatatattttttatggtaaataagcatcttaggtttggtaagggggaggctgttcttctcttagagagaaggtaaataggatagtacagtacaaagaattattacatgttagatctggctgaaatttcagagactttccactgaggcctttctttatgccaacaaagcagcagagacccagaggtgaaatgtagcttttctactttctagacctagaatcttggattctataagcccaatccaatgccttgttgtcatatcatgttttcttccactatgtgaatcaaacaaataatttatttttaattctctaatttgtcgtggcagtgtaggaatagcccacatcttatacaaaaaccagataccaaagatatttttgaatagctttctaagaagaaaacttcgtgtggtatgatatgcttttgtgtatagaaaccagagctgcttccctatgcagttcttctgtaaggaaaaagaaaacttattttgatgccttacaatctaaataagtgttgtttcatactacaaggctgagagaccaaggtaatagatttacaacaattattattttccaacaaaataaaagatgattgcagttgcattttagccttctggcatctctcatctctccataccattacgtgttgattgatgtgatcatttatttgtccttgacatcacacataatgttttttccctttgagatctttgctgttacatactcagtctttgagtgaagtagaggtgagaattgacaaggaatggctattcatttccatgcaaagtcaaaaaaagcattaagttattatatttcctttccctcaaatgtcaacacttactgtagttttaaagcacctgctatcctttactaataaccagtttccttttaaactgacattctaatatccaacttgaatgtcataaaattaccactaaatgtgatgtgatatgggaaatttggttccaaattatgctgtctgcttcatctttttcattttacacattttggggaaattacaggcaaactagactgatggaagcagtctccccttttgattctacaaccaagcacttttgcctggtgaggatttagctggtttcaaagcaagaagagccctgggaggttggaggctgcaggtagtggagggtgtggaacacctggactctagacattcctggttgttgccttgttctggaattgacatcatatgaagttctagtttcctcatttctaaactgacttggtgattgaagcttgtgataactgaactgtgctctacagagtcagatggcaatacagagtccgagtcttccatcctcaaagtttctgatttgagtgatctgaagcagggtcagattttgggatccgttggaccacatcatctgtagtgtctctcctggcttgaaatcttttcccttcacacccatctcccctcaaagaggtctttccttgattctgtccatgcactctctgcaactgtgctgacttggtttgttctgagcagccaaggctgtaagacagaagacataaacacagtgattatgcacaggggcttttgagttgaacatggctgggaaacctggatctgcccttcacagaatggccctgagtgggtatgggtcctctctaaacctgtttcctcttctgtaaaatggagaaaggaatgatgtcttcctcacagattcaagaggataatagaagatcccagagcagtaaaagacagctgtcattctgcttctgagatcagctatcagagtagatgaatggggcttcatagaatggtcacatacatttttaggatctctgctggtgaggccattttataaaaatgccccattgttggaagggtcttaaaattcaaggcccccagtttcatggggttggagcattttgtggctgaaaggaatctggaagtcatctattctgatcctttctcacatggggaagctgggcttcagaggtctaagccttagagccaggccccctttatctccaatcacgtgaaggagtctggagttaaaagggggctacctctaaggctcatacagccagtttcccagatcagaaacctgaagtcaccctttcaccaccccctaccccaattcgcagtgatcatcaggtctggacaggcatagcaggactctctttttgcctccattttttttctccctaaaatccacattccagtcagatgcagctgcttacatataccctgatggactacattctttcttgtcagagagcttaagatgttctctttcctctgctttcactgatctcctacttcttcctatcatcctttgcctggctgttaactttacctggctgtccttcacctggctgttaactgcatgtctttccgttctcatctcaaatgtcactttcccagaaagctgcctctgatacctttacccataactaggttagttctgcatcctatcttgacattatcaaaccgtttagtacaagatgttatattttccccttcacttgtctttttctcttaagagattgcaagctttcaaggtcagggctatatgcttttgttgttgttgttgttgtttgttttttaatcattgagtcaatgtcaaatatattggacatatggtaggcattcaaaaaggagttatagaatgaatgaatgagtgaataaatgaacatatgaactagtcagggcaggtttgagaggcacgtcccagacatcctttccaagcatctggtgttctattctgcaaatttctttggaaacttctgatcctgaatccatgggatatcgactggccactgtcactgactcccgagtttaagattttctagttttgtgttgtttatagagaatcagaaatagctttaaatagtcttgatttttataaactttctttaggcttatattttcaataaaacaaataaatttaacattaaaaagaaaagaaatgctctttaatactaaactaagtgccctttttttgccatgaatataaaaactagtgtgaattaggaccacccaagttgattatctccacagaattcagaaaactgtgtccatattgtgtaaaaattaccaccctttgctcttttggatgtcaactgctttcttggctgtgatattatggatgaaatctgattttaaaataaatatagtggccaccatttaagacactggcccaatttaatgaaaaattggctttaatgcaatgaggtgagctcagtgggggccaccctgaagtttcattctgtccttggcttcctgccgaattgctgcaaggtagaatggccaggggtttcctggcctgtcctcacatgtttctctaataaatgtggaaatgtctttaggaaagtgattgacaattctcagctgacaaatttttctttcttcgattatcctctctgggtttcagctgtgattactctccaccaacagaaatataacttgctgagaaaggcaccttgaagatttttaattactaatactgcaaaatcactccttgttgaatcattaaaacatagtaggattctgtagtagatacagatcctcactctgcaacatcttttttctcatcttagttctatctttgcctctgttgtatacataaactttgggacttgtttcagtagtttaaatgttaaaattggaaaagaacatgaactttgatatcttcactgataagagattaaactgccatttcataattttgggttatgcagagtgtctgactctaagactcttataagcccttattggctttcaaatggtagttttccctctaatgacagatagacttcaaaaatatgagtgatttagctcaaagttaataataacagaattgttgagcacagagacatatgcaaagatgcacttagtttataatcagtgtgtaggttaccctctgggagtaagtcaaaagttgcataaactctttctgcttatagatactacagtgtagctaatgcttcacttgctttgaaaggtattctacatgcccaaagaaagtaatgtacttgttagcatacccagctttccttggggaagaaggtatgtctcataatgaaatgttttttgacaggctttaagacagcctcacttctgtaagcttacaaagctttgttgtgaggtagttacacatcaacgtgatgttatcatgtttcagatgtggggcaaataacttatcttaagtaataactgtattatgaaagagagaagagacttggaatttttaaatttcccctagaatcccaccacagatcttgtttacctgcattttaatttgtcactgatctgtaaaaacaccaactgggcataggatctgacattaagaggccagtatgaaaaacataatgtgtttttagacagaatttgtgaaaggaatttcttgtaaatgttttgttttactatattttctacatgataattttcttcttccagttagtatatataatggaatgctgtgaaaattagaataaagtaccaagacatatcaatattgatcacatgccttaatacagattttagcccagtttattttaaaccatggcaaacttgtcttagcaatacaaatagtgtgttttatagttaaaaattttcataaatagtttcacttttcagcaagatcccaacaatacctggtttgcacaatcccaaacatggggcctgaatattacaaacacacagtcatcaataactgatatcccagaagggacaaggaagtctaaaaaaagagacagaatttttttttatattatatccccagccagaaatactttgccttgatgttttctcttccaaaacctgtgagagaaactttcatcccacgtgatagaagcaggaaaaagccttcagccaaaagagaaagtactgggccagtaattattaaatggggcaattatggtgtttattcatcctttatacatgtgattatatctatttagggctttcaccttgtcttcactgccatgcatttatcatttttagtttcagccaggaaaagcatacatttagttatgttattaacttttcttactgacgtctacttctaggctgatatgcagcagaagaaagaacccgttcaggacgactctgatctggatcgcaaacgacgagagacagaggctttgctgcaaagcattggtatctcaccggagccgcctctaggtacttaaaagtgcttcctgttactattcctcaaaatcaacttgcgtgggatataccatgtccagtgtttactattcttttaagtctttagttttttttaatttttatttttaaagacattctgtggcttatggttcaggttgcatgtgtttttggaattgagggggctggaaggagatgggaggaaagttgtagaattgtcagtagtttggggcttactgactgattagatggtcaaccttctccaccgtgttactagtagattattttatacttgttaaatgagttgccacttggtaaatataagaaatcttggaatgtcttattaaattgttcctcattttcattgctgagttccagtgtctctttgccaatctaaatactgtggatctgggttatgaatttcataactaccacaggcatagagttagtctatgatgaaaatagaaggcacagtgagaatttgaaggaaaacaaaatggtggcagattagcagccgattaacaagtttaaattaatttgactttattgtattttgatttgattactaattggcattttcactacaatactcctcctctaattcgttcattcctagttggttgtctgtgacctcattttatcactaaagcttggatattgaattattggttttctttgtgttgaaggtaacttgtgcatattttgtttattctgtcacttacctatgtatctctcatgtaatagttttatttttcttttatccttttgttttccatacatttaagattaatcctagggtgtctataaaactacattatatccaatatagttaaaaacccttttggaagaatacataaaaataaatacagtattcagatcttttgtttagaatactttcttctgaagttaattccataatttacttttatattaaaataaattatcatttatttccatagttagttaaactaagaatataaattatcccatgtagaacaaaatggcaaatgtttatatcaatgtgaataagaaaaagaacaatatataataagcttaaaaattattaagtattgctggatgtaatttaatacacacaaaactaaaacactattaaaaatcattttatactcaatctcaatttgtaataggtaaaaatagtatgttcaacaatgctataataagccccaataagattagattctttggtttaatttcttcatgttgtggaagatgtaacctaggggacgttatatttgactgatggaccttcttttctacttaggagctgatacacatttttttctacttagttgacatctgatatgagttagacacattgcaatcaattatatttgtgcctcaaaatagcctttgaaattatgttgcaatgtgaacactggttaaatacaataatagtatgtcctagtctcccctaccctacataaagccagtaattaaactttaagaacaaaacagattaacatctctaaaccatgaccaacttttgaagtatccttgcattactgccaacggactctggcaagggccctgttttcatttttcagccatctcttcgacttaccctctgagcttactcagagggtaagtaatcagtgaattaattgtgggaccacatgaaaattcctagcttctcgacagatctgccattgtgttataggatttgggtaaaacagttaagccctttaccctattaagtaaataaaaggaaattgcacatgattgaaaccaaatgggaatctacatttacgtactgaaatttctttctatccatatggcttctctggcatatgtgatattgagaacccgttgaattgcctggcctggagccatcttggctatttggtgcagcttctatctgaaggacatttggcttgtatctgaaggaagggggaaaaaattgcattggctttagcttttttcttttattatgcctgctctcagattttcagcttgtgccgaccttgatctttgaacttgtctcctgtcttcagagtggcagcttacttctgtgcacatggcagggtcttctagagctgctggaggcaaggcaaaacaagtcccaaagacagtaaacagtacaatgggatgcaactattaattaaatgtaaaaataaagcagcctggcatttttctttgttttgaaagagactttttaattaccagtttcaacatttaccctttctctatctgtcacttaggctctcatggcaaacagcttatattccacagagtacatttctctctcaatgcagacatacaacagatttttctgactgtccttgaccatttaaaattattcagaatcacttatttaataaccttttaaagttttatagacaccttgttttatttttaataggtcacatctatactaacaaaataatgtgaagaatcagaattatctggatggttcatgttagagagatatttgacttgaattatctggatagctattttgatgcttcattttactttgttagggtggacatggcctcagaatccctaggttaattctgtctaaatcatttcaaattttaatttccaaaatacaaaaaattcactggacttttttccttttctttccttttttttttttttctttatcccatctcaatgtctcctggccatacaaccactttaatttgggcccatttgttttgatttgtctgacactgctcttcaccagtgcagccgctgcattttttaacatgggatacctgttattttcattatttagtcccaacccctatgtctccctcctcgaaatcagtgagcactcccagtgaagctggaagccaagactcaggcgatctggggccattaacaaggtaagaattgtccctttaaaaggccatgatgggtgtcaattaaaaaaaaaaaaaaacagcaacaacaccactgttagaatactgtgaaatgtgcatgtatctgcatgtgtacttggacatcttatgtttaaatttatggtggcttgctatttttagtggaatagcaatgatcttgaacactagaaatgatcaacatatatcatccttctttgagtgggctaatttagcaccatgtgtcttgcttaacaaacacacacatatccattagcttaggcttaaaaaaggcagggagaagccttttcattatttagtagataattgaatatatatccagcttcttattatcctactttggttttggtttccatgaaagtctttgtgaatagaatattgagatgttctaattctaaatttaatttttcaagtgagttatttgcttagtaaagttgactaatttgaaaactcagtcacctaagtatttttattgtattattattggtagtagtagtatcaggattggctgcttctgtttagtgagttcattgccaaatttgtattacactatgtagactcacagattatgtaacttctgaaagtagatctagacattctgtaatttaatcactgaagaggtatccaaaaggtaaagatgtaaaaagaagaaaggagaagtttcataaatgtagatggagtcatggtaaatctccgaatccagctgtcttcaccagtgttcccacatgccggggtccacaggcaggaatttatgtgagtatggcaactgcacccaattcttaaaggccagatggccccctcatagctcaagctggttgagctcacatgatatgatggacccaatttttccgcattttccagtttttcttgagaagctacaaattcagatattcaggtgataatctcctgaatgttaaatgttaatgacttttgttccaagtagttatgggccagatttggcctgtggcaatttatgaactctagctttgactcttaatttaaaaaaatcataaaatgctttaatcaagttttaaataaaagaagaaacaaccatctacagcactgctgttctaagaagtcagccttttggcttgtctgtgtacctttccagtccttgtctgtgtgcatttcttgcctccgtatgtattactggggcaaagatataaaattttgcatttttctcttttcacctaaggcattagcataagcattttcttctgaaagtgtactgtttccacacaggcatagttaatttggtagctgaagatctggacatgaagataatctagcgttgatctgagctgtagggtttttttgcttttgaaaccaacatataagactggaattatgttacctatttctgcctgttggtgtccttcagacttgaatattttgttttcgtaggccctttggaaaccagtggacactgctttcaattaaaaaaaaagtagaggtttttgagggcataaagctggtttattttagcaaatcgcttttgtgatttggggcagcacatgtcttctctcatcttttgctttgaacacttcaaaaggtctttggcaggaggaagtaatagcaacacagttgtgtaagatctaacatttattcaagagctggcacaatataatcacatttcttggggggggtccattggcctatcattaagttaatgtatttgaccatttctgtaccatgatggtgcgtgtcattactgcttagcttcaagggtgcagttggcagcattcaattctattactgacttcacagttgaggagccctttggaaaactttctaaagaaagctgacctatgctgttagtactctggggacaacagcaattatttcttctcagagaatattactctttatttctttctccttcttaggtgattttttttaactttatgaatcactttggaagaggtgcagcttactcctacccaacacaatagtaacttcaattctttataggaaagttcttgcaagactgagtaactagaagtcaattagtaaacctcctgcaaagtgcaggtttcatagaaatgcaagaaaatttgcattgaaaaatgctagttttcagaaaaactgagcacaaagtttgcttgaggagaacacattaagaatgccttagtaaattctgcccttgttttgaacttaggaaaattccacacaaatttatgtttttttctttaataaaataaatatgaagttaaattgcaggagaatgttatatttcagtttttttaaattccactttgaatgtctttttatgtagaagacacatctttgaaaacaatttatattaactttaacacttcataaaacaggagactgggaaaagagttcagttattcttaagaatataactctatgctcataaatttgcctgtttatgtggaatttgaactcttcaaaaaatggtaaatctttcagaagataacaagaattaaattaacacatctggccgtagctaaaggcacatataaattatctcattcatttgccaaaatttcaaaccaaagctaaaattttctttagaaagccaaaattagcaaacatttcttataatctttgtaactagttaatctgcaaattggcctactcaatgtactttattatagagaagaagtaaaaatagtgctttaacaaaaatccctcttattgattttttttttttttaattttaaagagaccgtcttgctccattgcccaggctggagtacagtggtgcaattatagctcactgcaacctcaaactcctgggctcaagcaatcctcctgcctcggcctcctgagtagctgggactacagccatgcaccaccatgcacagctaatttttatttttactttttgtagagatggagtctcactatgttgtccaggctggtctggaactcctggccttaagcaatccttttgccttggcctcccaaagtgctgggattataggcgtgagccactgcactcagccacctcttactgatttttaagagcagttgagaaaattttaaaaaatgggtagagagtagaaatatgtaagttttcagttatactaatgatttaattttttaaatttcacttaaagtgttaccatttgttttgcaatttatgcttccattgttatatcccatttctcatttacaacttatacttttggttttatcttctttctcctgatcggttttggtagaatcaattaatcattgctcagttaattatactggcaagcaacacgctcttggattttaagagcttgttgaaaaggttagtttgaagggttagttttacttataaacataaatgaaaaatctttgatatactgtatgcaactggaatccaacatattaagaggatactatgctatggttaattagtattgtttcaaaaatgcaaggttattttagtataggaaaatgtcttaccatataatttagcatacaaaaaggtcaaagaaggaaaaataatcattgcaatatgtacttaaattatacttaagaaatttaaacacttattcctatattttaaaatgtagcaaactaggaatagaaaatattttctcaatatggtaaagaatatttgtctgaaacagcttacgctttttatacataagagtgaagcattagcactttatagtcctgaagaacggcttttgtttagttgaacatgtctctcatcctcagaaagtggtgaattccttgaaagtagggactaagtgatactcatgtggtaggtatttgataaatgtttgctgagtgaggtgtggtagctcagaactgtaataccagctacttgggaggctgaggcaggaggattgtttgaggctaggagttcaagaccagcctgggcaacataacatccaagattaaaaaaaaaaaaaaaagtttgtagaatgaactatataattctgctttttaccaatgaggacactgagatgcgcagagagaataagtaattttctcaagttcatacagagtgttgttttgctacagtgctaggtttttacctaggcaggttgattcaagtttccacaatgtatatctctatgctacataatctctaacagtagttgatatgagtgatacacaacctaccccataaggttattgtgaggattatacaaagtaatgctctataaagtactcagaaaggagtctggtgtatactaactatatgtgagttttagcaattattataattttttcatattttaatttagccatttttcctatgggaaaaaatctttttagatcctctcatagaacatgttggtgtcattttcaattttagtaagcattgcctgtatctttatccacgtaattacataaaattattaaacatgacaaggcaaaggacagattgtaatccatgcccctacagaccacattctgggttgcccactccttactcactaaccttcagatagcaaccagaagtgaatcgatctaagtgaaaatcattcagccaacatttattcttctcattcacatggatggctcacaagggactttgcactaggacttttctcatgtttagttgtaattccttagggttcgcaatgacagagctgaactagaaggtgtactggcctgcaaaaatataggaaagtgtattgacttcataaagttcagctggacaccacagtgtaggctacaacctgtcccaaatggaaggaaatgttgaaaatgttttcaaagttaaaacatctctcaacgtgataacatactgtgcaatatcctgtcacaataataacacccattgcataacatccttaacaaaatagtccgaaggggagatttctgatgtttgtctttggtgagaagtgtcatggagggtagtaatagaattaatttttgtcttttttttttttttgaccatctttggtcttaacaccatcattaagttctactttccaatcaatcaagacatttaagccctcctccaacattttattttttaaatcttttttttttttaaagacaaagtctctctgtcacccaggcagcagtggtggcacaatcttagctcaatgaagcctcgaattcccgggatcaagctattctcccacttcagcttcctgcatagctaggagtacagttgcataccaccacacccagctgatttaatttttttttttttttttttttgtagagacgaagcattgctatattccccaggctggtcttgaacttctggcctcaaatgattctcctccctcttcatcccaaagtggtgggatcctcctgcctctccctcccaaagtgctgagattacaggcaggacccattgtgcccagcctaaaaatctcttactattatagaaacaacacctgtgtattttatacaactagaaaatataaatgagcaaaaataacaaaataaaaacatcatgtttccaccaccagagtagcactcttagcaccttagtgcttattcttttatattatatgtatgtcatcatatataatgataaatgacatcttactgtgaaaactgttgaacctgctttttcaatcaagtgtatttttatatttcaatgtattttcaccttatctagtatctacactatcttcaaatttccccaattggccccaataaaatcctgtagtatttaaaactgatgcctgtgctcacaattagcagcatttcttaacccaaaacactgatattcgtagattgttctctagggaggtgaggcccctctcaagggtaccacaaatgcagcaggtggagaaatgtcttctgaagcacatcacaggagaatgatgatacaaagggaatggattaaaagtctcttaggctttcagcttcatgtgaatttcagattagaattcagggacaaagggacagatttcttcaatgttctctcttcagcttggatactgggcctccatatagttactattcagtttcttattgacagaaagctttggttaaatttagatacttgtttttgggctacaataattcgttgtgggcaacttgtcctgtctgcatgtagttactactttttttttagtgacttcaggaaagaaaaatgtgttctggggccacatggacataatactcaaaggaaatccttaggaccttcacctttatccacagtcagattctgcaggattctttggaactatgtaggcctcaaaggacttgacccatttgggtgaaagcatcatcatcttctaagatgctctgataaatcagaggctaaagggaagtcataaaggaagtattagtaaaggtgaaaagtgtaataaataatacaagattatgggggaaatttaataagactattaaaattttgcttatacaaaaaaattttaaagtatcattatataaagagagattgacaggatgctaccagccaattcgactttggggagactgaagtcgctaattcaaggttggttaaaagtcagtctctttgtaaattaaaataagatttacactatagggttttctctttatgcagcacaataagttcaaaatttttaatatcattgtcttcaggcaaagtgtgctctatgtacccatatggttatagtaacacagtaagcatctattttaggaaagggtagctgagctttcttctagagaaactgcttgcttgacagcaggacttttgtgtaagattttgggaaaacatgctcttgttctatgatgggaagtcctacatttcttattgaatccagctcagatggacttcccatgtggcttagtgtggctcgctctggagctccatattagggctcaggtgttagccaacagatggaaaattctcccaccataaattaagaaaaatgctttttaaaaagagcctgatataagtatgtatttcactgttccacatttatttctgacatcagaaaatctttatcatcattgccagtcctaagtaaggaaaaaattgaggccaggaaataaaacattaactcattatttgaataccatcctttcttaattaacatcactttaatgaatgtgacagatgagtgatatgatggattttaaaatgtccttattatttcatgtattacttttggaaacggcattttaaaaattagatatttagcgatggcattgactagatattttctgtttggcactatgcttacataatcccaaactgtttgcactggctgattaatcactagtgatttgtttgacagagaagacatgtggaacaagagctcagagaaactgtgcgactcaggaaatctctgtattctgtccttgagctctctctccatcttagagagaaaaggaagaacatgaaaatttgagttccagtgcagttgcttcagggactaattaaagttactaaattcacttggtagagaagatggctggaccgcttttgtttttcaccacaaatcagcaatatgttgagcattttaaaaataataatattcatagagacagggtctcgctatgttacccaggctggtcttgaactcctggtctcaagtgatcctcctgcctcggcctcccaaagctctgggattaccggcatgggccatcatggccggccagtggtcagcatttttattagataagatatgctttccttcttcagtatggaagtgagtctgaaaactctcctgcggccatgtagtgacatcacgctgagtaagactgagttttccataaatgctttgatggatattaagggatttagggagacatgccctgatttattatttcattttttaataaaaacgtaaaaactgtttcttttggaatcaacttgccctcacacgtcacacccatctacagaaaagccaggtaaagaatattcatttgttcattcattcatcaagtcattcagtaaacaattgagaatttattgtctatcagatactatactagactttcaaggaatataaatattcttcttacttctaaagagcaagtaaattgacacatttaatttgaatctaaggaaatgttgctgtgtagttacagctctcaaatatgcatactcagagaagagctcaatggtaatgaggactttggggttattttgcagaagatatatggacgtctgtgtgattgcctggggttagagtagaaaggtgaggggagaagatagaatcctggttggagaatgcctgtctttattggaatggaaagagcaagggtactgccaaaaacacagtgagagagggaggaaaagaaataagattttcagggccaagaaaactaaaagaaagactatgccaagaaggagccaatagtgaccaaaatcagagacagcaaagataaggaacaagaaccgaccatgggatttgatgatttggaggtggttgtcgtcatcattataatcatcattatcattttttgttattattattattattattgacgctgttttattttcataggctgaggtcctgggagcaaaactagtccaggagtaattctattttttatgttcctgccatatattggcatattacttcccaaagaactttactaatttaaatgctaccaacagtgtatgagactgccttagccacattgagtgttagcattataaatgagaaatttgttaactactgccttccaaatatttattgaacatctctttcttatagccaaagactagaaaaggtaagaacaaaaacactctttaggaaataattctaaggttttctgctctgaggtctaataagatggaaagaagaatggaaaccaccaacttgttgttggtaaaagctgaatgggaagaaattgaccactcatcagagtgcaaggtatatgcaacacagacattatgtctttcactcctaagttacactttcaacagatggccaaggatattttaaaattttcacttctttctgtctcataaactgaaactgagcaaataaaattgagccaatgaaaggggaattttataagaaattaaaaagtaatgaattggtacaaggtttaaaatatgaaatgaaattctgcttgtctcttagttggttacggctagtttgaagaattttgatgtttgcctattcttttttaaaaatattgaaaaacaaattgacccacaaattataaattaactactacatggtaggcatttttgtataaggtgccagaggctacaatgtttttgatatgttcaaggttaaataagtgagtattttccatgttgggaagcttctgtattttgaaatgaagttaggaaatgtgaccttaattggcatgtccaaaacagccaatccaaccctgggaccatagaaccgtaacagtgcctgttggtccagagtaggtacagaattattgggttacttagcttctgaacacataatagggctcctatgaaacagagatcagagatcccacctagacagaacctcagaaagttagcctaagaaatcaattgaaactaatcagagcagccaaatgcaactcataaaaataagcaaacaaacaacaccaggatggttccccagcggggaatactgacggaaatttaactgacatagttaaagaaagattgtatcaaacaacaaaggctaggttggtcatcccaggaattccagaaaggggagacttgggtagcagtgaggatgatgtctggtcttggggaaagataaggtcatggtgggggagggcaggggaagctgtcgtagttaaacattcagcatcacctactctagtcccaaagatactgctggacatctggcttcccaggaagctgggcttcaaggagagaagactttgttaggcttatatatttgtctgcctggttattattgttctcacaacaaattgctaagttggcatctaaaatatagcagtcttataagacctagtggactacctcagccacctaagtccaataaactaagcactgaggaaaatgaatttaggcccaaatcctatcccctcctccaagaccaggtcaaatggaatctctaatcttttcagtggaattgtgtctccctgctgtgacttccaaaggatgatgaaactgcagtccaatgcctggctggctggcacggagcaaacactaagtgaagggaaattataacaatcaccattcttaatctgtctttcctatggcatttattaatattttcagctcatatttattcaaactttaaactgtgccagtctctgagcaagtgatgagagctactttcttccttgtagatgttatcggtatattattaggcataaatattcatatgtctcatttcttttaccaaaatggaaaagtcttaagtgcaagttccatgtccctcagcatacatgtggtactgccgggtaggggaagctgtcatagttaaacattcagcatcacctactctagtcccaaagatactgctggacatctggcttcccaggaagcggggcttcaaggagagaagactttgtcaggtttacatatttgtctgcctggttattattgttctcacaacaaattgttaagttggcatctaaaatataacagtcttataagacctagtggactaactcagccacctaagtccaataaactaagcactgcggaaaatgaatttaggcccaaatcctacccctcctccaagaccaggtcaaatggaatatggcaagttttactttcagatttgttctactaaactatatatatatatatatatatatatatgttttggttttttgtttttttttttttttttgaggcagggtcttactgtcacccaggctggagtgcagtggcatgatctcagctcactgcaacctccacttcccaggctcaagctgtcctcccacctcagcctcctgagtagctgcgaccacaggcgagcaccaccatacccggctaatttctgtatttttttgtagatgcagagtttcgtcgtgtcgcccaggctggtcttggaacccgtgggcttcagcaatctgcctgccttggccttccaaagtgctgggcttacaggcatgagttaccgtgccaggcctattggtataggttttatctcctcataagagctgtaggttccttgaacattttttcaaccctctgttacagtattttgtattttaggttcttaatagatggtttttgaataagtaaatgaatgttcttatcaaaatcttctctcctctgcatgcattgattgagccatgccagaaatgactaaaaaatagaactaattattatagtaaacagggtgatttctatatcaccatcattttattttcagagatacaattacttggtaaaatggctggaaaataagatctctgcccattggttaaataaattattctaactggagaagagaaagctaaaaggcagttgaataatcatcctagattttaaaatatcaggcagagaagaatgttaaagggccttaaggcctgcaccctcatttgctgggaacaaaaggagatttgcctgatgacacactgaagccatatccaggacacagacctgcaacccggggccaggagtgctcctctctaagatactgccatctgcggggaagctgtcctgcacggtttacacagaaggaattcggcgaatgtttaatacatatttctaggctatccctggaaacacaaacaacttttgcccattttgcatattggctttaagttcctttcaaaaaatttgcatatttgcatattccttgaagggaaccaccccacagataataatgggaaaaatgaaaagataatacaactggcacatttgatagcatccttggcttcaccccttagcccacagcttgttactgacaataactatggtttctgttactgaataacataggtgtgccaggaggcaaggctgttgtggtgttacattcctaccttggtttttctggccgagtaaatgcaaactccccagtactaatctgtggactttttaagtggatgatttgatagaatcactatttatacttcttaagggtatagtgagttcaggtgatctgtccaataagtatcagaagagccagaccatcggggagctgctgggagaagtggaaaaggtcactaaaaatcagcccatcagaaacctcaaggaaaatggaggtcaaatagttgatcctactccttgcaaggaaagcttcttacaatcagcaagagccagagtctgctcttttgtctacagcagaagaaatgatcttaaatttgacccccagagatatgtgaacagcaaatatgaattacgttaacatattccattactttcacaatttgaactgagattaaagaatcagtgcccagaagcaagaagggctaattttcttcagcagagaatgaattcagagcaggggttctcacccctggctgcacattagaatcacctggaaagctttaaaaaactacagatgcctgggtcccaccccagacattctggcttaattggtctaggggtggcctggatctgatgccaggcttgagcaaatcagaagtttagatgctaatgtatttgagcttcagtgatgctttctgcatgctgactactgaaagcaatagtctagctctgtcattctccaaaggtggtcccatgattaaccttgtaaacatcacctggaaacttgttagaactacaaattctagggccccactccagatttactgatctactgatcagaatttctagggttggggatcagcttattaaagctctccaggtcattctgatgaacatgaaagcttgagaaccacttatgtaagtcaagtcattgctgctcaaagtgtgttccacagagcagcagcatctgtatgtcctggagcgtgtttgaaatgcagagtctcgggccacccgcacacctactaagtcagactgcattttagcaatattcccgggtatctgtatgtgtattaaaatttgagaagcactggtctaagaaacactcgccagttagtgtctcattggacttcagttttaatctttcagaggttctatgtaaaaagacaagagcacagccagagcatagaagggaagctgtgaatctgtattccgctacttctgcaggaggggttaatatgtgatctgtcaaataggtcgggcattgactcaaagaaacattaagagtagatagagtgattgtggcagtagtaaaagcagctgctgcttatcatatggttgccatgtgctttataggtatacctgcatttaatccttgtagaaaaccagcaaaatattcattcattcaacaaatatcgtattatataagcacatatgcgcgatacagttctaggcatatccctatattctagagatgtagccacccctgccattatgaagcttaactccaaagtcagacaacaaacaaaaataaataagctgatatacaagaaaatcataggtaaagatgagtgctatgaaggaaataaagcaggggaaaggaaggaaatgaagagtgataaggaagtgctacctgagatcaggtggtgaagcaggggagcctctttgaggaggtaacatttaagccaagacacaaaagaagcaaagtcatgagccatgcagatgtttaaaggaagaacattaaggagtatgcagagttgacatgtgagtgaatgaatggttagagagaagtttggaagatcactgcaggccagttcataagttaccatataagctacagtaagtatttatagacaaggaaaccgagcagggcttctcaaattaagggtgcccatggatcacctggggaacttgttaaactgtaatatggagtcactaagtctggggtgggacgtgagtttctgcatttccaacaaactcccaagagatgttgatgctactgctctgtaggccacagagtaaacaaagggatgcaggggctgagaacttattaaacagcacgctcaatgtcacacagctggtaagtcacagaggtaagatttgaatcacagatgcctgatcctaaagtttgtgctgtccattagttgcctctgagataacctcatgcctgattcacctgtaaccggtactgtgcaggatatttaaagagcctggctgagaaaagtcctggcatgtgctctgtttatagaagagccatttatcccctcttatttagaaggagaaataacaagggaaattggatgctttggtaactattgatactttgtgccattgcttatgcaatgtttaaaaaatataagatataatcaatccctgacatcttagacagaaatgatattgttggtgaccatcttggtgtacaatatataaataagcataaaatactcatgagtcttgaaatctaatgcattatatttgtagtacctgatccaaggaaggcagttattcaccaggccctgcagtcatacccctgcccttacccatttgcacccttgcgtttagttcttttcaccacatagaagatgcttggagttcccagatgtgggtgggctctggggtgtcagagatacatgcagtggtttacttgcccaaatcaatgaggcttcaatacaaaacaaaacaaagggtaggggtgtgtgtggagtttgaacacttggtctcaactttctttcatgaaagcagccatagctcccgatattaaacagatgtttgcaggaaaggatggctcctcgatttctcttgtttgatagtcactgggggtggaggggatggaagggggacatgttctgtgtatgtattgtatatgctcttgccttgatgaatgacatagtttggtttggtttgttgccctccccttttgttaattctctgtgttctttttcctttgtgctgcacaattaggaccctgcagtgggacacagacccctcagtgctccagctgcagtcagactcagaacttgggtatatgtctgctcttttgttactccttttattatttctttgctacagttgtgttgaaatgctggagctgttgttgctcttgtgttctccccttttgttgaacttccagtttgataagttcgtttccttctgttgattttccttataaagctttgaagaaagtctctctttgtggaaaacaccacaaaaagatggcttttgatttctccttattaattcctattattgcaaaacaacactcccccaaacaaaaatcaaacataaacccacacatctaattaaaagtggggcacacaagttctgcagcgggagatatgtttggctttatcatcaccatcctcccctttactaacaagttgccttaagttaactttggtctaagatcagtatgaaaatattgggtcttgtttctttacttttcttttcagtttttggggaactcacaataagcacttaatttgaattaagtttgaacagttaaagattcctgtttaaaaaaaaccaaggaaattaattgaataccttgatctaaagatatttcaaatactagatgttgagtaatgtctcctatgtcctaaatatcatctttttcagatgtaaatgtattatcacaagttaaaagaaaacctcagagatgaagacttggagtggaataaaacacacagacatatcctagaaactcaatttatttccgttgtaggattggagttagctgtagtcacacaggagatattactggtggggtgtttgtatcagctggtcatcaagctcaggagagctgattgcgcatttctcttctcaacttcacattaagttaaatcagctggaaatcagccacggtggaagtatttacaccacagaaattgcctcctttcctacaagcaatttattaagcatttaccgacagagcactggatatctctaagtgaacagcaagtttcataaccacattttatggaaccattatcttttctttctaaatataaaccaacatatcccaaaccaggcatttatttacttattattcattttgaattcctgagattcctgggcatatatctctgaggttctgtcagtttcaatgcctactgtaggtataaaaggaggttgaagggctatttgcatgttaggttaaatgccatctgcctgtgaccctttgcatatgcaaaaattcttagctgattcatgacaatactaagccaaggaaatatcctaacatttaggtaaccgatgcactatttcttttttaaccttactaaattcttggctatttagttatatagttcatttatgttatatttcaatttgtattatttaaataaccaagagatatggcttaaataaagcagagaatgtatggtaagttatagttcaggggaacttcagaatgcagttcttcaaaattatattgtgttaaaaaaacaggcaggggaaagaactggcagagactaccccatgcacttaaattaacagatttttagacagattgcagcagtgctaaattacacttgctgatgtggaatagtttggaattttcccatttatatctgttttccaagcaaaaactcatgttgactatgcagattaaaatttgtgacttattctagggatatagcatatctgtggacccaccttacctgctgcattatacttgagagtgaacccagtgtgttggagagagaagatggagactttctgttcactttctaaatacaaaccgatataccccaaactaggcatttatttatttattattcattttgaattcctgagattcctgggcatacatctctgaggttctatcaatttcaatgcccactgtaggtataaaaggaggttgaaggactatttgcattttaggttaaatgccatctgcctgtgagtgagtggcttatcttagagagtttgaaggcattttcagagaatttttgagagatgacattattttagccattttacaatttcaaatattgccttaatgaaaatttctagatttttctagagagttttatttcaccttcttgagctgtggcatgggaatgatcatagtccatagcttcctttgtcacttaatttaacacctttactgaagtataactggctttaaataaactacacatattaaaactattcaaattgatgatttttgacatgtatgcacatccatgaaattattaccacaatcaagatagtgaacacattaatcatccccagagtttcctcatgcccctttgttatctacactcttgcttcttcctgttcttccctatcccccaaacatctgatctgctttctatcactataccttagtttgcctttcctagattgtcatataaatgaaatcatccaggaggtactcctttgactgacttccttcattcagaaggattattttgagattcattcaggttaagtttatataaacagctctatcctttttatttcattgtatggatataccacagtttgtttatccagtcactttttatatacattgggttgtttacaatttttgcccattacaaatagaactgctataaacattcatgtacaaatattttaatgcacatatgctttcatttcttttgggcaaatacctcccagtagaggtatttatggttgaatcatatagtagatacacatttaactttttaagaaattgtcaaactgttttcaaaatggttttaccattatgcattcccacgagcagtttatgagagcctcgatttttccacattcttgacaacgcttagtttgagcttcttaaaagaaattattaatttgttaactattattaaagaagtatagtggtatttcattgtggttttaatttgcatttccctaatgactaataatgttgaatatctctttagttgcttatttgccatatgagtatcctctctgatgaaatgtctgcttaaatctgttagtcttatatattgtttttgagttgggttattttctcataattgattttgaaagttcttcgtatgttctggataaaatgctttatggggtatataatttattaatattttctctcagtctatgacctgtcattttcattttcttaacagtgtctttaagaaagcaaaccattttaattttgactaattacagtttacaaatttgttcttttatggatcatgcttttgttaacataatgttgatttttaagcaattattttaatatttggtagaacacaattcacctatgaaatcatttgggtttggaataatattgtggaggagattttttgctttgttttattttgagacagagtctcactctgtcacctaggctggagtgcagtggtgtgatcttggctcactgcaacctctgcctcccaggccagagacagatatctctttgagatactaattttatttcctttagatatatatgtccagaaaagggactgttagataatatgtagctctagttttaataatttgaggaacttcaatattattttccataatggcaatgccaatttacaatcttaccaacagtgtactaggttgtttcctcaatatcccttccaatacttcttattttttatttttaataatagtgatcctgattgcatctcattatagttttgatttgcatgtctctgataattagtgatgttgaacactttttcatatacatattggtcatcttatgtcttctttggagataagtctatttagggcctctgtgcatttttaaatcaggtaatttgtaattttgctattgagttgtttcagttctttatatattttggatattaaccccttatcagtaatatggattaaaatattatctcccattctatacattgccttatcattgtattggttgttttctttttttttattattatactttaagttttagcatacatgtgcacattgtgcaggttagttacatatgtatacatgtgccatgctggtgcgctgcacccactaactcgtcatatagcattaggtatatctcccaatgctatccctcccccctccccccaccccacaacagtccccagagtgtgatgttccccttcctgtgtccatgtgttctcattgttcaattcccacctatgagtgagaatatgtggtgttcggttttttgttcttgtgatagtttactgagaatgatgatttccaatttcatccatgtccctacaaaggacatgaactcatcattttttatggctgcatagtattccatggtgtatatgtgccacattttcttaatccagtctaacattgttgaacatttgggttggttccaagtctttgctattgtgaatagtgccgcaataaacatacgtgtgcatgtgtctttatagcagcatgatttatagtcctttggatatatacccagtaatgggatggctgggtcaaatggtatttctagttctagatccctgaggaattgccacactgacttccacaatggttgaactagtttacagtcccaccaacagtgtaaaagtattcctatttctccacatcctctccagcacctgttatttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatgggattgtttgtttttttcttgtacatttgtttgagtttatcgtagattctggatattagccctttgtcagatgagtgggtcgtgaaaattttctcccattttgtaggttgcctgttcactgtgatggtagtttattttgctgtgcagaagctctttagtttaattagatcccatttgtcaattttggcttttgttgccattgcttttggtgttttagacatgaagtcctagcccatgcctatgtcctgaatggtattgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtgccagtaccatgctgttttggttactgtagccttgtagtatagtttgaagtcaggtagtgtgatgcctccagctttgttcttttggcttaggattgacttggtgatgggggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccctcacgtcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttctcagcttaaggagattttgggctgagacaatggggttttctagatatacaatcatgttgtctgcaaagagggacaatttgacttcctcttttcctaattgaataccctttatttccttgtcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttgtttgtgtctctgcccggctttggtatcagaatgatgctggcctcataaaatgagttagggaggattccctctttttctattgattggaatagtttcagaaggaatggtaccagttcctccttgtacctctggtagaattgggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatgtattttgttgatcctttcaaaaagccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagacattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaagaaatgtatatgctgttgatttgaggtggagagttctgtagatgtctattaggtctgcttggtgcagagctgagttcaattcctgggtacccttgttgactttctgtctcattgatctgtctaatgttgacagtggggtgttaaagtctcccattattaatgtgtgggagtctaagtctctttgtaggtcactcaggactttctttatgaatctgggtgctcctgtattgggtgcatatatgtttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggcttcctgaatacagcacactgatgggtcttgactctttatccaatttgccagtctgtatcttttaattggagcatttagtccatttacatttaaagttaatattcttatgtgtgaatttgatcctgtcatgatgatgttagctggttgttttgctcgttagttgatgcagtttcttcctagtcttgatggtctttacattttggcatgattttgcagtggctggtaccaattgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattctttaagaatgttgaatattggcccccactctcttctgtcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctttgtatttcctgaatctgaacgttggcctgccttgctagattggggaagttctcctggataatatcctgcacagtgttttccaacttggttccattctccccgtcaccttcaggtacaccagtcagacgtagatttggtcttttcacatagtcccatatttcttggaggctttgctcatttctttttattcttttttctctaatcttcccttcttgcttcatttcattcatttcatcttccattgctgataccctttcttccagttgattgcattggctcctgaggcttctgcattcttcacgtagttcttgagtcttggttttcagctccatcagctcctttcagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaggtcgttctccgtccagctttgttccgttgctggtgaggaactgcattcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccatgtgaggtgtcagtgtgcccctgctggggggtgcctcccagttaggctgctcgggggtcaggggtcagggacccacttgaggaggcagtctgcccgttctcagatctccagctgcgtactggaagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccaccttgcagtttgatctcagactgctgtgctagcaatcagccagactccgtgggcgtaggaccctccgacccaggtgcgttatataatctcgtggtgcccccttttttaagcctgtcggaaaagcgcagtattcgggtgggagtgactcgattttccaggtgccgtccgtcacccctttctttgactaggaaagggaactccctgaccccttgtgcttccccagtgaggcaatgcctcaccctgcttcggctcgcgcatggtgcgcgcacccactgacctgcgtccactgtctggcactccctagtgagatgaacccggtacctcagatggaaatgcagaaatcacccgtcttctgcgtcgctcacgctgggaactgtagaccagagctgttcctattcggccatcttggctcctcctggtcctggttgttttcttattgtgcagaagctttttagcttgctgtagtcccgcttgtctacttttgcctttgttgcctgtgcttttggtgtcatatctaaaaaatcattgccaaggccaatgtcgaaaatctcatttcttacattttcttttaggagttgtatagttgcaggtcttacatttatatcttttatccattttgagttttttttgtgtgtacatgtatgtgtgtgatataaagatccaatttcattctttcaaatatggatatttagtattcccaacaccgtgaattgaagagactatcatttttccattttgtattcttgtctgtattatggaaaattagttgactgtagatgtgtgagttaatttctggaatctccattctgtcccactgacctatatgcctgtttttgttacagttccatactgttttgattaatatagttttgtagtataatttgaaatcaagcagtgtgatacctcttgagaatacctttctaaagattgctttggttattcaaggtcttttggggttccatatgaattttaagatttttttcctatttctatgaaaaatatcatttaagttttggtagagattttattgaatctgtagactgctctaggcagtatggacattttaataatattgttttgtgtaatccatgaacatacaatgtcttttcatttctttgtcttcaattttttttcataaatgcttcatagttcttttatgtagagatttttcaccttggttaaatctaagtttttttctttctgatgctattattagtggaaatgctttcttgatttctttttcagatagttcattgttggtgtagagaaacacttaatttttgcattaatttttgtggagtctataaagtttcctacgtacaaggtcatgtcatctacaaaaagagacattttacttctgtcttatttggatgacatgtatttctttttctgtctaatttatctggctaagacttccagtattaggttgaatagtagctttggtttcctttctctttttctttttattttttgagacagagtcttgctctatcacccaggctggagtgcagtggtgcgatcttggctcactgcaacctccgcctcccaggttcaagcaattctcctgcctcagcctcccaagtagctgggactataggcatgcgccaccatgcctggctaatttttgtatttttagtagagatgcagtttcaccatgttggccgggctagtctcaaactcctgacctcgggtgatccacccacctcagcctcctaaagtgctgggattacagatgtgagccactgcacccagcctcctttctctttttcttctatgtaacttctataagtattttctttgtggttattatgggacttacataaaatttattatagtgagctgatagcattttctcttgcatacgaaaactctacatttttatctcatttccccccacattatgtgcaattggtgttgcagttcatatctgtttagaatgtgtgtccatttacataatttagttatagtcatttttaattcatttgtctttttacttttatatttgaaccaaaagctgtttacccaccacctttataacaatgtagtcttctgtttttgtctatatatttacctttaacaacagattttatactttcttatgtttttgtgttgctgtttagaatcctttcatttcaagttgaagaactttctttagcatttttttgtatgtcagaactagtgatggtaacctctcttagcttttgtttgtctgagaaaggctttattgcccccttcatttctgaaggacaggtttgcctggtattgtattcttgattggcaggttttttttttcttctttcagcactttgaatatatcacacactcccttctggcctgcatgatttctattgaaaaatcggcttatagtcttatgagggttctcaggtagatagcaagtagccattttcttgttttcaaaatcctctctttgcttttaacttttgacaatttatttataatatgtccttggtttgggcatctttgggattatcttatatggtgttcttggtgttctttgggcttcctgaatctggatgtcttatttccttccccaggtttgggaatttttcagccattatttctctgaatgagttttctggttctccttctgtgagtttcataatgcatatattgccacttgatgttaccctgtaattctcttaatatatcttcactgttttttattctttttttttcctttttgctcctctgactagaggatttccagtgagctgtctttgactttacttctcctttcttctgcttaatcaaatctgctgttgaaacctcatattgaatttttcagttcagttattgtattcttcaggtctattatttctatttggtatttttaaatattttctatccctttgtcaagattctcacattgttcatgcatttctctcctaactattgtgaacatcttcatgatcaacattttgaattctctgttgggtaaatcacatgtctccatttcattaaggtaggtttctgaagatttatcttgttcttttatttggaacatattttcattttctttgattctttgtgttagtttctgcacattttatagaacaaccacctctcttagtcttcacagactgatgtctataagagtcaatcttcatccattaggctagctagagattctggatgctacctattccttcgtgcttccaaactgccatctgtttccttagtgggcccagggtactagagtatgctaaaccctaagagagtcctaagattggcaagattggagccagtctcttgagtagcagttggaataaatgatgcattaggtacgtgttctaatgcatcaatttattccagctctccttatgcatctccagctgtccttaatgcatattaatgtccttaggaagaagctgggaactggagtttatcacccacttgctctgcactgagccaggaagaggaactgtggcaaatgcctgtaatgctcactcagacgcaggctgttttaaatcattgctttactctttgtcacctctagggggtctagtaaatgctaggccctcagttcttggaacagacaagctagaggccagtccctctggtagcgactagaaaatttaaaggtctagatgggtagtttaagctcttctaaggagaagctataggcttggttttatttctggaatgatttgtggggaggagccctgggaagtatcctcacattcatttaaactcccagtgactagtgactgcctgccctgttagctccaagaaacaggcaagtcagaagccagatccatgggtagcagctggaaaagtcaaggtactagatgtatagtgtaacccctcccagggagaatctgagagctgtgcattttggtaaaataagctggcaggaggagtcatgggacgagcctgcaaggccattcaaaaccactgctttgttctctggagactccaagtgaccagcgaatattgggccctatcagctccccagttaggtgagttagtaactacactcccaagcagcagatgaaaaaaatcagagcatttgttgtgtagtccaactccttccaggaagaagctaaaggtttagtttctttgccagagtgagctggaggaaggagctgtaggaagtgcctacatacccatttaaactccctggggactagtaattgcctgccctgttgacttccagatacaggcttgttataagccagacccttgggcagcagctgaaaaagtcagggcttttgatgtgcaatctaaccccttctagggaaaagctaggagctgagctttgtcacctgctcactgtgtgctaagccagtggggagaagcatgggaaatgcttgagtgcctgtttaaagctgcctctgttctctgccattccaggggtctaataagtgctgggccccattggcttccagagataggcaagttaggaatcatttcctctggtagtggttttaaaagttggggtattgtgtgtacggttcaaaccctttactcctcagggagaaactgagagatggaggttcccctcaattgtatagtgctgggctgagggtagggtttatggtgagagtgagaatatgtctcagcttttcttactgttgcacccgagcgagttagggaaacgccacatttgagacaaattaagagtcctttattagccgtggacggagagacagctaatgcccaaagttctctcggcccctaggaaggggcttgattaatttttataccttggtttaggaaggggaggggtctagttagaacaattttacataagttaagtagtcaaaaagttaaaaggataaatggttacaggaaagtaaacagttccaggtgcgggggctttaagactattacaaggtgatagacgtggggctttgggcattatcaatcagacgaattcttggggactgcagatatagcttgccacagtatcttatcagttaattgcattcttggatgtgctgggagtcagcttgcacaagttaagtccttgaggaaggggctgccagtgaaagagccaggatggagtttgtctggttctcttagctaagggagaaacaaggctaggtgaatgaaggaaaaaacaaggttgggcattacattacctgtgctgaagtgggaattttctcagccatccgacatacagaaatctctccactagtttctgtatttttctcagaggatgtcgattcatgtatagctgtttatttgatgctctatgggtggagtgagagttctcagcctcctattctgtttttttgctgaagtactcctgcatgtttggtaattttttatttatattagacattgtgaatttttttttttaggtttcagatacttgaatttctataattttcttgtgatttgttctgagatatagtaaattaactttgaccaagttttatcttttaaggtcttgcttttaagattttttagttgggacaggagcagtgctcagcttagggctaattcctgctactgaagcaagtcccttacatgtattctacacattgccccataaatcttaaggttttccagtttgactggcgtgaacagaaactattcttattcttgtgtaaatgcccagaactgttatctgtaattgtttccagatcattctttccttggcctcaggtagtttcttcacataaatgtactgatcaatgctgagctgaattctcaaaggcaaacttctgagttttcttttgtgcagatttcttctctctgccgtattttcctgtgaattctaactgcctggtctccctggactctcaactctgtctctacaacttagagagtctgctggatttcacctgagtttcctccctacaccatggcctggaaactctctcaatgctgtaacttggggcagttgtagggctcctcttacttgtgtccctccctcatgtatcactgttcctcattgcctgacctctagtggcctgtaagttgttttattcagcattacatattttaaatttcaggtttctgggtaaatttggtctctattactccattttggccggaaacacaaatgtgtcacttgattctggtttgtatgttaactatgtgattagcaaagcaaatggcagcagagagaaaaaagggagatgatatggctttcagaaaaaaaaatgacttcaagaaaattgtaaataaaatgagaaaataagtgcaactcaacttgtctttttaccaggcaaatacatacggaagtaccaaaaatgctttgctttctttcttaggccattataatagattaggtgaattgaagatactgaaagggaaagatgaaataacaggataaaaagagtaagttaaaggatcacaggagagaaagaactaatatagcttggaagtgaataaatatgtcattgaaatttggaactgcaatgggaaaatttgagggagggattatgtttaaaatgttttttggtgtgtcttatgaagagaacataaatgcaaatattcccatgagattaccagtcttccagaagatgggctgagaacaacataagaagagcagggctgggagagaagaaaagattctcaactttatatagataacaatgagcaatgagggtattttgtggcccttcactccaaattattaaacctagtaccttatagaatatttattggcttcagaagcctcgtgattatatttcctttacgtattagtatatcaaactcttgatagagtttttaaaaatattaggaagcaaagagaatgaaggaaaaccatgaagctgtgagcaaggatttggctgttccttcacagaagaaagaacttagattttattttcaatgtttgagagacactgttaatgtacttgcctagtggattcttcctgcctgctgcacagacaaaaccagttcactgagaccaaggcattgcagtaaagaatttaattgatgaaggcctgctatgccacatgggagacagagttactactcacatagtcccctgcaaaattcggagactagggtgttttaaggatagtttagtgggtcgggcggcggggggttagaggaatgggttcttttgattggttgggggtgcaatcgtaggggtgtggaaaatggtcctcaaccactgagtctgttttctgggtgggggccccaggacggactggtggaaccaagagtccagggtctgggtggtgccatcagattgtcagaaatgcagaagcctaaaaagacattttaaaaggccaatcttagattgtacagtagtgaattggggaagctgcaaatcttgtgacctccagaataatggctggtaatcgtttaactatccctacatcttagcagaattcaggcccctctcattttcctaacctgatgacctttcattagtttataacagtagtataattttgggaaatggctattttcatttaaactataagctaaatttattccaaagtagtttggcccaagcccaggaatgaccaagtacagtttgaaggttaaaggcaagatgagagttggtcagatcagatctctttcactgtcataattttctcactgttataatttttgcaaaggtggtttcactagtaggtggtgacctcttctttctctaaactgtcttctttgcattcttggctgaaagagagaatgtgtattactctagagtctaccaggcaccattccaaactgctatggtgaaataaagagatcactctgtcaagaatagaagtaaaaccaactatataaagaaatgagagaagcatataatcctcaggatggtggtaggtattacagaaaatctaactaggaaagttctagaggtctttttacattttaaagttattgccatttgcctaacagaacagatgtaaccccattagcctttaatgaagaaagaccttcatttggcttattctccaagctttgtcaaatattcgtatgcattaagtttagatatctgatttgaattaattttcaaggtttgtcatgtaacaatgcctggtatgttcttgagaataatgccagttgaattctttgagcaagttgacaacctctgcctcttcagtaacactcaatcacactttccacagaaattgaaatatgaaacagcatcttgtaatatgtatgtgtatcaaaatgtagtagcaaaatgtatttcagaatctataaatatagatttatattctgacccatgaagaactgttataaattggttttaacagaaccaatcaaaattttgtcacaagagaggaaggaagcattttgctcaccatttgtaataatcatttatttgtccccaaacatttcttgagaagcttctatcaccaagtgtttgttctctaccctcaagaatcttgagtaagcaattatagggcattttccattccatagtagcaactggattttcaaagaacaatatttctttttcattcaatttcagaaagatgtaggccaattgttaaggaggtgtgcttatactttggtacccagtgacttgaagaattctataattttatagttttatgttggtacaaattctatggaagctttttcataagtatcaaggtagtaaaaggtcattcctatataatttttaatataatcattgtcatttatatatattattggagaaaacacacttctgtaccttccatccttactattctgaacttttaatgtcctttgtaaagtgagcccttaatagcagaacctcttccagtgttgccaagttctattataatcatgactattttgattcttctctcatcctagaaatttacttgtgttatgaaattcaaagctaaccctttggttgtgcctattgattgagccagacttgacatttgcttctgttcaggaaaaatgcttttgctgccaaactaatatctctgcacagtaagaagcaaataccatggaaatgaaataaatacttcctaaaatgactttttaaatgtgaacatagaagaatggaagctcatccttcttgaagtagtcagaaaaagtcaaccatcaagctgtttcccagtacttggagaaaaatacccattctgaacataaatgataaatctctctctctgtgtgtgtgtgtgtgtgtgtgtgtgtgtgtgtgtgtgtgacgaagggggccacaaggccaggttcatgtcctcagtgtggtgccccatgctcaccattcctccatgtggtatcccatacccaactctctaagaatcagtccttcagatgttacaccttgacacctcagtacattagaattcagtagttgaaaaacaaattaactctgtcattgtaaaatgtctgtcatattacatgagttcctgtgccattagctttctacattctctttttctatagatccaacattttctctatgactccattgggtggctcccaggtcctcattttgaattttgtcttctctgacctttggtcctgcatttcttatgatcagaaaagcccttatcacaaactcatccaccaagtatgcattttgttaaccccaaagaaaaggtatttctctagatttctttatgtcttccagttacaccagtcacttttcttcctacatggtgtgaacctttgaaataatctctaatttgtttccttttcttcaccctccatatcaagtaaactaagatctgtcctaaattcttttccaaagtctccaatttgcagcattctttccattccagtgctgttgccacttagtgctttctcgtcaccctggaccaaatctccacacttcgttagaccatcaatcacagatcttttctctggctgctccctttgaattgtttatcctagattcggttttgttcctaaacctacccaaccatccgcctttgcttgtaggttgtttctcaattccattttctccaccctcagcttctaaggtccagtgactttccacacctaacattggcccctcatttgtcagagaagggtttagactatatttttttacatagtttctatacaaacatgttttaaatgttgtcttgcagctgtcaatttcttacccagcaacttttaataactcctcactgtctacagcataaagtccaaattctttaacctgatacttaaaaccctctactaatctggcctcaatatacctctctaaatttatcttctcttgctctcaaatcaaaacttatattctgaaaaccttgtctctcagacataaaatgtgaatttagtctccagatctttgtatatgccaggagatctcgctaggatattgtccccattcctttccacttaactgattcctgcctatccttgaaattcacaccagagcttctattctctatgaaattctatttcacttatccacaataatccacccattatactctcctgccttacttattatgtgactcacccatgttggctcttattatatgctaccttttcttctttttttgactttattttttaatttacaaataaaattgtatgtatttaccatctacagcatgatgtattgaattatatatgcattgtggagtaactaaatatagctaattagcatatgcattacctcacatagttatcatagttatggtgagaacacttaacatccaccgtcttaccatttttcagtaacacaatacaaatggtccctgatttacactggtgtttgacttacagttgtttttttttttttttttaactttacaatgggtttattggaatgaaacccaattgtaagttcagaaacatctgtatactgttattacctatagtcatcatgttatacaatagatctcttgaacttacttttcctgtatagctgaaattttgtatcctttgaccaacatctcccatctttccttcctcaactgccccagcccctgataaccttaccttcctactgtctactttatgacatgaactttttaagattccacatgagtgaactcatacagtacttgttgttctgtacctcgcttatttcacttaacaaaatgctctcctggttcatctatatcgttgcaaatgacaggattgtctttattatggctgaatagtattccattgtgtaagccacattttccttacctattcatcttttgataaacacataggttgatttcatatcttggctattgtgaatgatactgcagtgaacatgggggtacaaatacctctctgacatgcttattttattttcattggatatttatctagtagtgggattgctggatcatacagaagttctatttttaatttttgagtaacatttatactgtttgccataatggctatactaatgtacattaccaccaactgtgtgcaaggattcccttttctccacaatcttgccaatatttgctgtcttttgtccttctgatcatagccattctaacatgtataaggtgatagctcattgtagtttttaatttgcatttccctgatgattaatgatgttgagcattttttcagatactcattgaccatctgtatgtcttctttaaagagatgtctactcagatcctttgcccatttcaaaatctggttattgttttcttgctattaaattgagttccttatatattttggatattatcccttaatcagatgtaagtttgcaaatattttctcccattttgtacattgtctctttattctgttgattgtttctttttctgttgagaagctttttagtttgatgtaactccatttgtctgtttttgcttttgcagcatgtgcttttgaggtcatttcccaaaaatccttgtccagaacaatgtcacggagctttcttgttaggttttcttatagtagtttcatattttacaattaagtctttaatcaattttgagggagttttttggatatggtgtaagataaaggtctaattttattcttctgcatgtggatatccagttttccaacaccatttgttgcaaagactgttctttccctatagtgtgttcttgccacctgcataaaaaaaattggttggctgtaaatgtgtagatttatttgtgggctctcagttctgttccattggtctgtatgtatgtttttatgccagtaccatgctgttctgattacttaaggtttgtagtatattttgaagtcaggtagtgtgatgccttcagctttgttctttttgctcaatgttgctttaactgtttggggtcttttgtggtttcatatgaattttaggatcgtttttcctagttctgtaaaaaatttcgctggtattttgatagagattacatagaatttgtaggtcactttgagtaatatgggcattttgacaatattaattcttccaatccataagcatggaatatctatcaatttatttgtgtcttcttcaatttctctcatcagtattttatagttttcagtatagagatcttttatctttgttagatttattcctaagtgctgtgttattttggtctctattgtaaattgttttcttgattttttactcagttcactgttagtgtgtagaaatgctactaatttttgtatattgacttttcatcctacaagttaacggcatttgtttattatttctgaaggttttttagtgaagtctttagggttttctatataaaagattatgttgtctgcaaatgggagcaatttaacttattcttttcagatttggatcccttttgtttctttctcttgcctaattgttttgctaggacttccaggactatgctgaatagaagtagcaaaactgcatatctttgccttgtaccagatctttaaggaaaagcttccaacttttccctattgagtatgatgtttgctgtgggtttgtcatatatggcctttttatgtggaggtgcattccttctatacctaatttattgagggtttttatcatgaaagggtattgaattttgccaactgctctttttgcatctattgaaatgatcataaaagtttttgtacatttatagtagtcctctcttctatgtggaggatatgtttcaagactgtcagtgaatgcctgaaaccatggatagtactgagcccaattaccagtcagaccatgtttctgttcatgtttgcctgccacacacacaaatgtaatgccttttccatcttaactaagcatgtgtcatgcattgtggccataacttttgcagtttaagatctgtcagcaaaactagcaagggtttccttttccttcttcacaatttcacagataaacgattcattcttaccatagaacttagcagccccaccatgtgatttttcttctttccttattgagaatgtgtaccttttcacataaatgaaacgttttacagtttctctttgacataagcaaattgccagcatcactactcttgtgctttggggccattattaagtaaaataagggttacttgaacagaagcactgtaataccacaacttttttttttccttgagacagggtctcactctgtcacccaggctggagtacagtgtttgtgaatgcagcccactgcaacctcaacctcctgcgatcctcctgcctcagcctgccgtgcagctgggaccacagcgtaccctacacacctggctaattttttgattttttgaacagaagaggtctcactttgttgcccaggctggtctcaaacccctggcctcaagcaatcctccagccttggcctcccaaagtgttgggattgcagacatgagccaccatgcctggccaatatcacaacatttgatctgataactgagatgaatactaactgactcatttgtgggtagcatatacagcatggatatgctggacaaagggatgattgatgtcccaggcagggtgaagtgggacagcgcaagattttatcatgctattcagaacagggtgcaatttaaaacttatgaattgtttatttctggaattttgtgtttaatatttttagatcacagttgactgtgggtaactgaaactatggaaagcaaaaccttggataaagaggggctactgtattgatttgcgttcatgggactatctttgcatctctgggatgaatcccacttaatcatagtgaatggtctttatagtgtgctattgaatttgatttgctagtattttgttgaggatttttgcatctgtgttcatcagagatatatgactatagtcttcttttttttagaccagagtttcgctcttgttgcccaggctggtgtgcaatgtcatgatctcggctcactgcaacctctgcctcctgggttcaagtgattctcctgcctcagcctcccaactagctgggtttagaggcatgtgccaccacgcctggctaattttgtatttttagtggagacggggtttctccatgttggtcttgctggtcttgaactcctgaccttaggtgatccgccctccttggcctcacaaagtgctgggattacaggtgtgagccaccatgcccagccagttttcttttttcaataacattcttatctggctttggtatcagggtaatgctggcttcataaaatgagcctggaagtgtccctctcttcagttttttgcaacagagaaaaaattgctattagttcttctttaaatgtttgttacaattcagcagtgaaagtaaaaagccctgggcttttctttgattggagacttctttattactgattcaatctccttactcattattggcctcttctgattttctgtttcttcgtaattaattttttgatagattgtagatgtcaaggaatttatccatttcttttgggttattctatttgttgtcatataattgttcataatagtcttttatgattctttgtatttatgttttaccagttataatatcttcttttatatttttgattttatttaagtcttctcttttttccttagttagcccagctaaaagtttgtcaattttatcttttcaaaaacattaattcttcatcaatcttttgtactgtttttctagtctttatttttcttctctaatttatttattattattattattttgagatggagtctcactttgtcgcccaggctggaggtaatggcacaatcttggctcactgcaacctctgcctcctgggttcaagcgattctcctgcctcagcctcccgggtagcgaggattacaggtgcccgccaccacacccagctgatttttgtgttattagtagagatggggtttcaccattttggccaggtggtcttgaactcctgacctcaggtgatctgcctgccttggcctcctgaagtgctgggattacaggcgtgagccaccgcacccggtgtcttctctaatttttatttccttctattaactttgagcttcatttgttcttgtttctctagttccttaaggtgaaacattagattatttaatttcttcttttttgatgtagatatttattgctataaacttttattccatgtttttgtgcgttgtgtttccatttttgtttgtctcaagaaatttttacatttctcttttaattcctctttgaccctttggttgctcagaagggtattgtttaattttcatttatttgtgaattttctgaaattccttctgttattgacttctagttttataccattgtggacagaaaagatacttgataagattttagtttttttagatgctatggtttaaatgtttgtctcctaaactcatgttgaaatttaattgccattgtgacagtattaagaagtgagatctttaagaggtcattaggtcatgagagcctttccttcatgaacagataaatgtcattatcatgggaatgggtttgttattataagagtggattccttataaaaggacaagttcagctcccctttgtctctcttaccctcttcttgcccgtctaccaggggatgacatggcaagaaagctcttgccatatttggtcccttgatcctcaatcttagacatcccagcctccagaactgtgagccaataaattgctgttcattataaattagccagtttgtggtattctgttataatagcacaaaataaagtaagacattagatttattaggactttttttgtggcctaacaatgatcttttctagaaaatgttccatgtgcagttgagaagaatgtatatcctacaactgatggatggaatgttctgtttatgtctgctaggtctatttggtctattgtgtaatttaaaccttatgtgtctttattgattttctgtctgccaatagtgggatgttgatgtcccctacgattattttattgcagcctatctctctcttcagatctattaatatttgctttctatatgtagatattcccatgtcaggtccatatacatttataaatgttatggatataacaactgtggaattgatccctttatcctcatatgatgaccttctttgtctctttttacgttttgacttaaagtctattttaacatgtctaacatgtatagctactcctccctcttttggtttatatttgcatggaatatatattttttcatctcttcactttcagtctgtgtgtgtccttacaagtgaagtgagtctcttgtaggcagcgtattttttatccattcagccacttatgtcttttgattggagaatttaatccatttatattcaagataataattgatagatacaaatattctactaacattttgttaattattttttacttgttttgtagaccctctgttcttttcttcctgtcttgctgtgttcctttgtagttaagtgattttctctggtggtatgtttttatttcatgctttttattttttgtgtatctactataggtttttgctttgtggttaccatgaggcttacagcaaacataggtatagatagtttatattatattaaggtgataacaactgaattttgattgcaagaagaaaactctgtacttttactacactctcctcccacattttgactctgtgtcacaatatgtattttcttatattgcatatcccttaacaaattattgtttctcttgttatttttaatagtttttcttttaaccttcatgttaaaaatgttagtgatttacacaccaccattgcagtattagattattctgaatttgactgtgcacttaactcacttttaacagtgagtttcttagtttcagatgtttttgtgttactcgtgttaaaataaagatttaacacaaattaaatttaatacagtttaattgagcaacgaacagttcacaaatcaggtaggcccctcaaccagaatagattcagagcaactttatgctgctgcatgattggagaggatttacagacacaaaaaaaatagtgacgtacagaaaatggaagtgaggtacagaaacagatgaattggctatagctcagcatgccacaattgagcacaatataaacagttggctaccttttattggccaaagcttggtgataggtatgagagtaggttacagtctatttacacatcccgataggttgctgttcactatgtatgaaggaaccattaggcagaacttaaaatatataaggagacagctttaggctaaacttaattttattttcattagcatccttttctgtcagcttgaagaactcccttcagtttttcttgtaaaacacgtctgatggtgatgaactccttcagtttttgtttgggaaaatctttatttatacttcatttctgaaggacagttttgctggatacagtgttcttactttgcagattttttttccctttcatactttgaatatatcaacccactctctcctgatctgtacaatttctgctgagaaatttgctgctagtcatattcgaaatccattatgtgttatttgcttccctttctatcttcagaatcctctctttgtctttggtttttgacagtttgattacaagattactttgggtagctttgtttggattgaatctgactggagaccattgatcatcctgtacctggatatttacatttttctccaaatttggaaagctttctgctgttaaagtcatgtgttgcttaatgatggagatatgttctgagaaatgcattgtttggtgattttgccattgggaaaacatcatagaatgtacttacacaagcgttgatggaatatatcccctatgatgctcctaggcggtaaggtatagcctattgctcttaggctacaaacctgtatgacatgttactatattgaatactataggcagttgtagaacaatggtaaatatctgtgtatcttaaccgtatctaaacatggaaaaggtacagtaaaaatatggtataaaagataaaaaatggtatacctgtataggaacttaccatgaatggagcttataggactggaagttgctctgggttagttagtgagtgagtggtaagtgaatgtgaaggtctaggacattactgtacaccatagactttataaatactacacttaggctgtactaaatttataattttttcctttcttcaatagtaaattaacctcagtttactgtgacttttttactttataagctttgtaatctttttagcttgttgactcttttgtgataacatttagcttaaaacacaaatacattctacagcagtacaaaaatactgttttttttaatattctgtaagatttttctatttaactttttttttcctttttaaacttttttgttaagaactgtgacataaacatgcacattagcgtaagcatacacagtgtgagggtcattaatatcactgtctttcacctccacatgttgtccccctggacggtcttcaggggcaataatacacatgaagctgtaatattctatgataataatgccttcttctggaatacctcctgaaggacctggctgaggctcttcattagaaatgtcacacttttcagaaatatgtcgatggccgtttctttttttcatcatacattcgcttgtaagcagataatgtactacagacattcctttctattaatgaaaacattttggtgttaaggttcattttcaaaatttttatggttgctgttgaggtctgaaaaatatttttgtaaacttttcacttttcattttcttcttcagctgtgtgttcctgtttcaggtttaacaactcttcattagtcagttcctcaggaatcacctctagggattcctcaatgccatcctaattccaacccaggttaaatttggtttgctggccgggtgtggtggctcacgcctgtaatcccagcactttgggaggctgaggcaggtggatcacgaggtcagaagttcaagaccagtctggccaagatggtgaaaccccatctctactaaaaatacaaaaattagcagggcgtggtggcaggcgcctgtaatctcagctacttgggaggctgaggcaggagaatcgcttgaatccggggggcagaggttgcaatgagccaagatcacatcactgtactccagcctgggcgacagagtgagaatccgtctcagaaaaaaaaaagaaaaaaagaaaaagttggtttgccatctcaaccatagccttgttgacatttgtagcttcttcatccttaccaaatcctttgatgtcatggagaagacgcttgagtgttttcccgaagtcattcatacactccttggtgacataactctaagcccaagcaaggttcttgacgcagtcatagatgttgtaatccttccagaattgcacctgtgtcttctcagtgcctcctttagttgcagcaatagcttggataaaggtcttcattaggtagtaggcctcaaaagctgctataattttttgattcattggttggatcaaagaggtggtattttgagggagaaacacctcttttatttgggatgaagatcaccaataaaaggagtatgtgcagaaacattattaatgataaaatcttgacagatatgttattctctaaacaggaatttttcattttgttggcattgcaattcaggagggcactttggaagaggagctgggtcatgcatgacttcttattgttcctgtagtacactggcaatgtgtgcttattgatattgaagactctagggttctcactgtgcagaacataatgggtttcaatttgtagcctgcaatattgcccccaagcaagactcttatcctgtccttgaatgccttgaaatgtgatgttaacttagcctttttatggatgtaagtcctttcaggcattgtttccaccatagggaggtttcatccgtattgaagattcactctgacaagtaattttcctccacaatcagcttatctagagtttctaaaaattcttcaactgtcttcacatcagcacctgcagactcacccatcactttcacattatgtagtgaataaagattcttaaatcatttaaactacctagactagcagtaaattcagcatcatagtcacatctagccttttctttcaacgtcacaaactctttgctttgtctgtgatcattgtggtcctgagagggatacaattctatgcctggttttcaatccaggtcattagaagattttttcatatctgatataggcccttcttgagtatttgttagtctagttgccttcaatgaagtagatcctttaacagattccatcactttgttcttgttcttcaagagagataatagctgtggctgaaagggacaggcctgactagtgagcaatagtcataactgattttccacctttgtagtccttaattacttttaactttatttccaggtcaatcacttgatatggcctcttactggtaacattagcagtggattttgtatgcttaggggccgtgatgaacaaaataacttgagattaagtcaagcacaagagaaaatgatgcatcaatgagacatagtaatcatgagatgtatgtggctgctgctggcataacactgcatcctgttgtacagtaaactttttttaataagtagaaagagtacactctaaaataacaatcaaaagtatggtaaatacataaaccaatatcatagtcatttattatcattatcaaatatataatgtacataattatatgtactatatttttatatgactggcagtgcagtgggtttgtaaacaccaatagcaccacaaacatgtgtaatgtactgcagtatgatgttacaacaactgtgatgtcactaacttataggaatttttcaactctaataatcttatggggccaccatcatacatatgatgcattgttgaccaaaacatcattatgtggttcatgatagtatgtctttaaataagctttctacccttttatcttttttactccttcttaaactcctgagactcaaaatttaccctttaattctattctgtgaatcccataagctttctttattccttttcattcttttttcccttacattgtttttatatttattattttaataatatatttattatattatatattatattaatatataatatataattaatatataaatgtataagatattaatgtatttattatatattatattaatatatttattatatttccccttatattttcaaattacctgtcttcaagttcataagttcttctgcttgatcaattctgctgttgatgttctctgttccatttttcattttgtttttgtgtctttcagttccagtatttttgtttgtttttttaaaatcatttcagcctccctgttaaatgtcttattctggccacttattgttttccttatttcattgaattgtttctctgtattttcttgaagtttgctaagcatcctcaaaacaattattttgaattctttgtcaggcagttcatatatctccttttctgtagggtcagtcactggcacattattttgaccctttgggaatgtcatgtttgcctgattatttttgattctcaaggtcatgcatcagtgtctgtgcatttgaaggatatacatgcttattccagtctccacagactagctttgtctgataagtcccttccacattcatcttacccagagattctgggcagccatctggcatggctccaaagccccagtccactgtggctgatgtggtgttggggtatgcatgaagcctgaggcggcttcagcaggctgaaagcctttggcagctgaagcctgcctgccactgagagctgtctggaatctcctgccactgagagctgtctggaatctgaggctgctgaagtctgcatgatagtggtgtgaatcagagactgagtccacctagcaggcataaagctggaggctacaggatcctgcctggtgctggggcaggtctgtaggctcagtttgcaagtaccaggctggcatctagggtcatgagggcctgcctggtgctggattttactttaatgagcctggtgttaggatccaaggaaaagtcctgtgcttgcttcccgctccttctccccagttaatggtaactctctttgtactgtgccacctggcattggtgatgtgggtaatataaaactgtcccttttgccctcttcaatgtgtattttcttattattgtgctacaaccaggttctatgattgctccattgttttccttagctcttatgaaggtattttcatgcacggttattcaaattaatgtttctctgggaggacaattgctggagagtcatattctgccattttgctccacccctctcttaccttttattcctatttactttttgattgatgtattctatctcctcattctctctctatcataatgatctggcatagtgctttgcccatcatttgcagttgcttatatgatgttgaccaaagtagttcctttgccattcatccaggaaactgtatcccacccacgtaaaaatagtgtagaaggaagaaaatagcaccattatcgctctcattctgaggggctcatctttcagaaactcacccgaagaaattttagagtactaggaaaatctatggcagcatctttaatgtatctgacgatgaaatatcgtgatgtgaatagcaggaataaaacttaataaatattattttatccttggcctaagaatatgaagatactcttttattccttggggtcttgacctactttgtcatctggccaaataattctttgtctctgagaatacctttcttagtccatttgtgctgttataactaaatatcacaggctgggtaatttataaataatatagatttatttctcacagttctgaagattaggaagtccaagaacaaggtactggcatttggtgtcttgtgagggccttattgctgcaccctcacatggcaaaaggggcaaatgctgtatcctcacatggcagaaggcagacaggcaaaaaattcctaagctagtttcttgtagccctttcattaggcattaattaattcatgagggaatagccttcatgatgtaattactttctaaaagaccccccatcttttaatactacaattggggttttcaatataaatttgaaactatggggttttcaatataaattttggaggagacacattcacaccatagcaacatctgttcctggttttatctgcttgcctttcaggaatcattcctgctctagaaactgcctagtattgaaatgaccccttttggtttcctggcttctgagtgccacactctggcttctgattcaagctcctgcctctgccaccttatctacctctactcctctcttgccaccagatctaaccgatgtaccatcagcattataatatccagttgttaaacactgtgattgctattcagagaccattgctcagtgttatttgtgattcacagtttatggaatctcaagaatttcttcaattcctgaagtgtattttaattctggctcttctgtctcttggtacacgttcttgcattctcatactaaaacaaaatattcaactaatctcagagtagatatatcttgcagctttaccttccaatatttgtaatatgcacaaaaggtataatattctctgatatgcgcctttatttaggattagctggtgacatctatggaattctcatggcagccatcttacctagaacttcggctgtctgaagccagttctccagtgctgtcatattcctttataagtcaaagaagtagtacagctctctttttgcaattttttttttttacttttcttaaatatgaagcgcagaaacagcaagttggctatatataattcattgttgtcagaaatcagagtatccgaatgtgaattgtatagtatctaactgattcaggtggactttagtgacgctcttgctagtggtggaagtcatgcgaaggtgttctgagagctttcataacccctgggaaacttgcaggtgatggggtctctccccttgaatccatccttcatctgtgagatttagcacctgcttggagcaagtggcatcaatgaaaatcaatattcatgacagaagcctttctctttttccctgttcaatattatctctgaacattaagaaaattaagcataggaaaactggatatccactggcaaaagagtgaagttggacccctacctcacattatatacaaaaattaactcaaaatagaacacagacataaatgtgagagctaaaactataaaattcttaggagaaaacataggtttaagtctttgtgtccttgggttaggcaatgatttttttagatatgttaccaaaagcacaagcaaccaaagaaaaaatagatatattggattttattaaaattgaaaatatttgcacttcaaaataaaccataaagaaagtaaaaaggcagcccacagaatggatgaaaatatttgcaagtcatgtatttgataaagttctaatatccacagttataaacatttcttacaactcaaccattaaaaaaaaaacaaataacccaattttaaaatggacaaaaattcaaataggcatgttctccaaagaagatatacaaatggtcagtaagcacaaaaaaagatactcaacatcattagccgtcagagaaacacgaatcaaaaccaaagtgagatatcacttcatattcactgggatgctataatcaaataaacagataataaaagttgaggaggttgtaaagcaattagaacgctaatacactgctagtgggaatgtaaaatggtacagacactttggaaaataatttgacaggtcctcaaaaagttaaatatataatcacctgccatgtgacccagcagctccactcctagatatgtattcaagataattgaaactgtctacacaaaaatgtgtacagccatctctccatatcctcgggggattggttctaggaattcccccattcccagttactaaaacctgagtatgctcaagttctttatagaaactggtgtaatatttgcatataatctatgtacatcctcctgtataaattaaaacatctctgtattataatacctaatacaatgtaaatgttacataaattgttatactgtatttttaaaaatttttatttttaaaaattgtgatattgtttatctttgaatatttttgatcagcagttggttgaatatgcacatgtggaacttgtggattcagagggccaactgtatacaaatgtttgtagcagcattattcataataacccaaagtggaaacaaacaaaaagtctaacaactgatgaatggattaaaagtaatgtataaccatacaatgaaatcttatccatcaatagaaagaatgacataatgatacatgctacaacattgttgaatcttgaaaatgttagactaagtaaaaatagtgagacaaaaaggctacatcttttattattccatttatttccaagtaagtagaaaacatattattagtggttgtcaagggctaggcgaggcgggaatggggagtgactgccagtaggcacaggatttttgagagggtaacgaaaaggttgtgtaattagatagtggtgatggttgcacaattttgtgaatatactaataaccattaaattatacagtttaaataaggaaatttcatactgtgtgaactttattttaacaaaaaaattaaggcagccttgatcttaagtctctggtcaaccacctctgctgcttctccgtgcctttcataaccagctccccatccagtccttgacatgtcaaaattatttttccatttaaatttttggcctttatttttcaaggtaactagaaagtttctttgaaatctagtgggttttctttaggccttcatcacatgtaggcacaaaacagtgcctctcctcttatttcaggatgtagatgcaatgattccagaagctaacgatccattgtttatggtcctgaaaggaatggagctcttttcagaacatgtggagaaagccagggcattccagcttagtaaataactctatgctttgcaagaattattcatagtactaaaaatagtacttaaagttttcataacatcccaaaatatcattcacgtttttctcaaaatttcctttatctttgaagtgagagaagagccacatagaatatattttttagaattccattggtaatgtacatgtttctcatgcttttatttgggagtaagtttgtataatcctaactttcttcagctttagtagctatcgtagatcatccttatatcacacttggagcttcacctttttttggataatacaactttataagtagctagcaaagccatgctaaccttattgtgagtggatagacaaaagtgtcaattgaaccagaaatggaaaggggaatggggacagtgattcatacaatggagtagttttcttcttgtgattcataatgtccaatcaaggacaaatggacagaacctgggtggattggactatgctagtgttaaattggaaatctttgcaccttgagcagtggcaaataaccttctcaaacttcaagtagctttattttttattctttagtaagacctgatttttcttttcagaagaaacatttcaactttcttgcaatatggctttgctcagccagctttcccagccaagttgacaggacaaggtgaaaagaaactctcaggggaaagtcaaaccctagctctggggagatgttggctccaggtcacttcaggacaagaccaagtcagcttgtcaaggatctgtggttccactgcccggtctggaatcatctgtctgactttttagttttttatctagcaaaggttcttgagccagtttcttaatattttgtataccgcaatctactttctgtagccctcttcttctcaccttttccctcatctctttacctggcttgtttcatagaacttcataatgaagttcaaagacgtctgcccattcagtggcactaaagcctctagaatagcctgggatctgatggcagggtggggaagctcaaacaggtctgcctaaacaatgaagttttcatctctccactctatctagtatttttaagccagtgatactcaacctttagcaggcatcagaatcaccagagtaaggggttgtggggaaagggggaaggtggacaagcttcctaaaacagattgccagaccccaaccctgaaatttctgactcagtgggttggggtggggactgtgaatttgccttctaaccgtctcccaagtggcactgctgctggtggggtcaggcaccacactttgggaatctctgctctaggatttctcgaattttggtttactcttggcacaattaatccaaatatatgaagctttattgtactgcataggtgatattgaatgtttgttttcccacggttacttaaagcattatagttcagtaattttaaagtttcaataaacccttttattttaccaaggtgaaaatacaccacatgattttaaaatgatgccgtgtcaaccaggacatacataatttgagtctcaatttatatttctacattgtttctaccttttctccttctcttcccttttttcctctctaccttcctgcctcaaacatttatttagtgcctgctatgtacctgacgctaaactaaggcccagggtatggcataaattagtaagggataaataagtatctttgcagtctagtcatgggtgagagacatgaaaaagaagtgaatacggtcatgtgtcacataatgatattttggtcaatgacgcactgtgtattatggtggtcctgtatgattataatactgtatacttactgtaccttttctatttttagatacacaaatactcaaccattgtgctacaactgcctacggtatttagtacggtaatatgctgtacagggttgtagcctaggagcaataagctatcccatctagcctagacgtatagtaggccataccatctaggtttgcgtaagtgcggtctgtgatatttgcacaatgacaaagttgcctaacatgcaattctcagaaggtgtgcccatcatgaagccacacatgactgtacagtgacatgtaccaagggctatggcagcagtatctgggtgtacagtgaacagggcataagctatgcaggaggggtggtgggatggcaggaaaggtagcacagagtcggaactgaggaaccagcatagagtctgcagcctaactagaaggcacgggaactgcagtggtatgaatgccacagtgttgtcttgctcttcctcctttgcttagtttaacttagagaaatccctaagcaaaaggtctttgctatgaaaggacgacaccttctggtcatcctttctggactggctagggctgggagtgattgtatggtacttaactcagaaacataatcctttcattatgtcctaacaatctaaaccaggctacttctcaataattctttctcatgcttctaaaatgaccacacgtgcttggaccactatattaggttttaagaagcatgcctcaatgagtggatggtcataaggcattagagaacacgcaggaaaacaaggtttttaagtatagtttcaaagtttttaagtacatggccctgggacttactcttgcatagagccaaagcccaactctgtcactacctttgtgattttggaaaatttcttaacatcacttgaacctcagttttctcatctgtaaaattggaatatgagataaaattttaatgaggataaaataagatgatgtatgaaaagcgtctggcatattgtaagtccctggttactaaaacagcagcaaaataggcacaaagaatagaagcatttgatataaatgcagcttcatccatccagagatcatatggaaagatacagtaatctaccagtaccctctaagaagtgttataaggaattgctttaaaattataaattatttgagacagattcaccctcaagccagaagaaccacaagcttatcagtgtgtcagatgatcagtacattgggaaaacctaatgatgacaactcagcttttattttgatgtcttaggtacaagtcagaccctgaactcacaaacatagcatcagtgaaaaactggttgaaacttttcaatggttgttgagaaaagaaaaggttttgttttagtgggataaacacacttactccacctacgttttgaaaacagatgtttcaaaggaaaagaagttaaggaaaagcaaatgaactctcccaagcagccacatcctatccatgtgcccatataaagaaattaggagtatgattctcattttgttgtcagagatcatcttcaactctactatcttaaggaatctttaatgtaggacactcctaaatctgctttctctgattttcttttacaaatataaacattattataatcatcagaacagataaagtagagctgcttgagccaagagccacttgatatataccaggcactaaactaagtgctatgtaagcattagcttcattcagtcctcacaactcaatgacaggtacccattttacagataagaaacatgaggcttagagaagtttgtcacttgtccaaagttttcccctaccattcagctgtatgttcaaagcagaactatgaacccagtttcagaatgagtgcatgacatcaccattgtgctgtatggtctcacctgctggtttcagtccgccatggtggagtatcaaattacacatcagcctcctgttgcccagcacctgttgctggtcccaaacgagatagggctgcagcttacgtcatgttagcaggatgccctgaaatccctgcctgtagaggtagctaccacttaaccagagctggagctccctgggtctcatgcaggtgcccagggcagttgagggtttagggtgatctctctgtgctcaggtggcctcaatttgaagtggattattttccacttccttgtttataataaagactgatctactggggcctcagaaagacactgggctactaagcagcggagaggctttgcctcaagcagtcctgcaatgtcttttcatgttttcttctttaggtgcttcaagaaagacccacttcaggcaggaaaacattcttttctgacccagggaggttttaaaataataccttgaatgtcttactttgaaactttgaggattttccctcatttggtgattttgtttctgatatatggtatgtgctttccccatttctgtgtaagaagggagcaaggtttgtcacttgtgcaaagctcagcctgggcccagcctggactctcttgcattctgtgtcccagagctcccagtgaaacaggcccatgtggttcaggcctgcgtggagcctgggctccagtcacggtcacttagaacacagagacagccagcgaggcttgtcctctaaccagcgtttgtttgtttatttgcttgtacctactttgagcacatcttagatctcatctcaattgtgttagtaactcatagacaagaagaatttttgttttcctacagtgtttgggaaattgtatgtgaaaattcctaactgtgccatgcattttctcactttattcctattaataataatttaaagaaaaagaaataaggctgtgccatccgctagtaacaattaaggacaataatatgcatagaatatacttctgttgctcctagagagctagggaatgcaagattttggctaaatgggtagtataccttttttttctttttctcccacagagacgcatgcactccatgcctggaaatttttagaaatagaatatgtccaatactaataacataataactatatactaaaaacaatgttccagaagctgttttaaaatacatatgtttgtaaattatgtacatatgactacataatatatatgtggcatatgcattatgtgtatgtggtacatagacattacccataacaattagaaagtacctctgtctccgttttacagatgaggaagctgaggcacagagagattagtgacttgttcaagatgagacacacgctggtaaatggtggggctaggggttatgtatttaatcaccaggtgatactactatacctccacgactggatgtttcctgggtgtctcaggaggcacttcgatttttgcagtaactcaagaactcaccagtaagaaccttagttaggagttcgagttggtaggaaaacaacggaccaagactcataacctttcttctacaatttacgagttgtatatacttgggcacatctcttaacggaatctcactatcctcatctgtaaaatggagattataacatctatccacatacttcatagaggtgtcataaaggcacgtaacataatgaatctaaagacccctgaaaacccttgaagtgctacataaatattcagaaatggtttcttacatggtcatggttaggtctggaatgctgtgctaaggctttatcactctgagcccagtgccccctttcactcatctgtgctatatcaatgtgtctttcaagcaaattcacatgctaatctgtgttagttcctattctgcagaaatgagaagtgttaaactcattctttaaatataatcccctcactgctatgatagagaatgtgttacaccattaaagaacccacctctctttttttttttcaaatttaagaagcattactttccttttctccttctttcctaagagactagaatcctgtattgcaaatggaagttccctcaataaattttaactgagtagaatctgggatgctcagaatggaagaggtctcttgtaagctggaccaagactttacagataggaaagctgagggtcttatctgacatcacccagcctattagggccaacgtgggccaagagcccacgtgtcctgacttccagcccagagccagttctgcttcatgaccctgccccttgcactcagaagctgagggtatttgtggtttgtttgttttagtgctttcttttattactgatagctcttctgcaaggaatgcctcccctctctaagcatttattctttgttacttacagaagaagactgcataaactgggcgtgtcaaaggtcacccaagtggatttcctgccaagggaagtagtgtcctactcaaaggagacccagactcctcttgccacgcatcagtctgaaggtaaactatgtctttggcttactttccatattatctctggagaaatcgctgggaagtaacatctttcttgttgatttcctcttaccataagagctcttcatgggatacaaacataatgacactgaaagccaaagcctcttctgagtttgaaagctatggagagggaactcggtgatactcttccaagtgacctggcaactttaaattagataaactaaagaggtttatctcactacatcgaaatcatgtgaggagaacaaaaatcatcaaagaacaatgtaatagaaacagtgctgaattttatcaataagaatacattaagcatacattaagaatcttaagcatacattaagattcatcatttacatggcttagcaaactatagcccacccacctgttcctagaaataaggtgttgttggaatacagctatatccaaccattgacttctgtggttactttcttgctgcagtggcagggttgagtagttgtgaaagagaccttatggctcacaaagcctaaaatctttattataacctggccctttacagaaaacctttgctgaccactgatttggtttgccaattgaggtaacaacacacgagagtttctgaccacaatttaaaagtattttcccatgcaaactccacataggtgaatggaaattgaactccataccttctttgtgtatgccagaaaaatatcaagtgaaaaagtcacatacgggtatcagagaatcataaaaatacactcatgagagaagtcgaagttgataaatacttcctagaattcaaaactttatcaaagcaagattatgcaaaagcagaagagggagatgtattttgaaaatagggtaagtgaaagtttcattgttagaggctaacgttgttatagcaaagcaaatactctttttactttatgttattttattcttcggtgggtgaagaggatgttggaattctgggttccttgttgctatgtagtaagtatggacaaaagccatgaaatgcaaaaatgattagcatttcccccttagtgatttaccggaaatataaaaatcagtgcatttttgtttatgcaagctacaggttttcagttttggttctaaataaataacgccaaaagcaaagtgaatcagattccttgaagtccggggtgccgttaggcattctgaaaatcttgcctatacaagctgttgtggggacagttcttcagtagcagggcctccatttctcaagccccagtgaaatgaattttagaagcaaacaagtagcaccctctgctggtgagcttttaaaccaaccaacccaacaaatgagacctgtatattaacgtggctgaaaatacagttagcgagggggaaagaaagaaaagaaaaagaaaatacaaaattagaaaagcctgtgagagttcacctagtctatccttgggcctccagacaagaacaggaagatcgttaaaaaacatcctcaccacccaaccaaaacatttgtttgacttaatttgctgccagaggtatttgcagagctgtagctggaggcatgtttatttagcccaaaacttgacccatagcataaagttatacaactgaaataggagaaggagtgaattattttttaaaatgtgtacttaagatattggaagtggtaaagaaatatttacaagggaagataaattaaggatgaaaaggcatcagctctaaagttttaaactggagcacatcaaaaggaaaaggctgtacattccattttattactgcaaggagagcttgggagccctcattatgctgtggtccaagcagcaggaaagggggaatttatttctcagctattggcagaagttctttctgttttgttcacaagatccatcaagcttttttgtggtgaagggcatttacatggttcagattacaatacagaacccaaagctagctaccatagttcttgacatttaagcaatcctggatggatttggacagaaaaacctttcaatttgggttcagcaaactgcccctcaccacaggcgatgatgccttgacccttggctgccggcagtcacccggctgcccggccatagagggtgctggtgctcactttcacctgctgtggggaggtggttggcaggagagctgcgtggagcagtggacagttggcactgaggttctaccatgcggcagatgtgggttggctccactgtggggtttgagccatggcaatgttttcatgaaaactgcgcctttcagcggcaggaaacaactacggaattttatgacacaatgaggctcttgggtggctaacatttgaagctctggcatatataacatccactttggcttgctgttgcccacaatgtaagaaggcatgctgattattttttgtcattgtttgactgtggacagtttaatgataatcaaactaatgatctcagagcattgatttgttctgcctctaatggattctagtgcattcaagttcttacacattcccattttacttttgaaaatgaaggggaaggcactttggatttgcccaagcttaagcatcctttctgtactgtgcaccgtaatgaacattctcatcatagtaagtattaatttttgatcataatgatctgttatgagaaacactccagacagtgatataaataagcaagatttaagtataaattctccatgaatactgttctttcaacaaggttagaccttccttctctgcagggaaagaaggccaagaatggccaacactgacttggagaaggatacctttgccccaatatatttgaaacacataattttattcccaagtagcaagaaaggaaaacgaaattatggtcccctccaaggctgcctctctgttgcctattatgaacccatttctgtaccaaccatgaggtcctgggcttagggagccagtcttttgcatctttattatagtgagtgagtgcatggcttatcctgagtacccaagaaatgctgttgaacgacaaagataatgccagacatctctagaaacaccaagttcactatgttccccctgggggaatgagaatttcttaatctgctggaaagatgcaagccacactggaggaaggaggaggaaatttctacaacctggtacataatcatagtttgttttgatagtcacctggtatcttgtggtcaaggtttaatctctactcaggcccagtagcaaaccaagacatctctctcaaagggagagtaatgcaataaagaggccacattattattctaaaatctaagcacttcttctgagactcacctcttagggacatttgtttgatttgccatagacacttggggcaccattgggtcagctggaccataatttccaagtagtatagccatttgaaagaaaaactttcaaaccactgggtaaatggattgaataaataggtgcaaatgttgaacatgttgcctgcaaaacccagaatgacccactaagcatttcgactcttaatattagagaattaaggtattcacatatactttggagtttaccagatgactagaccaatagagactttcttaaggtagcgagtacttatgttttcaaagatttttcctccatcctctggcctacataatgtcttaactaggtcttaaagataccagctacagcttcctctccaggtcctgctgacatgatgctccatgttgaaggtgagattgacaagggctacagatagagaactggctcagccctgaggtaggatgatgaagatgcaaagagaaaggctgcaggtctttggctgtcaagcaaggcttagtgtagaacatggtttggaggtactcccaggcctccgtattcttacctacattcaatttcccattatttcctgatcattgctgtcactttcacataagtcacctggtgacactagcaattccacagaccttattcagaaacccacagaatttaaactttgcatttgactttgacatttttgtagatacttatcacaagcagagaaagtccatgggtctatgcctagatctaaaatatagagacttcaacctgtcatctatttcttacagctgtccagtcccattagaagtatccacctcatcctagtgtctttaaattcttcatgccactcacactattcaatagcagtgaaaatttgatcccctaaatccttcttttcaacggacacttcattaaagatcaccatagaagaaaaattatgtagctatttgttacagctgacagattcccattcctgaactcttactgaatttttattttctttagcatcagctatggcagataaccaacatcagcttcccacgtgactatctcctgatggtagtttctgtaccagactgagtttgtggttgctgacaatagaaactaactctaattaagtttaaacagaaaaaaaggtttgttgagaagatatgagatacttgatagaattgacaaaagaaaaaaaagccagagcattaggtttgaaataaaaagtaaattaggtagctgctatcgactggattgtgtatccccacaattcatatattgaaggcttaacccctaatacgactatgtttgtaaatagggtttttaggaggtaattaaggttaaatgaagtcataagggtaggatctctaattggtggccttattagaaaaagaagagagagagagagagagagatctttctccctgtgtgtgtgttcaccgaggaaaggccatgtgaggacacagcaagaaggcagctgtctgcgagccagaaagagagctttcaccagaaaatgaactggctggcaccttgatcttggacttcccagcttccagaactgtgagaaaataaattgtccttgtttaagccacccagtttatgctatttttcatggcagcctgagcagactaagacagcagctaacacagcaagatcataccagttaaccttcctggttagaagacctgagcctcctgacttccggtcactggatactctctgttaggctcatgatttaaactctgtagtcactgctggcttggaaacctctaactctctctgcctcttgacagtgttccctcaagggagtccattagccaggactaggttacatgcccctgtgtcagctgtgagggacaaggcagagaaataactgcccaagttcagcttcccataatgtttggggatgctatgactcaactttgatctatttttatatccttccttttagaacaatgggtgtttggatgctaagtggccaagaatatatattggaaaaatgcccactttggtgtaagaaaaagaaaaaaaagggaggtaaagagaaaaataatatttattatgtgttcagcacactcatatacattattacgcttgcagcattgctagaatttactcaccttataaatcagaggtgccgagagaatgcagttcctttattttatctgcagccatttataataccactagttgacatggagaaaatatacaaaataaacaactttagttcactctcatcttttaaaccgtccctgttagtatgttccattaatcttgggtagaaatgcccaaattcatagagtccccctctcatctgcatctctctctgagatcatggtcaattgtagagggaagaaagatgaggtttacatgatctaatggccttggtggagatagggaggatgagggactctggccttgtgctagtccctggcagcatgctggctgacatctgttgccctctggcatgatgtcctttgtccacctgggcactggcaccctgtgttagagtgtgtagctggtgaacttgtgatttgttcttttggcttagtttggcaatgttcctagggagcattggctatctctcttttgatgatttagtctcctctcagctgtcatggtctccagaccttgagttgatgccttgtcctttctccatcctagaggtctaccttcagcccatgccatgcctttatccaccacagcagatctcttggcatactgactctcgctttggtgcccatgcctcagaatatttaagggagatcctcacctgttcttttctcagtcttatcatgccagtcacccccagggaggctcagatgcctatggtgaataagatctattgcatggtggtctcttttcagattcccaaaaaaggagtgtggttcaagaaccctgtgctcattcctcctcttagtttaacactccacctctcctaatgcttcccccagaaagtgaaaatccagatatatctgaaactttgtctcttcttccgaaatgctcctatctggaaataaattcccctgtttaacttccttcaatttatatcttcattctaccatggagtctcaaggttttactgttctggacagaaggagtgatcttggtagttattgatattttaaatggtaaggaaaaaaactggaatatcctttctccctcaattaaacttggctctcaaactacagtgggattacaaaattcaatgttttgagatggaagctgagttttaccttagctgttttattttcattctatatcaaattctaatctctctactggcaaaaaaaatgccctaggtacactagggtgaatatcattacattcacaaagacaaacagaaaagcatattaataattttcaaatataagccccgctacacacaaaaattatttttgcctacctctcataatcaatgacacagtcaagaaatagcagaactaaataatattacaaggcatagcaaacctttaattccctggagagtaacaactgatatgttgacttacttaagaaacatctaaggttccacttccagcataaagtagacacaagagatagagcacatggggcatgtgagatggtccatgaatctacttcccagtaaaattggtaaaaatgataacaacaacaaaaccgcacaactatttaaaatatctgggagcagtcctaatagcatatagcaagtaaaaaaaagaaaaaaagaaaaacatttatctaataaaactaatcacaacttggtaaaaacaggaagattctatggtatttgaaccatactccattccctccttgcccccaattcagctttaaggaaattacttcaggtggatgcagcagaaaacacagggctacctctcctgccagctcccacttggagagctattgtatcttcctggaagaggcaagacattagcatttctcatactgccccagctacttgtttcagaagataagttccaagcaagtgtgagtacaaggtggggactcccttttttcagcccaacactaacttgagggatggagattttaccttggcttcaacatgctgagaacatgggaccccaactgtcttctccatggctcatgtgtaaagcagaggtttcatggtgggaaaagcaagctaagtagaccagaagcaatagcagtaccctactctcccacacagccagctgctaaagcaagggtgtcactcagaaagaagtgtgccattgtcccctcccccagctccagaatcttggtgcaaagattttgaccagggagagaggcaagtcaaaatcagagagctcagaatgtcttctcaaaagagctaacatgattttcaatgttcaagcctaagggcatcctcaaaacaatcaagatagtggtgtaaagcaattaagaaaagactggtagatgtgctaaatgtgtagacaagctgaaacatagctagcttaccagacagaaccaggaaaacagacagctaagaagagcccttctgggatcacaacacatctcaaaaactggtctcaaaaactgtaaattaaattcaggcttatttcaacctgtggagaaaattgtgccccagggcagtgttgaaaactatagagcaacaattatggaactcaatggcagcaattagtgaaactgagcagttgaagtgatcagagaaaggaactgctaaatggactacaaaaacctgttaccgcaggataactatgcacatgcccaaggctgcgcccttccaggaccagtatgagaggattcacactgtgggaggacaggggagaacagatttcaccaaaatagcccaaccaatcactaaacaaataagcaagcaaataacaataacaaacctgggggttggggggactggtatccagtgctgctacaatatattatcaaagtcaatttcttaaaaaaagaaatttgaggcaaagaaaccagaaagtctgacccctacacaggcagggaagcaggcaacagaaactgcctgtgagggcaactagatggatttaacaaagacttcagagttgtgtatgtgtgtatgtgttttttcaaagaactaaaagaaaccatactaatgaagtaaatgaaagtatgattactatatttcaccaaatagagaatgtcaacacagagctagaaattttttggaaaaaaaaggaatcaaatgtaaattctagagttcagtacaaaaactgaagtgaaaaattcattaaaggcacataaacaaacattgaactaatagaagaaaagaattagcaaacttcaagatagattgatagggagtatgcagtctgaagatgagaaaggataaacaatgaagaaaaactaagagatcctcagagaaatgtgggataccattaagcaaatcagcctacctgtaacaggaatgccagaaggatagatcaaagaaaaaggagtagaaaatactcaaataaataatggaataaaatttctcaaatttgatgaaaaactttaactataaacctaagaggctctaaactccaagtaagattaaagcaaatagttccatagacacagcatagtacaaatgctgaaacccaaagacaaggaaaatatcctgaaagcagcaagagaaaatgaattttcacttacaagagaacctcaataagataaactgctgacttcttatcagaaataattatgaccagaagacagtggtgtggtgtattcctagtgcccaaagaaaagaagaaaaaaaaaaaaacaactatcaatcaagaatcactacccagcaaagctatcttttaaaaatgaaggtaaagtaaaaacattcacagataatcattgagataatttgtagtcacagacccaccttacaagaaatataaaagaaagttattcagactgaaagtgactgaccccagagagtaattcaaatctatagggaaaaacaaagagcacaagtagaggtagctatgtaactataaaagatagtatacataaatatttcttttttcttttccttctcttaacttatttaaatagcagtgatataaaacactataccaataattgtattattcagcctataacttatagaaaggtaatatattttctaataacaggacaaagaaggtgagtggcagcactttgttatttacagaaattctccattgttctttttttttgctgaaatcctgtagtctatagtaactagcattaaaactcttaaatgaaaaagagtcttatattttggggatagtagagaagtgaagaagaagtaattatggggagaggaacagcaaaagtaaagtaagtgataaaataatcaaagagtaaaaagagtcatgcttagctcttgtggcataaagcaagaaagaaagtcataacaaataactagtcaaagacacggaaatgagggcaggagagctctgtgtggcctccatacattttagacagttaagggtcaaaatctgggctatctagttgaaggcattagaaattcaaccatatgacctaggcttcatggggggtacattaagagaggaatgcctacttccctttttctggtatccagaaagagcaagcttccctcaaacttctaacttgtatgcctttcttttctcctcctaatagagagagaattgtaggaaggtaattgtccaacattttttgattggatgtaactaacttatcaatggttctaagcatgaagaatttggtctatttatactaacgttctccccagaccagttagagttacgtgtttgctctgccatgtaggagctgttccaaggtctagaatctgcatggaagaagtagtaagtccagttttacttttacagtaacttataattgtcagcctattccttattactagtaatgatgatagtttggcctttatttgttttattcctgttcttatttttcaattaattcagaacttggacaggaaaaagtggtactatttcaaaaccccgacaccttggtacattgcctggaaatctaacccagtcctcccacatggtaagagagaattccaccaaccgaacacacttcctgtccacatctgatgtttcttccaatgtgaagtccgttcgtggaatactcttagcttcttgccacccctttaccactccactctaccctgcatactccacccccagaggaggtggaatgatttatccaattggtaggtttggataaacgacccgggcagtttcaggccatctccagtttttttcctgggggagccagcatacctgtaggggttacaagttactttcttctcctttgtgccatgagtcatactcaagtcacatgcaagaggggatgcctgtcaggtccagccttacctgtgagagagtgggtaagtctgcctatttcaggaaatcaattagtagatccatttggctttcttcataacctacatcttcttactttttttttttttttttttttttgagacagaatcttgctctgtcacccaggctggagtacagtgacgtgttctcagctcactgcaacctccgcctcctgagttcaaccgattctcctgcctcagcctcccgagtagctgggattacaggtgcacaccaccgtgcccagctaatttttgtatttttagtagagatggggtttcaccatattggccaggctggtctcaaactcctgaccctcacgatccgcccatctcagcctcccataacttgcattttcactcgttcgttatcaacaatgaaaatgttattttggcctccctccatttttttatctttccctaatttctcatttggatgctatttatttagtcctcttaagaatctcaaacagtagaaggaaaattatgtcacgatgtcagttctgaagaaatcaaagtactgaagataatgttaatgaccataggtaattacacaagaaagagtaacttaggcagaagggagagggttatattctaggaacaaggaaatagcccatttgtagaagtggattacagggtcagagtggaagcagcaataaagtcaccttgatgctgagccctgaaatccttccaattctctatgaatgtgtgtcaatgctgagcctgtgtgtgaaggtactaactgtgtaggtttgtgagggaagagagccaggaagcttgctatacttgatgacttatttgaaaaggaaaaagaaaaaaaaaagtaaaacctgatcactattaccataaagccatagcatgaaataagattttctgtaaaattgttagcacagcattccagttttgataacacttcagatgattttgttgcagtaaaatatatcagactgaaaacctttcctttgcctaaaggaaggtagttcttggactatttgggaacaaatgatctctttcaatagctcaaaacttgtagtgtgacatttgttttcttgtgatcaatagagcaagtgttcattttcaccatgagggtggcatactggaggctcaagctaattatttttctggtaatgggaaataagattgagccgatggctcaaagcaagtgagaataacttttgattccctctgcctgattattctctagtgtcatatggcagcccctggcagcccattcacatttcctgattaagtaagcagtttgagtcaggcatatggtcatgcatcagatagttctctggataatattagttccaaggtaagaaagaaaatatggttaaatgtgtatgagtttataatttatttactgttcacaggggtgggatttgccttgcacattgctaccctcatagcttccatttgtttgatatatgctctggctgaggacaccatattcatatgtattttttttatcttcagcagaaccatttaaaatttccttcctttcctatttccttcagtatgttctctatttccaaaaccatcttctttccctggagcaaccattttcttttgtttaggatcacaaatttcacatctcctgtcaatctttttgtcaagaggatattgtgaagataaaatgacaaaatggttggaaaaaatgcttttctttgaactattatttcaataataggtattgttttgctgccgaagactgagaaaagttttatggataccaattttcccctcataaagtagatcaagacaatgttcttgccaaaaccgggtacttcttagtcatgttgagctttgggaggtgtctattttctccagaagaagaggacaaagagatgcaccatatttcttaaagtcctggataggaagtttgagcatctgtttccctctatccatagttcattcacagtggtaacttcagcagtcatccagcagaactaaatagtgtccccatcatcttcaggtgctctgaataagtagtgatttgggctgctagaaagatccttgggtgggctggcagtaacacatcttccagtaatcattactagaagtgtcagcctaggtaaattcatgttcatctgggaccattttctcttactttgcttaaatttaacccagatcttaagatccaagtgttatattgaacattggtgaggtacagcgaaatttgaagaggtgggaaaaagttttcctttccacccttacagagacaacacgctgaggaaataggactctcccttcgtctatttaggtaatccttggcttggcatatttgggtaagaaaatgaaaggtttgcctacatagttgaaatctctcgtcacattatatcatctgaagcctatttgtacgttgggatcattttatttggttttggttaggcataaaagtgttctgtggtctcctcttttttcaaggccttctggcttttggaaaattgagtgatttcatccctgtccgggtttcctagtgaaatcttgtatttttactcaaattacttgatcaattagttatgtcagctgcccaaaatgtgcctttttattaatagcaccttttatcaactcattggaattagaaattgcaaccatggtttgaggctggtaacatcttgcaataatttataaattttactttttaaaaagacctcacaattgctcatttgtgaactttttggatgtgtccctgtgtgagaaattgcatttgtattattattagttctgacaaactggattagatcttggctattgttaagtggttctatctgccctcaaatctactgagagacacagcattttaaatgaatttaattaaaacggcatgtggtttatagagctgcctccagttagtatgccattcttcttgactgaatagagtttctactaatgtataatgatgttttatgtgagagatgtttgaaactccttcatagtagccccgaggtagtttccgtggaatgacatggtggtgaaattttaaaattctaaaaaaccttttatacttaagtgagtcatgtttacactaactaatgtatgcataaatgtgttaaatatgtttgttgaagctgtgagagacatggattgtatttcaacaccagcaatatgttggcagtgagagatttttaagaaattcaaatctgggagcagtttggaagatctgagaaaagatatatggataccaataatatgtattattctttgaagtatgaaaaaagaccactgtggaacttcctcttaaaatcagttcctttggtcaactagttttaatggttctcccctaaggaataagaattatacataaagacgattctcagcatcagtttaaaacaaagtcttggaaaatatcaatgatagaagtttatgtttttttaatgaagattttttgcatttttgaatattttaaaagaataaattgttcaataaaactttatagagggagtcaatgaagccatttgactgaatagactcaaattctggttctggaaattgatctttgatgataatgataggataactgcagggaagtcgtcttgacccattttcctccacagtcagtcttctgaaatgacactactgagaaatgcagtctttacatcatcttcattaagtacacaacaaaatgtctggcaatgttgtagactccagcgggacatggttagagaagaagtggttcagcagaagggagtaagctccaggtaaacatgcagcacaaatgaggaagaatttccaggacatggaaactaacgggtaagagagatgagctcagattggaggagctcacctcagcctctcaaaatgctaggattacagacatgaaccactatgcctggcccttcatttttttttttttctaagagacagagtcttgctgtgttgcccagactggagtccagtggcatgatcatagctcactgtagccttccagtgagcaaggaaggaaacaatgaactttccatgggaagagagttgaaataaaggaaggtcatgagaaactcaggctgtgatttcttgagaggaagtcaatgaaatgaactacaggcatgaacaatgaagaaaagttaaaaggataatagagacaacagcttggccgggcatggtggctcacacctgtaatcctagctctcagggaggcagaggcgggaggatagcttgagcccaggagttcaagacctgcctgggcaatatagcgagaccccgttctccacgaaaaggaagaaaaaaaaagacaaaaaaaaaaaaataagcgtaatagagacaacagcttataggctacatacacagcagtattctctgtttctcctcaacctcagtaaaagctaatctacctcatagggctgtcatgaagatcaaatgtagtcaatataaaaaaaattcatgtaagatgcttagtacaatacatggtatattacaagtactcaaagcattttaacttaaaaattaccatttgcatgtattctaactagatgtctttcttaatgtttccataaaagattccatatattgattcaaaattaacaaatatcttttcatttctagaaaccctgtgttttctcctgatctgaatggcatgtcattttagaattcttattgtgagatgtttcttcttcttctttttttttgaaatggagtctcagtctgttgctcaggctggagtgcagtggcatgatcttggctcactgcaacttccacctcccaggttcaagtgattctcctgcctcagcctctcaattagctgggaatacaggcactcaccaccacacctggccaattttttgtttgtttgtatttttagcagagatggggttttcccatgttggccaggctggtcttgaatgcctgacctcaagtgatccattcgcctcagcctctcaaagtgctgggattacagacatgagccaccatgccctgcccttcatttttttcttcctaagagacggagtcttgctgtgttgcccagtctggagtccagtggcatgatcatagctcactgcaggctcaacctcctgggttcaaaggatcctccctcctcagcctcccaagtagctgaggaaacaggtgcatgccaccatgtccagctaattttttaatttcttaattttttgtagagacagggtctcactgtattgcccaggctcttttcaaattcctagcttcaagcagtcctcctgccttagcctcccaacgtgctaggattacagatgtaagccactgtgcctggtcttgatcttagcttcttaaaaaatcagaagtgttttaggtagtggtatcttccaaaaatgtcattatcagaaagaaagacatttttaaaaacccacaacatttttattccttgcacttaattttttggcctctaactttgggagatgaaaataatctctctgaagaaaaaataaactaccaaaggtcttattataaatcctacttttaagatctgggtaacactgtttaataatagcatagcagctatcctttattgagctattacttgcccagtacaatatgcaatctacatatttcctctacagtcttcacttctatgctaaacaaattgtattattctacaattttataaagaaactaagactcaggccggacgcagtggcccacacctatgatcccaacactttgggaggccgaggcaggcagatcacttgaggctaggaaaacaagaccaggctggccaacatggtgaaaccccgtctctattaaaaatacaaaaattacctgagcgtggtgtcatgtctgtagtcccagctactcaggacactggggcaggaggattgcttgaactggggaggcggaggttgcagtgagccgagatggcactactgcactccagcctgggtgacagagtgagacctgtctcaaaaaaataaagcaaaacaaaacaaacaagcaaaaaaacccatactcaccaaaagaaaaaaaaaattaagacttagagaacttaacttgctagcaaataaccaagccagaattcacactcagtgcttcctgactttaagtttcttcccatgatgccattctgcctcaaaccagacagccaatctccttaagaagacaacaattttttatcaaaatattttgacattagtgaattaaccaagtatgccacttgtctgactgtgcaaatccttaccaaggaagcaaagtggaaaaaaaaattgaggaaattccagacaatggaaacacaataggcaaaaagacatttcagttttatctggagaacatatgaaaggagcagcagtgatcacagagaacaagctggaaacacttccttgtgagtgatggtattctgtttccatggtaactagacatggcagaggaagtcaatgcctcgtttctgtttactcaatctgtatgagctcagtgtatacgacagggcagttttcaacaaagaataattcagtgagacagccctgatcatgtcacccctgcctaaaaactttccaggattcttggctaagtgcaggacgcctcgtgggcataggaggtcctctactcagccagtctcatctcctgctctctacagttccgtctctatgctctggtccattctgacatgcacccaatccgggctgcatattagagtcacctagggagctttaaaaatatacagatgtctgggcttcacgaaccccagggattctgatttgatgatctggggtagggtcttaaaatctctccaggtaattagaaagcacagccgggattgagaagatcactgatctaatcaaagaggattctaaaaactacttcattctcctgactctacactttatactaacgcccttcctttctcctgaaagatcttttctctctcctcccctttcaccttctctggccaactataccttttaaattcttttcatcttgtaaagtgtttctccaatgccttgaagcttttcttaattccccgtcctctttttagttgaacatagtatctctttcatttaaactttaaaaatgtgtttttacccctcttatagcatttatatttcctatcactacctcctctcacccttctctatgagcaaggactaggttttgcagatttcttgatatactaaaggctcaataaaaaattaaatacctgtatttcaaaggttgcaaaatatctgtctttggagaaaagagttaatatcctccatttctgatgatgcttgaattgagttcaagactgggcccaaagtccatcccctaatagtgagaatgcttattttagagcctgcaagccccccggtattgtattagaatggtgtatgggcttgggtgcattattttcaggagagtttccgtagctttaatcagactctcaaagttacccatctatgattcattaacatgttaaagctactatcctacaagatgaatcttcagaggctcagtgctcagtggtgacagtggccttgatttgacactgtttactggacactaaccttccatttctctttctgccataattttaggccacttcacctccatttaggttgaatgccttcatgaaaatgttagtactccaaagactaatcgagaataacacctatcatttggatgattaaatatttttaaatgaaaaataaaattaggccaggagtggcggctcacacctgtaatccaaacactttaggaggccaaggtgggcagattgcttgagcccaggaattcaagacaagactggccaacatggcaaaccccatctccacaaaaagtacaaaaatctagctgaacgtggtagtgcacgcctgtagtcccagctacttgggaggctgaggtgggaggatcgcttgagcccaggaggttgaggctacagtgagctgtgatcatgccattttagtccagcctgggcaacagagtgagaccctgtctttaaaaaaataagaagaagaaacaaaattaaaggtacttttgttattggctcagaaaaatgtgaattcccatcttggttaggtgataaatgcatagtgtctttgccaccattgaccaccacagagaaaagtgctcatatgcatgtgtatgttgtgtgtgttttgtatgagtattttagcaaaatgtgatttttcttagacaaaaaaattgccaaaggcctggttgtctgcaaaaggaataaaattcatttcggcaggccacctctgagtttcttaggtttcattatttgctgctgaaatatttgagactaaaacaacaacaatcaaaacatgacttagtagctgttcgaagtaatttttctacttctgggcacaaaatagccagaaaagcgtctgtcttctcaattgaactgatttgtaattctagaatgtaagaggaaaaaactggaaggacctccacttaaatctgtaattttggtaattctgaagtaacgtgacacaaggaattttgatcattgctcagttcagcctgggggaatctcctttcaaggaatgagaaatgcttgggagaagtcattggaggaagctgcaattggggtttgacctgaataaattgaaatagaacatgggagatattacctagtgagcctagtagaaattagcaagctgaagataagagttagcagtatatatattcacatatatatggctgtatactcaaaattgttgcaaagtgtgaacatcagacttaatcaaatgacatgctgatatgcctccttataaaaaagggttggcattaaaattcagaattttcaaaatacaaaaattagaaggtgattactcacgtttttaaaagaactctttgccttaaaaagaatctaccacattattccattcaaattaccccttatagaaacgacttcctgttcaataaatagttctgggacaactggcttatcatatgcagaagactgaaaatggactcctatgttacaccatacacaagaatcaactcaacatggattaaagacttaaatgtaaattacaaaactataaaagccctgaaagttaacctaggcaataccattcaggacaaagaaactggcaaagatttcattttcataccaaaaacaattgcaaaaaagcaaaaattgacaaattggattaaacttaagagtttctgcacagcaaaagaaaccatccacagagtaaacagaaaacctacagaatgagagaaaatatttgcaaactattcatcatctgacaaaggtctaatatccagtatctataaaaaaactttaacaaatttacaacaacaacaacaacaccccattaaaaagtaggcaaaggacatgaatagacacttttcaaaagaagacatacatgtggccaataagcatatgaagaaaagctcaacatcactgatcatgagagaaatgcaaatcaaaaccaccatgagatagcatctcacaccaatcagaatgtctattattaaaaggtcaaaaactaacagatgctggcaaggttgcggataaaagagaatgcttacacactgttggtgggagtgtaaattagttcaactgttgtggaaagcagtgtggcaattcctgaaatagcgaaaaacagaactaccattcaatccccttactgatatatctgatgtaataaatcattctcccataaaggcatatgcatgtgtatgttcattgcagcactattcacaattgcaaatatatggaatcaacctcaatgcccatcagtggcaaagtgaataaagaaaatgcggtgcatatataccatggaatactatgcagccataaaaagaatgagattatgtcctttgcaggaacatggatgaagctggaggccattatccttaacaaaaatgcaggaacagaaaggcaaataccacatgttctcactttaagtgggacttaaatgatgagaacacatggacacatagaggggaacaacagatactggggcctccttgacggtggagggtgagaggaggaggaagggagaggatcagaaaaagtaactattgggtactaggcttggtacctgagtgagaaagtaatctgttcaacaaacccctgtgacacaaatttacccatataaaaaaccttcagatgcaccactgtacctaaaataaaagtttaaaaaataaataaaattaaattaatgagatgctctttaaagtatgttaaaattgccatttggttaatttcagaggttctcacacttcagtgtgcatcgcagtcaccagaaaggtatgttaataaaaattaggttgctcagcccccaccctcagaatttctgattcagaaggtttgggatggatccctaaaatctgcatttcgaacaggttctctggtctgggcaccagtttgaaaactgttggtttattaaaattcttcctgaacgtagtttattagaaaaaaatctatgatgtaacaggaagtaaacctacaagtgatttttagtggatgtgatgtgctgaattgtgtatcccccaaatttcatatgctgaagtcctcatccccagtacctcagaatgtgactgtgtttaaagatagggtccttaaagaagtaattaagttaaaatgaggtcattagagtgggccttcatccaacatatgactagtgtccttataggaaggggaaattaggacccaggcacacacagaggaaagcccatgtgaaaaaaacagggagaaggtggtcatctacaagccaaggaaagaggactcagaagaaaccagcctgctgacaccttcacttggatttctagccccaagactacgaagaaatatatttccgatgtttgatctccctagtctgtggtcctctgttatgggtctagcaagctaatacagattgtgggcttcaaaataaaatagctatttagaaaatgtattcaacggttttgcgtttggtctaagggtaaaaatcaaaagtgatagtaaagtaagagaagcaaacagagtaaaatgcactcttaacctctgcttcatgtccacttttgcctttgtagatgtctctgggcatctgggcttggaggagatacctgaatttatgtttaatcaggggacactattggtgtcaggttggttcacaaatgtgggagaataagagagctacatggaaaggaagagtccatatgaacagaatgaagtgtgtggcctagggagagttttaatgttcttgcatattcagtgtctttatgaatagtataccaaatatacaggggttataaattgggggaaagggagcatgatgcagagtgtgggtgaagagtgtgttttatttggtctgctcactgtttgcacaatttgaagttaaatgatttggggtgtgtactctatcctcactcctcctttggtcacatatccaccttcttcacgcatttgttctgcctggtctctagatgcctttcagtgggtgacccccaatttcaagtatcctatagtggttattgtcccctacacagtacatgttagttgtaagttctggtaaattttgtttttgtaacttttttttttctttttgagacagattgttgctctttcacccaggctggagtgcagtagcatcatttcggctcattgcaacctctgcctcccaggtttaagtgattcttctgcctcagcctcctaagtagctgtgattacaggcatgcaccaccatgcccagctaattttttcttttttttaaattgagacagagtcttgctctgtcatccaggctggagtgcagtggcatgatctcagcccactgcaacctccacctcctgggttcaagcaattctcctgcctcagcctcctgagtagctgggattaaaagcacacactggcccacgccaccatgcccagctaatttttcttccccccgagacagagtcttgctctgtcgcccaggcgggagtgcagtggcggtgatctcggctcactgcaagctccacctcccgggttcacgccattctcccgcctcagcctcccaagtagctgggactacagatgcctgccaccacgcccagctaatttttttgtatttttagtagagatggggtttcactgtgtaagccaggatggtctctatctcctgacctcatgatcctcctgcctcagcctcccaaagtgctgggattacaggtgtaagccaccgtgcctgacctaatttttgtatttttagtagagatggggtttcaccatgttggccaggctgatcttgaattcctgacctcaggtgatccgcccaccttggccttccaaagtgctgggattacaggtgtgagccaccgcacctggccctgtaactatttttattataagaattttctcctagcagtagtgatggaaataacattagcaatacaaatgctatcttatagagggagaaaatgaggaggcccaataccatttcatgagtgagtcagaaggtgaaatccacaatcacttgcttttatgctttgctcaaagtggcaggctccatggcctcttaaaaaaattgccatctttttattataaagtaataaataaattgcaaattctgccataaactctttcctcgtgacctttcttaaatttgttttcttttttcttcatttcttaataagtctttatatattttggcacagtaagctttgaaaagggagggttaaaaatagcttcctggtttcagctaccaaacacaagcatgttttggagctctcccacaacaggctgatttccaaagaaacacacatttattcatcctgaagggctgtgatgttgaggagtcagacaaaaaattcaactattatgtgaagacagtttgagaaatataaataagggagtgctttcactagcacttgcagtatggatttgtgactcaagaaagtcctgttcatgtgtttcttcattttttccctgggtttccataatcagagaagggaaggacaggaaagcatgtgatatttatatagcagaaatgatactatattaaagggtttctttaggtgttaaacagtttggcttgcaaacgtctagacttttttaaatatctaaaaatgacaaatcttaaacaccactcccaataacttccttaaaatttgatataagaaatgttgcctgggctttatagtcccataattgcttggctgagaacatgtgccttactcctgttcctatacaaggtccatcatcttgctggcactccatgaatgtcaactaccaagtgtacagatttaggtatcaaagactgctgatgatgcaaaacctagagatctaggaaatactgaggaataatgcagccagactcaaaaggtttgtttctttgagctgccagagctagtaatgtaagtggaaaatatagttaatatagacagatgtcaaacaaagccaagtggaaagaacaggaaacaaaaatattaaatgaaacagtagagtgtgcttactgggttgggacttggagaattgggtttggaatctctttgcagtctgccctgtgaaagactgaaagaaaattttgaagtgatgtgaaaatttattcggttcctcagtggataaccctttcccaaacaatgagaatctctgatgaagcctctgctgttacttatgaagaaatttgataactatttaacatgttgatattatactactatcaagtgatattgtaaatacctgcccttccctcatccacccatgcaaagcatcctggaacatcccagattattagttgctgtagtccatctagaatgctataatgagacaccataaactgggtagcttataaataacagaaatttgtgtctcacaattctgaaggctggaaagtccaagatcaagattccaggagacttggcacctggtgaagcctggctttctggtttatagaaagcatcttctctgtctcctgatatgatagaaggggcaagggatctctctagggtctctttataagagtaccaatccccagttatctcccaaaggacctacatctaatacccttaccttgggggttaggatttcaatacctgaatttgggggggggacataaacatttagtctattgtattagcactgcaagcatagggtgtaagagtgtgtatcttcttttcaaacttaggaattagctatttcttcatagattcttctagttagtaataggttggtgcaaaagtaatcacagtttaaattttaaatcattataactaggctcaaacacatctttattaattaaaataggaaccattacaatcaacacatttttgccaactggaaataagtttgtttattcctgtagcataaaaatctgtgcttcgggattcaatgaactcttggaaagcattttctgcatcctgctggttgtggaaacattttccatgtaaaaagttgtcgagatgcttgaagaagtcagttggtgagaggtcaggtgaatatggcagttgaggcaaaacttcttagcccaattcgttcaacttttgaagcattggttgtgtgttgtgcaatgagtggtcaggcattgttgtggagaagaattgggccttttctgttgaccaatgccggctgcaggcattgcagttttcagtgcatctcatcaatttgctgagcatacttctcagatgtaatggtttcaccgggattcagaaagctgcagtggatcagactggcaacagacaacctaacagtgaccacgacccttttttggtgcaactttggctttggaaagtgctttggaacttcatcttggtctgaccactgagctggtcatcgctggttgttgtataaaattcacttttcgtcacatgtcacaatccgatggagtatagttcattgttgttgagtacaataagagaaaatgacacttcaaaatggtgatattttcaattttcactcagctcacgaggcacccatttatcagctttttcactcttccaatttgcttcaaatgccaaacaaccatagaatggtccatgttgagttcttcggcaatttctcatgtggttgtacgaggatcagcttcgacgattgctctcaattggtcattgtcaacttccgatggctggccactatactcctcatctcaagtctcctgtctcctttggaaaacttcttgaaccaccactgcactgtacattcattagcagttcctgggccgaatgcgttgttgatgttgtgagttgtctccactgctttacgacccattttgaactcgaataagaaaatcattcgaatttgctttttgtctaacatcatttccattgtctaaaataaatataaaataaacagcaagtaataagtcattagcaaaaaaaaagtgagaaatggccattaaagtgatatataacataactacatttatttaagaatgtattccaatatcacacagcaaatttcaacaatgcaaaaactgcaattatgtttgcaccaagctaatagtatcctgtcttatgccactaattaccttagggctgagtgaaagcggggcctgctagccctgatgatggaccctcagttcagagtcagcttgagagggaggcaagagaaaccatcttctccacctttcccctcctagggcagttatctgagagaagagccggcagaaggcatttagccttcagtctgtgaagtgttggtgctggacaaattatagcagaagctgggctgctacagagtaactagggttggcaatagcttgcttgttgatggccactttcttaggcaagtccagacacagtatatagcggcttcaggtgggactagaacatccctgcagcaccatctgcccaggcttgctcggtgaagagccctgagccctaagccctaaatcctaaggtggtgtcagtttagcttaaaggaaggtggtcttcttggagaaatgtgccaagcttgagagcgtcctaaacatcatggcaaaatatgaggcaaaagggtaaactgacgaggattgttaacaccaacattactaataatgcgtgcttatattacttaatgtttctatttgctagatatcaagccttaacactgactactttaaattcagtgtttcattgaatcccctcagcaactttatgagttaagtattattactattcctattttcagagaagataactgacaaaaagagagtaagaagtttgcctaaagttacagttattaaacatttagaattggtttcacacacagctcagtccgactcagaatcccatactctttcccctaaactatgccacctgtaaacaaacacaggcaaggccagtgagaaatcagaaaccaagttgcttattatttcatggtgttgctgtgtgttgtgggaattacaaatgactctaaaatattgtttctaccctccaggagcctagaatgtcaatccgtgatctttctcatcaattctgtttatgttttatttatccccatatgaaagctaaacagtaaaatttattctgtatccaactgaagggcatgtttttaaatttctaaaaccccaaatatgtcaaatgttagtaaacactgctagactgagaacagtgaaaataacttttaaatacttgttcgatgccattgcttataacttgtaagaccaacatagaaatttatctgtagtttatcagtgaaagttgatagaccaggattttatcagctaagaaaggagggatatgccagggcctatggaattttaggaaaaagggaagcctttaattgggtgaggaaaagtagaaattgagttataacctcttccatgggtcgtttattagcacatggtcattaacatctatccccaggttcctaagcaggaagcaggaaaagcaacaaaccagagaaagtcctgagccccctttgaactttatagaaaggcactttataaatcctaggaaaatgaatttatgttataatttgtctagagtgactctgagttaaaactcttttgaaggtagggcctgtttgatacaccatatagaaagtcacctctctccctgccccccagacagtgtagcccatcctgtgttgacttgtcctctattgaccatgattttttttttttggcattctttcctgtggatctagattaaaagtattaagaaatacaccttaaagagaaagagcctattcaataggaggcctagagggcaggaaagaagaatttagccctttgtcatgaagtggaatgagtggtcctccctgagtgttgattaaacaagattataatcagccatgtatggttgcgacttaattggcaggcagatctgcttgctgtgcagagcagtatatttgtatgtgctcatttttttaaatgtgttccaaacccttatagttgagttgattttttttttttgcaataatgatatgctttcagtagcgtgtcattttctttacccttgtagagagataacatgcaattagggagtgatgtcagcctgtaacattttggtgtaaaattttggtcacaccaaaatactgggctccttaacaaagctggcagacacatcttttggcagcagctgctcgccatgtgatttaaaacttcctgtcactataattgatgtgtttttattctttccatttcctgaagcctgatcagaattaaaattgctgttggaatttcctgtcaaagcaactcatttattctctgagctctgcactttgattggacattgccttcagcaatagtcaggtggagattgctgggaattattctctccacacaggttagatggccacgcacggcacatctgcaaatctacacagattgtccatcatgtggtaaacttgtcctaatggaaactccacatgccaaatgttaatgatttgaatatcaaacttggccacctgctggggcctctgggttttgtgttaatttaggaaatcccgtagagttttcagccaattgtctcaccattgaatttagattgttgttccaaggttcactagtgaagcatctcagaacaagactctgatctgtccctggtttagataacatgactaaaaatgtttaatttttaagcccatttctccatcccttctgttcccccatatgctatttacatataacatcttggggtgattgggggtataagggatgaatggttctgaaatatgccctagtagatacttgctcacagatgtgtggccaagacaactacaaaaattcagacgtgggtaaaatagtaggcagtggaaagatctaaattctacctcgttttatttttatatctgaaagtaaatccataaaattacttctttatgcaaaggaaagaatcactaactttcctcagtgtatccactgcacagaggatttatttatttactttttgattgtgagttcatcttctttacaaatgactgttttccagttgaggcaggtgaaagaaacgctttcatgagcttaaagaagaggttgattaagtttaatgccctggacaataaggactatctttacttatcctggtgattagactcgaagatttcattatggaaatgggaatctctttttttaaaaatacaacaacctatcctataaaccacaacacaaagacgtttttaaaaataatactttattgaaaactcaatctggcatttaaaatgcttttgttttgtcaccaagtaaaggtaggctttttgattttttttccaagtacttgtaaaatattgtttttaatatttcaaaaatgtgaaatccacaagtctcagaccttgttttgagactttgcttacccccaccacctaggacagtgccttacaaattgtagatactcaattgatatttattaagtgaatgaaggaagccctgtagaattgtaaaatgtcaaagcaatggggaagggaccatgttacatctggagacagagcttccaagcatagtaatcttgctctgcataaggatttctgaccctgcttatatgtcagaatcaccagaggggctttaaaaaacaaccacaaacaaactggtgccgggatgcctccatgggccatgaaatctgaatcttctgttggtcactcttgggctgaaatgatgttcaagtcagaggtcagcgtttccccatactgggcacccttgagattgaatcccaggcacattccactccagatggccaggtctgatgtgttggttccaccaagtcagaatcatcctggacattttttatatattagcttgagtcaatgactccttgaaaaatggagatggagaacagcagttggtggagagagtgaaccactccttcaggcacgttgtgagctgaactaatttaaaatcacaggtaaggataatgctacatgtggagtgtgttagaaaccaccactttcattcaatgtttctagcatgttaggatatttaaagcacggaggggaagaaaaattacatcactagatttttttctgatcttaaagtaagttttgaatatttaattcttttctatgaatattctccaggaacttctaccattgttatctgacttctattctacctctgtatgtatctcttttgccttcttattccccaaagcctctgattttagagcagcttgcagaaatagtggtgaataatgtgcttattatcatgtaggtgctcgcctgtattttgtatgcaaggaggtatctgttccatgggacacatgagtttgccctgacgatgacccagaaagggtctgcatgtgtatttctgctgccttttccggccacagcttggggagcttgtctgtagagggcgtccgaggctccatggatagtgaggtccatcctactgcattttcaacactgctccatagcctgtgctcagcatgccactggaaaggaatcctagctgtattctcttcaaatttcccttcccctttaattcttacttccttcttgtgacattctgctattctttgccacaaaccattgcaaaacaacccatacaagagtttttgcctcctccttggctagggtagaaggctctttggaaaccacaaagccacatctccagggaacagtagctttattaatataataatcaccaccatcatggcctggatacaatatacacattactttagaaagaaaaataaggactatctggggtttgctggagaagctgcacttgaggttagatgtgtatagttaaatttggagtcaagctgaggtcattgctaaggagatttggagttggaaatccatgtggaaaatggttgccccatggaagttatcctctcaccattaaaactcattttgaataatatcagttagggaaaatacgagggtttgatcctgtaagacttgggcttttcttgatgccctggtttacttggaaaataagttgtatggtatataatctttgccatccatcctctctttctcaaaaaaatcctagcacaaatggaataaaaaagttttattaagaagaatcataccatgtatgtttcatgagattttcattctaaataacatataaggaatgagttgcacaataccaaatattttagactgtgttccttctaaataagttgagtgtatttaatgaaagattttctccaattgaaatggaataagaagaaaatattaaaaggtcctttaatttcttatttggttgtttcttggatatagaggaggaagaaaaaataaagtgtggcaaaacaaacaaacatggcatcctcctttttaagcaatcatgtcagcttggatggaaataacaaaggatcccaactaagtgtgccagagcctccggcaaaggcagactgctgacatggcagctgtatgtttccagctgattttaggcctagataactatccctttcagcttaaatgatgctctacagtcattgactagtgcccagttaggttggagcacagttcttttggaacctgttcagaccaacttggactgcctgtgagatctgggccaagatcagactggtttcctggagcctgaggcatagtacaggctgtagtaaaagggacagagttctctgcatgtgtagtagaatgtatcattgcatctgtttgctacctttactttttaagaataatcacaaatgagtgagagctacactgtattcttcagactgaagcagggtgtacaccaaatatcttttccaataatctgtaaattcaacaggttatttttcttttctgttttaaaaatagcttgtacttatccccctcctctccaacccaagtgtggctcttgaactattttcaatatattgcctttttaggatcccaaattctccttttaatgtgaaacttgctttaattgaccaaaaatgccattttcaaaatgttcaattctctgcaaaagcattgcttactgacagtgcttattgatgaaggctgtggaatctaaaggatgtcaacagatgaatgaagcctagtatggtgagatgagggctgccatctgcttaagggttggccaaacacctggataatttaggctaaaagaccagccatttcttcattctgaatacataacagaaatcactgctttttaggtttggcctcaatcaacaacaagaactgatttccctggtgatgctgaacaaatgtttaagagagtaagatctgaaactgattctccaactttagtgggccagtgcataaaatgatccaggttttctgaatgcacatgagctgccagatgggttgtttagtataagcagtgcaatctttgtttctttagctgctgtctgcaaatattggtatttaagggcggctctaaagtgaccaaagaaagtttgtgaaattcaagaggctgtctttttcctttcccaaaaaataattgtttttggtatatgagcccaggagataattgcatgctgacttcttgttctccagtggcgtgttttttcctgctattgagcagaactgaaatagttagcatgtagaaaaatacatggaatattaaactaaaatatgtctgtctagggatccatttagttgcctccaatagctcctttctttgtgaatgccattatgtttatatatatttaaatgccccctttgctacactggttttagcttcttgttagcatcacttcttgttagcatgatgttctacagcacaaggcagctgaagaagtgaaacatgtgttgaagaatttatgcagtgtcctcagattctttcattaagagaagcaagaataataggtgcatattataagcttgctgtgttaagcaatatgttattgctatgcttgacagacatcttgtttacattcatgttatatattggggaaaccattgcattttaagaacatggcatttttttatagtattatttatactgtgcctcatatgcatgggaaacgtagtcgtctaaaaacatgatatgttttaaatccacttgtctcctcctcctaatgaaatattccaagtgctttccccccagcgtagggagttcaacgtgttctttattcaggccattctaattactgccagccacattccctcaatttattaaaacaatggcccagcttatttcagtttagtttaattcatgtgtgaaaactttacccccatcttattccatggagaacagtatgaaagctatctttctagttggtccagtgtttttgtttttagaaaagcaccggctgtttccaggctgactcaggaacatcattaatttagttgagccttgtgcaattgttaatgggcatgagatagcctagtggtgcagcctcatctggagtgcaaaatattacagtactccatggccaaatcttggtagcaagtattttttgctatctttaccctcactaaggagaaacgtgaagtgtgaggcaatttagtatagttagtattttagtagtaagtaccgtatattgaaggtgggaaataagaacatatttaccttctcctagtttttacatcttttgcacactgaaatcaaactgtgcttctccaaagtgttttgtgccattttacccaaatgcttccaacttatttagggaagtgttcattttaagagtgtggcaccttgtattttctgaagcatccttttctacctccaacagggagcagcaaggctagtcacagctagttctagctggacagtaatccatgccaaggactggaacccagaagaagtaaaagtgaagaaaataagtggagctggattaaaagatagacccacacacaaagaggcagacaggagacttaatgtttgcaatgtttcagcttgtgggaaaaccaactgtcatgtgaatattctgcaaagaacagaaatgatatcattttattagcaccacaattcatagtttattgaatgcttccattttccaggccttgctaagtggatcctttatttaaatttatccttataacaactctgtggggaaagttcaatcattcctctttgataggtaaggaaactgaggcttacagaggttgtggagctgtgtgagggtacaaccaataattagtagaagcagaatttgaatctctgtttgactccaaagaatgagaatgtgcatcattggtagggtgtacttagttgaatgctagaaagcagtggatgctgctgtgagataacttggcttagagcagaaagcaactcccaaagagagcctagagacaggtgggtggagaggagcagcagtatcctgagaatgtgttgacagtttggcaacattttatggctagatcaaaagatttctagtccagttttgccttatttttctggaggcataggtactaggcagctgataagtgggcttggttagccctttattttagggtatatggagaagtttagactgccctaaatctggcaactgcattatggtgcaagggcatcacatcacagaatccacatgacattacttccagagtactgttaccaaggacctggaccctagccagacctcaggcccttgatcctcagttcctctttccctgctcatctgtgtaagatggaggcagctgactcccagagcaactgctggatgggctgatggacagaaggagatgcaccctagtaagccataagtgatatgctttgcctagctaattctgcaaaagagaagtgacagatactcagcattgagaaattggtcagattatttataacaaaatgggaggagactggagactgggagatgaagagacacattttcagccaatggcagatgcaggacatcacagaacattctcttaggatttgcatgttggttagtattggggagattttacatatatatgtaaaaatacatatgtatgtatacatatgtgtgtatgtatatatatatatacacatatacacatgcacacatacacacaaagatatatatatacagacatcccaataataagctttctgtaaatagcagaagggaatgtgatcttgaattcttggaaaactttttccttgacatccaatatctctgaaaagaattgtcagttaaagtgtatgttctaaaaacttttagctccttctttggactatctgcctgccacttgattgtttactctctgacccactggcatgatatttctatattgattttcccaacattccttttgtcacatctctgttcaaagtttcagaatgctgaagttgcctatgcaaaaagtcaaaatgccttatcactgaaatcagtacttttcacaagctaatttcagcctgcatttccaggttcatttctacagtttccctgtgtaagttctctagtttaagcaagtgggtcaatttattgtttctgacccttatttaaagtgttgttttcacttacaatgcctccactgttttctttacctgttggaatgccaattggaagccaaattgatggcctagaattataaaccatgacaggcaacagacaaggtgcattttggcttggaaagtaattgaggtcataaatagcagtagtttcagagtggatgaagtaaagaggttcccatgttgcgtgtgcagaaacactaaggcaagccttggtccactgggtcagtgacatcggaatggaataggtcagtaccctggatagctcccaggaatacaaaactcgagtgctgacaaggttctatacttggagttgtagacctactcagctgcagactcatattttctgcacccctttttcttaaaaaggccactgtcatttttcctctaagtttagcaactagagattctaagactcatgctaatattgcccttcttctttcctgacctatgtctcaaactcacgtggggtccctgattatgctgaagggtttatcctccattttattgcatgagatgttcgccagggggtttgtctttcttcgggtagggatagggactggacttctactaacgccccattgtgtctgggcttttttttttttcatagatggcatttcattatcctgtcaacactgtgagcagattaaaattttgcccatccttcaagattaagtcccactctcacctttgctttgatctctccactgatcagcccaatataaaagtagctctctctcatcttaactagaacactttgtagtctttatagtcattcatttcaatattaatgatatactgttctttataagctatctttttatctctctgtgttatagctctccaattggcttggatgcttcttggggacatgcttcttagcaacagggcttcccaacggtaaggacccagtgaggatgcactgcagattattgcatgaactatattttttctgggaaagacagagagaacagtttcaagttttctgatagacatgttcagtcagtagcccttttcaattatatgtaaaatatatttcttgaagtttctattatttctggaagccttctccttgttgtggtgtaatgaatatagcatggactgttgtgagccaaagagacctgggtttgcattcttatttcaccacttataactgtgaccttgggcaagttacttaatccccttgagctacggtttctgcatctaggagtatggaaacagaattcactgcatatgatattcgtaaaaagtaaatgagatattgaatgtaaagggtctcaatcacttgtcacagagtgagaggcttaattcttattgatgccttttcctttttttatacatctgtggctcttgctttttaatcaaacttttctgagggtctttaaaacaccacctttacgtattttccaccatgtgctcacagtgagtccttgatctcggtgaaggacttatctttcacttccatttattcctagaattagccttaatttttttttcattaaaagattgagacttagttgctttatttgttattcaaaaaacagacctttaagctgtatgcttatatttactggggtgggagaatttgtctttgaggaaatcagggtggagtacatttgctcttgcttcttttatttatagaaagccccattatcaagcaacctgaaaaactacagtctactatagctccaagaaaattaaatgcttgtgacaaacagaggtctcaggacacacattgggcagcccagtcttcattgcttgcaagtggctgattctcagagactgtgaaggaaaagtcttagaataaatctgaatatttatgaaagaaaaccaaagcattttagctgggcttccatctctttaaacaataccagtcacagaaatgtggtttcatagtcatttaaaatacagtttacagaggaattaagctaaaccacttaagctctccaagcagctgtgctttctcagcttccttaccgagagctgcttgcagaacatccgctttgaaatcggcagctcagtcaaaaacagagctgttgatctctgagctacttgctttttcttgtcccacacttctcaggtaatgcaaaacagtggaaaaatatttggatacgagcatatatccttgccccgctttttcatgtttgaagcagccttactctcatgagtgtaagtgagcacctgaaaatgagttaaggtcacacagtgtgtgctttcataagccaccatataattgccagaatgaccgtttatattttgggggaaactttaggacttctgtcttcccggagaataatctggcacttaaagctgtgtacagtcagcctaacctcctctcacttgcacatgggagcccttggactcagcccgttggtctcttcactcttcactatggtcaaatcacattcctgtccctgtgcctgtggtcttgctcttccctactcttccagtgacattccctctgctgtttaactagccccaaccccacccattccactgctgaaagcccaagactcatctcctcacaaatagttcctacagcctcttcagttcagtttcccgtcctcattctctgccttttaccaggactgtatcggttcatttggtccttgttctcaagtagaccacagggcagtctacttgagaatgaatgtctcaatcaactgttttttttttttttggtctcagaatatatatatatattcaacattcaataaatattgtttaacagaattatcagttacatggaaaagtagaaaagcattgtcaaattgagttctattttttgaaaacaaaatatgagtagcaagaaataaatagaatgaaaacaatacttgcaaattatgtaagtaaattcaaccaaatgtgacagatggaaatttttataattgttaactatgttttatttactttttataacatattttaactaatacaaaatagtgtttaggtgttggcaaatttagttaagcagtcatgggtatcttatttaaggaagaagatcatgaaatgctctttttaaccttgttaaacaaccacgggaggagatggagactacccgtgcaaggagactgcacttatagagtttaataaaaatgtatctatcataaacttagtttctaaaacaataaaatatttgtttatagaaccctatcatggagctctctagttttgcaaatgagctatttttccacatttcattctataagcaagcatttgacacctaaatagcgagctgtagatttaacatctattgtgttataccctaaatatcaaagatttaaaaaaacactggtaggcactattgatgagaccatgaaaagagttttgaggaaaataatgcagccttttgtaccagaaaacagtaataataaaaaaagtgaatgactcatgatgctcataatacaccaaatggctaaatattactggttgaacaactcttcaactctgatttcctgagcatttttctagctaatctgtaggatttagcattcagtcgtctggcctctctgggtggggcgaggggtgggggttcatccatagccaaatgcaggagagcctccttgattgctcactagcagcccaggaatctaggactcctggtgattttccccagcggttggtttagaaagtgtgcaggcttagatacatggagagcagagtgctcggcagggcatccccagtggagcagcactggaaagctggcatcaccacattatcatatccagagtcatagtaaaatgtaccttgttaaatgtgatcttggcctgtaaagaaacaaaagactacttttaagacaaaacataaactgcattacaagccagggagtagggttgatgggaggactatgggacggcagtggggggaaattagagagttgggcacagctctcccagacagtgtctgaagaaaaaagactgtgtttgttcctggaacagaccaaaaagggaggatgtgaagactgatgaaataccaaagagagacttgggataaagacagttctaattgaaagggaaagaatggcaggacaaaagttcatggggaggagaaagaggagctcagtaatgagacagcagaaaaaaaaaaaaaaacccagctgaaaactctggagaaacttggagggtgggaggggggtggggggggggggcggggcgggaagggaaaatacaacttggatatttttcgaactctagcagcaacaaggatgtttcctaaccacatctttggctgtgagaaccttgttgttggaaattacatgtaaaacaaaaatgtgtccagattccattttgtatctattcatttttaaacctgtgtttattgggcatcttctgtgtgactacattgcactacagccggggtttcagggggcatggcttgggcatgctcacactctgctgtcctggaatgtgaaggaattggatcctgggccatgaaaggaaaagaggaaggaggaagagaaggacctggcagaaggaatgagggtgaagctggagtgacttttataaaatataaataaatcgcatcacccccttgcttaaaacccttccgtggtatctggtgctctttttttaaggaaaaattgtattattttaattatttttatgtacagaaaactcaacagtgtacatttaagccactttggtgtgacaagttctttaacctttgcctcttcgagcttggcagtgcgagccacagacttgggacccagcatctggttgctcttgagatcagtccaaactccttgctaggtgctttgagacctgcgttacctggactgagcctcgttctccatcctgtttcatctgtctttctctctctttctcagatggtcattttggggttgcgcttgattcaagtgcacttcagaggtggtcctgggtcagaagactggctgcagagctggccccactgttaggccactgcaagaatctccttgcctcttttccttgcattgtccccaccttgtcacccctatagggatgctgtaaggatgaaggctttgctcttgctttgtttgacctatctgaattggaggactcagaattcttctttctcctttcatttccactcaatattgagtccctcctaaggcctgtgaattatttcttcatatttcttggatcctgtacctttcatgtcattcccagagctaaaaccctaactctagccattattacatcacacctgaaataatacagcttcctaaatgctacccccatctgttcctcctcccacccagattaactggcattcaggacttctgtgtccaggagccagatgttttgtattttctgttatattatctgacagccctagcccttcatccatgcatgtataatccatgtaaagtggacacttatccctggaagtggtaagtcttgagctgggctctgaggcatggattaaggtttagagaggctgaagggcaggacagggcctcctgggcattagcaagggtttggaggcaggtgtgctggggccagtaagtagagcagagagtaatgggaaatcaggttgcattgggctttggctgccttgtcaaggcattagaagaataggaatcagtacaagaattatggacatttataggttacagactgggttcaagtcctattgctgtcacttattagttacatgaactttgaaagtactcagatttctcacctgttaaagaggcaatagcacccctcacagggttgttttgaaaatgaaatcagatcatacatacatgtagctcacagttgctcatgactagcatgtagtagaggttggccgtcgtaatattggccatcatcatctttatcatcatgacctttgtcatgatcattatttttttggataatggtgaatattaaagatttggaattttttaaaaacgagaggtgagaaaggatagcatggtaaaagctatgctttgagggtgtcacatttttaggaggttagcttggaagagttctgaagaggcattctcactcaagtgtggggatagctgggctactctgccaacagctatgatgatgtttccagacacagtataaaaaaatagaccaacaaggcttgataatccacaattgtcaaaaattagaacagagcaggagtcttgaagccagggaaacttcacagttttggaggttcgaacttgtcagtgaccaaagtgaagtgatctgaagccaggaggtaagtcatgatggcgaggagaagtccagtccagaggaggaaggcattcagattctgagaatgaggcagattattggagtggggccggtggagagaccccacagaggtgacacaggtgacactgaggcagtggtggtatgtacttctctgcttcagttaagggtcaaaaaaggctgaccagaggtgagaagaaggaaagcaaggagggaaggaacaatatcaagcactcctcctgagaagtggctgattggaaatgtgcccatgaaggacacagaggcccaagcttacatttaggaaatagttgaaacactagggaagcaggaaataacacactctaaggcagtgattctcaaatttgagcatgcatcccaatcacctggggggcttgttcaaaccaggttgcagggcctcatcttttgaccttctggttcagcaggtctgaagtcaggtctgtgagttgcacgtgtggtgaggtcccaggtcagcacctgctgctgctggtctaaggatctcatcttgagaaccactactttaaagggggctatcctaccaataagataaattagaaaaatgtgtatagctagtgtttcaaggtcactgcaactagttacagattatctgtaagaagacttcagagatgataaagcatgccctaatctgcaggatgaattcccaagcactcaaatttgtgaacaggtaatccaaactttttaaggctgcttgtttagcactcactcatcacttgaacatcattttttttttcttttttgagaaagaatcttgctctgttgcctgggctggagtgcagtggtgtgatctcagctcactgcaacctccacctcccaggttcaagtgatcctccttcctcagtctcctgagtagctgggactacaggcatgtgccaccacacccggctaatttttgtattattagtagagagggggtttcaccatgttggccaggctggtctcaaaatcctgacctcaggtgatccacccgctttggcctcccaaagtgctgggattacaggcttgagccatcatgcctggcccacttgaacatcttgatgctaagaaaggagaggaaaggcagttctggagtgaaggagtttatctggcttgttctgttctccgtggtatgaggacatttgcctttgatacgtttaatctctcttgttcagggtgtgcagtgcatgtggctcaggttgaagagctggtctttcccactccttgatttgcagggacatagagtgaataattaataatgagaaatcatgttctgatcatgtgcaggttctcctgccagaagaatgcccattgaggcacctctctagcagtagagaaggaaccgttctagccagacatgcaggcttgccccctctttgaccaacatgccaggcagctttggaggcgggaggaggaaaggcaatctgtttgtgtccattgtctagagtctcattagcaccagccctggtcaaggactaataacccacacttttgtccttcctctgcctttgtctgaatcagcttctaaacagtgggaggaccacctcaaaggcaggagattggtgggctacagaccaagatggacttcctgtatcttagtattgtggcagtggattggtttcatgcatccttggaaatagttactcccccatgctcccaaaatgagaaccaacttttgcaagttggctaaaaaaaagaaagaaagcaagctagttaaatccctttgattaatgctctaccactattggcaaaaatagtctgttaatatttttatgtagacttttcctttggcttgtttgcttaaggtgagctagtgtctctttcattacttgcacctctggttaggagccagagcctagttcatggttctatcctgggtgggaaaaaacagatgttaatgtgtttgcatcttcatattcatatagaaatattattttttagttctcttgaaatttcataaactgatccttgctaagtaaagtggtcctgatctaaaaatagaacagagctcttgagcggaggtgggggcatggtgccacacatatgaaagagagctggacatggtaatatggtttggctgtgtccccacccagatctcactgtgaattgtagctcccataaaccccaggtgccatggatgggaccctgttggaggtaattgaatcacgggggcaggttttcccatgctgttctcgtgatagtgaataagtctcacaagaactgatggttttataaagggcagttcccctgtatgcactctcttgcctgctgccacataagacatgcctttgctcttcctttgccttcttccatgattatgaggcctcctagccaagtggaactgtgagtccattaaacctcttacctagtctcaggtatatctttattaacagcatgagaaaggactaatacacatgggtaacacatagaattagggaaatggcatccttgccagtcttttggattatgagtctgatttttagtctctattcactaataatgctatgggtttaataattcagttgtctgtagttgtgcttcctaatctttttgcattaatatcagagtatttgcatggaacactgggataaatgaaggaggtagccccatcctcatcccagggctgaggatatcagttgcttacaacacacttgtgaccccttagtggcacaccaggtgagaagctctgatcttgggcagaattgtgcatttgatctgtttgcaagccttttagctttgacctgtttcatggccagagctatacattcacccaggcagggactgggttgataggtttattggaagtaccaggcaagaaggcctgaatggggcaccagacctgttactcctggaaaaacaattcaaagcacatttcatctatgacatcatgaatcatattactattttcattttctttactcactaggaagctttaagccacttccagtagctgaataggatggggctgctttcttgtccatggctctaatatttcccctcattagaacattcctgattatttactgtatccttttgtattatggttatttttataggccacttgaaatcctttctgcgggttgtggattatggaagagagcaaataatttaaaaagaaagctcaaaatacacttcttacccatattgggtcagtcatgtctttttttgatgcagacaaaatattttcaccctttaataaaattggtaactgaatatggtattagtcataatatgaaataatgttcctttttaaatgtgatgatcatcctgctttatttccccatctgcaagatgagaataataattatccctttgaaaatatcatatggtcaaattagttaatgttggacaagcatttcaaaatgaaactacctaataatttattagtggctccactggtgtgcaatttgagaatgaagtctgcgtttgaggaattggcatttgcattaattcatgttttcccttaaattcattacagaggtctagtctgaattctcccggctgggtgccagctgtgcccatctgtggcacatggtctcgtggccttttcctccagaagtcttgtttgagtaatcagaagtcatgtcctaaaagggaaactgagcaaatgaaattgctcatgtacttctcttaaatggaatcacttgtttgctttttaattaagatgagacttttgattaaagcaaaaatctggtggcattttattttctactctgtgcccctcgagatccattgcttgaccctgaaatgaatgatctcagttatatcttaaatgacatagtgaattaactgtatttcatgtgccagcatttccttcatgttacttagataattaagttcttcctaattcagaaagcgtgacatttttgtatggtcacaaagacagccaaggaggacaaacacataataacgaactatagtaatagctatcattcattgagcacttttgttccagaagctttgtgcattattatctccagtacaaccctgaaaagtatttacagatcaggagcctgagatcagaaagatttgactaacacgaacaaagtcacatagctaaagagatgggttgctgggatttgaacttacatctatctccagagctttgatttttctgtttaatttgtattttataaacccaaatcattgaagcatatttatgttttatttctatacacttcaggtaaagctatttttttaaacaatttattgaataccaagaagagttatgtcctgatggagtggggtcagattaaatgattctcctgttcacttggagctataaaactatataaatctatatgtgtgagaaactctcactgtatttaatgtgtttttttcagtgctactgtctacaggactctggcaaattgctgtcaaataaaagtcataaattcacagaatgcaattcctcgttgtcaatgaaatgaaatgagaaaatttctcttttcactcaaatgggctatacatttatacgatctaaattcccatattaacaaaaaaaattttagttgtttgctttccagttaggttaggatatttcttctgtttaagttgggatgtgccaataaatagggtttcccattgcagctcacaggcagagaaagtgaaactgcgcttggtagtcttttcatccgtatctgttcaacaacaacaaagtgatctccccaacctgaaaagagattgatttgccttcaagtaaatacctagttatcagtactcttagaatctgttgacttttgaagctttgagatttgatttttctctaagaatatatgcccagcactataccattctgtctgaactgcttaacaaagaacatctagaagtcatactggtgcccatatttaaaatatttatttaaaagaaactagccacagatggaaatatttctaactaaaaattatctttctcaagtataaaaacatttctcaaaatgaaatatttcccatataaagtcacttcattgtgggcttagagaactttattttccattgccaataaaagcctttgattggcgagcttttcttcgccttaaatttgaaactggagtatgtaagcagagtgtggatctgagtggaaaaactggcctaaattatgtgagtttcagaaatatcactccatgtttatttgaacagtttcctctaaaggggaaaattttgtttaatatttgaatatgtttatttataaaaacgatagaataatcagtagacatttgtgttctattagatctgagttgttctccattttctttttgtgttttccatataagggccgaattttcatatatcttatgacagagtacttacctgaccattgagaaatagctacgatttcacatctgacctttattatgtgaccattcattgtttttttgacatacgcagccttccctcggacatttccctgtctcttaaacccagttttgccgctttgtcctgtcttggattccgcacgctgcacaaaaaatggccagtagagggcgctgctggcttactttttagaaaactgctcacagcctgatttcagcactttcaaaaacatggaaattatcttaattcagtcaaagcaatcagaacgagaaaactgtcttaaattcatcaaagttgtttctttgtgtctttttctatttcgtttccccaaaggcatcaataaaaccaggcaattagtgtttcttcccttttctgcggagcccttagctgacccacagtaaggatgagtatggtagttgagggcaaccgggtgtgattatctaatttttccatcagcttgaggttcttatgtgaaagttgtattcatggagagccaaaagaaggggaaaataaaagcctgtttacactttcactttccaaccggccttgccagttatcccctgacctggtgcaatgacgagaaaatatctgtgcgaccttggcctctggattgtggactggggacggggtgtccgtggcttcggtagcgagaagcgggtgggaggggcatgattttatagactcaaaagctttctctcctttcaggcaggcagtgctgagaggtgatcggaggaagaccttttatatcccttccagcacctccattctttgagatgaactattgacagtccctcaatatttataaaatattataaactgctatgtaaatacagcgtcaagtcgaactttctagccagagctctcccgagtacccttccaaagaaaatgctatgcttaagcacctcctcctgagacattctggaacccccaccacttatataggtatatttacagaaccccatccccaatcccttcagtcattcaaaaacggtacaagttgctgaagacgttgtggtgaaatagaaagtatcaaaaataccacgggaattgcatttgctagtcatctttgtgatggcgtcagtttgtgccaacagcatcgtgataaagttctcagtggatctgaactttgcttcatgtggtttttcttcaccttgtgggcactgggcactcgccgtccttcatagctggtaggtgccacttttggccggccctgtagctggctgcagtcggctgtccttccacaggatgaaaaatgtcttccattagctaatggctgtgttctccgtgaaacattctgccccttggcctggggctgcaggagagcatcaatcaagtctcttagatgaggcctcagaggaccaagggaaatttgtataatcctgaactgtaaacatgaggaccagtggttgaggtttttggatttgaacaacatttaaaaatgtctatttgagtatctaaagtaaacctttattttaaagagaagctgaggcttgctgggtggccttcaggaggtcagctgacctttctgcctccgtttccctgtcttcaaattggtggagggagcaaaaaaccttactcttctgttgcacaggagaatccatttaatcttgattgattacattaaataaggaagtcaggctttctttatgccacttcacaccttatgggccacattataatttccctgcctctcggtctaagtgtccactagtgatcactgcctggtgtggttttttgttggtgttgttgttcctgtgggtctgtagttttcctttcagccatttcctttctcttgttcttctcctccccacttgctaaccaaggaagaagggctaaggggctccccacccttcctggcggtggcaaaacagcttcttgttcatgagggaaattgtggaagcatagatgtaaaaaggagagaagtatgtgggtgtgtctgtgtgtgcacacatgtgcatgtgtgggtgtgcatgtgtgtgccatttagcagttgcctttttttgtgatggtttgttgctgttggcacctgtaaaagcagtcaagctgaagaaattcctttggaaaaagaaagaactaacttcctagaggtgaatggaaggttgctgaggccttaaggcgaaaatttatagagagctgagttttctctgttttcctttgcattgcttatttgaaattcttcattgttagaacacagttttgtttaccatgccccccattattttcccttaaacaataccataaatattatcatttggggaacaacctcaatttcccagaattcatgacttttccattttaatagacaatgtatcagaacttaaatcttgtgagatcttcttaaaagagtacttctcaacagttttaggaactgttttttactctagcctttgaggacaagatgggagggacactgaagaagttgttccttttgtacagagtaggcaactcagaaatattatggaatgacagttgaatgacaacatgctgattgtttgctcagtaataaactagagttttgctgtgtatttttatatattcatataaggctatgcattcttgcaaattagcaattaattctactgaaatatctgaataatgttttccataggttacactatccccctcacaaaaataaaaaaaaactagacataatattttgttgctgaccctatgttacagacttagaggtttttccaaagactaggaagaaagttatttctgggttggctagctagaaatatgctatgctaattttatctctaaataccatatgatatccattctattttcataaatatagattaatttcacaaacagagttaatcacgtttgatgtttggtttcatgtttctaaataatttaaaaatcagcttcttttcatggccacttctaggtaaatatgtaaaacaaagtaaaagagaaaaagttatgacatcatatgagaaaagctgcaacaattcatagttttaattaagaggactagttggactctgggcaaacattttattgtccaccaactaagatgtcctctctgtgtgagctgtcacataccaaatctaaaaatctgtttttgatatttaaaacagctcaaaatcaacatgaaaattggcatgctcttctcatatataatttggggaaaaatatgaagtgagaacaggaaagatgtattaacttcttaaaaagtaatctttaggagcaaactgaaagagttcccagtggtcaaagctggaactacttgagcaatgaaatgaatagcgtattattggattattctcaaaagtagaaaatacatagccaggagtccataataaagtaaacgtaaatgatgtaataaataaatataaagagagaaaatagacaaatctcccatacagaaggatctcagataatttatgtaaattttgtatcttcaaggaggtgaagcatagctccccacacctgaagtgtggggttgtgcatagcaactcctttccaaggagcacaatatggaaagcgggggaaggagtaatcctatagtcgaggaactggacagacactgcttcagccaggcgatcaaagtcaacatcaacagcaatgaatcatgttagtagcatgtgcctttagaatgagatgaggagcatggcactttacttctgtagtcttcctcccccacacccacaaaccccgtctaatcatgagaaaaacatcacgcaaatttcactaacagaatatcagagaaaatacctgacctgttttcccaaaaattctcaaggttatcaaaaacaaggaatgtctagtggcacctaaggagacatgatgaataaatgcaatgtggtaccctggataagatcctggaacagaagaaggacattaggtaaaaattaagaattgtaagtaaagaatggattctagagtgtccgtattggttgagacaaatgatgcagtaacgtatgatgtgaacaatagggaaaactgggtgaggggtccatccaaaaggagactgtattgccttcgcaagttttctttacactaaaactattgtaaaattagaagttcatttaaaaaaataattcttattatcatatactgttcctacatctcagtgtcattattttcctaaatcttggttgatttttaagagatgactttaaattagacaaaagaaaacaggttctccaagatttgctatcatacacatttattattgtcataggtgccatttgcagcgctctgaataccatggttgcctttgcttataaatagacttataattttatcttacagaaggtgtttattaagaatccaaagtatgagaaagttcattccccatttttaggattgtcatgactatccttggaggaggattctctgagtaacttagtagtagatggccgctttcacattcagtcaagaattgtgtaattttcagttgatggtttagaaacaattaaatggtctccccctttctgtgcacattgctattaatgttacagctatgttcataaaaccaagattgttatagtctttatcgacatgacattgtattttcttgcattagtaaatccagtacttttaaaagaaagttaaatatatttcctttgaggtgaaaaaacgacttttccatccaaaaactggaactgttcataagatgtgtaaaatttaccctgcatattgataaacctatcaagattttgggggcttcattgtttcatgactataaagagtatgttattatgactatgaaagttcaaaaatattacagattcctaaatatgccatacatctagaggacaaggagacactttctgggagagcccttgtgtgaggcccaagccccaatttcaatccattattacctttgtattcatttcagaccaagtctagctctttccacagtttccatcttagtgttcaactacagtctgggacagacttttctgcctacagaaagaaacacatggtctgggcttcatcatcaaaactccttgtgtgatcttggggtctttgaggagccagtgggttcttcaattgttctcttgtctgcacacaccctggtcaccttccaaaatgaaatcccgggagtcaaatgtgcaccacatttatgagcgtgttgactgaccagtgactcatgagactatcacacaactcatgatgaatatgtcgttttcctctttaaaatgactgctgtgcaatatggttgtgagcagtgtgatcctacagtttccttttaacccagtaaatacttgctgtcttattctttgaaagaatagtttagtcattttgaaagaactgagtgagcaactgctttgtgcaattactgagtattgtatctagacttgagacaaaataatgtcctagtagattttacttcatcttttaaacacacacaagaatttaaattgttaactagaacacacttgaattttcccatgtttaatcattaaaaaggcaaaacttaatttcatcaagtgcaatcaaagaatttttcatagtagcaattaaaaaatatgaaactggaatttcaatgacacaaaattaaacagctgctgtgttatatttttaatcttcattcaaatcaaatggcaaatcgcatttttcttcaggatttttttttcttttcttttttaatattagtgtgtgtaaaggtggtttcagtaattcaaaaaccttctgaaacatgctgcggtatatttggaaacatatttcaaacgttactctagagtgagtaacccttgtatttctgtaggacacagaaggcaaaactctttggagaaggactgattggttagcttgctttggcatgagggaacttccaactatattgagctgtttaactaaggaaaccaaaacctattttgctcggtttgcctttctttctgtactccatgtgtggcatttaccataagagaaagtaaaaaccacacatgaagcttgtgtccttctcattccttcctatttccatgctgggggagaagggctatttttgtgatacccagacttccccacacttttatgtgtaagacaacgagctgggacatatgtagctgatatataattagccaaatggtatctttttcaccccagcacaaacacgttccctctgattttcctcattgacttttaggtttaggcactaaggaaaagcagcagcccccggtcaaaccaggactccaggttttgaaaaaactacttaaatacttttaaaaggtagaactatttaattatttgtcatttcaaagccttccagtccttcttagtttacctccatttttttttctaaaaatggaaattgagttctttggtcttgagcactcttagttctaaagacgtattttagctcattagttctcatcaaacttctctcctgaccctattctcagagcggatttttctaaagtcatatttgcatttttaattcaaattaaaattaatttcaattaaaatttgttttaattcagagttttaatttcttcagggaccttctgttttcatatcttttttcttgttgcacaggggattgttctgaggcttagctgttctcacaccagccaggactacacgtacagtgacttaagtggtaaatcagtctttgggtaaagacttcagctcaccattttctttaattataatttactggataataagggaattgctttggctagtagaatttatttgaccaggataaggtaggacaagaactctgacttattcaatgtgaaaacccaatgaccattaggacatagttaataaagcaatctgaaagagtcactgatagtaatttttttaaaaaatagagagaccccctacactgaccttgtaaatagtcttagtgcccaaaagaagtaaaatgttggaagaaagccagtgacaaagaacttgtatttcgcttattttgccatcgatgccttatgaggtttcttgtgaagcttaatgagacagtgtaaaccctgctttgtaaatgtaaggtactatccacacgcaaaatattattattattactaaattataggttgtgttacatggaggaatactgtactcaaacaatcatttttgtgggataacaacattttgtagcttatttgcaaaagttctctacacagttaaaacaatggtatgttgattggaaagcaatttaaactttcccataatatttgttcaacattcttttcattgctttaaacaagatgcacccattcagaaattatataacatcattgtacaaatggcatttgagtgaaagggaaggttataatgaagtattatctaccaatacatttttaaaaattcaggtcctgcataacaattacttactggaacttaataggcataatggctatcaggaagtgacaccaaggcatgggaagaattttgtatgttcttcatattgggcacctctttatagccgtattatttgccaaggaaaaacaagagagggtcattgctttgtactttggggccattattgagaacagttttccccattggagtgtgatgtcatcgacctattggaaagcatacatgggcactgaatggatgatttacagagcatctccccaagtttctttgcactgctgggtttatgaaatgaacatagtgattctgagatacaatcttctgtgttttgtatctcaaattgtcccattgctttggtagtcctgattaacatcttaatttctaaatgtgtgttccttccaatacaatagccactagacatatggtgctactgtgcatttgaaatgtggctagtccaacttgtgatgtactgtaagtactaaatacacactggattttgaagatagtgtgaaaagaatggaaaatatgtcaataatttttatatcggttatgtacggaaattatgttggattgttattagagtatattattaaggttactttcatcttttctttttgctttttgaatgtggcactagaaaattttaaattacatatgtggcttgcattgtatgtccatcggacagcagtgagctagatgggatatggcatttttctgcttctgatgagaatgcgaaatgtggaaacacattaggtcactcattagaacaattctgagtgttccttaaacttcagctaattttgatgggaggctgagaattagatcaagctctgtttatccaaaaacaaagatgtggaaagctagtacagcacagtggttcaacttggaatctgctgaagggggagtatctgtctgatcctgatttgtgaaagaaataccgtaaactgcatgggcaggaatggaggttacatctttgatctatcctagtcaaaagtgggctctctcctagagtctcttaggtgactattaggtggccttagccaaagcttttataatcacacagactcacccaaggacagccctctgatctctcaaggagaatgcaatacaacatagactttggcaactgaaaacctcaaacctaatccttggtgacttaaggtttctgttggtattcacagaaatgcctttggcttgtcaaaatacgagttgcaatatttgctttagtatctgctcaccatcccatcccttctctctaaactcgttcattaccattaggatattctgggtggctgggatggttcatgtaagtggggacaagacttgccaatatgttatcaatgtcttgagcttaaaagtacatgtttggatgttcaccagagtgaaaatttgtgtctaatcaccccctttccacctcccttttgatgaaaatcatcaaaatgtgagatgaaaggatctaatgggttgtctgaatgtttttcccagccctgttggaaatgattgaggcattggctcttcaacatttcctctgagaaagcaattccaaaggttggtgtcaacttacagcttagtaatggactaatacacattatcctgtatgcaactctaaattatagcctgccagctgtgattctggaagtttggaataggttccttcccgagattctaaacagaaatggctttgaatgttgcgggcatgagtctgtctaacccttctaaaggtggcataaacgctgtaacatttctattgatttttaacatccagctctctagaaaacagaaaatagccaaaatttgacaggcattttacaaaataatctgatccttcatagatgcagagtaagagctttgttcacaagtgacatttgtgcttaaacttggatcaaaccttccttgtttctttcttatgccagttttattatgtggagttgaattacattttactggatttaaaataatgctttaaacgttattttgtcttctttagtttttctttttatcatttaaatatctgtagcctcaaactcataaaaggagagtacaaacttctaataaagttccttaatatttaccctgatgcataaattaaagaaatccaaatttaaacaaggagccctgttgcatatatttagttgtcaaatataatgcccagggttggcaagggtgtgcattaagcagctccagaggagagtgctacaggagttaaaaatcatcttcatcttgctgaaaggcagcttggttttactgatcatcataagatttcaaacaatgtacatactgagcaattcaatttctgggaattgttcctgcaggaagtaattaagaatgacaggaaagatttaactagactgtaagaatgctcattgcagtattctttataatatcacaaagtaaaaaatctagaaatactattactggtagactagctatataaattaagatgcatttatactgtgaagtactatttagccattttaaatgacagcttataatatattttaagttaaaaaaagttacaaaataaatacattacaaaaatgtatgtgaatctgatttgatactgataaaatgatatctattttatacacatgcatagaaaagactgaaatggttacaaaaaatgattaatgttggttatttctgaatgttagaattataagggttttgttttttatttttagatgtatttattttttccctttgagaaggtacagtaactttggcttcatggacagttttccgaaactgttttcaaagacattaaaattttcctcatctctctatacgtggttagatgaataaaaggtacataaacttaaagtaaggataagacacaagtgagggatgtgaaggaaccacactgtgattcagactacctcctctacctgtctattaactgtcttaatagctacactgttgaccttgttcttttataatcataatgatccacctgccctctcctgagactctttttcaacatggacagcacttgtcgtccctcccatatcatattgtgtttaatttaatctttagcagatagatacagagtgtgtgttcaaactagttttttcatttgttaaggtgctttggaattgtaatccaaatttcgaacaaattatatactcaaaatatatgacaatacaatgaaatttttgtaaaaatattttaacaaactgacctcatgagcaaaaactgctgtagtttttaataattctgtttacagatgattttattccagtatgtgaatcttcccaagcaaagaggggaaaaaaagtgttcatttttaaaaatgacatcatggaagtccttaaagcatctaatacaagttaatgaactctgcaaccatttatactagccctaatatattatatatacgcacctggaaagtcatccaacagatacttacctgaacttcaaaaagttgtcagtctagtaggggaggtgaccgtccatacaatgagaggcagaacataacaatagtcagaagacaggcaaatctaagggctacgggagcgtcacaagggaaagggaagtgttagggatggggtgatagtagaggtggcatttgtgttaggacttaaggccattattggattaactgagaatattgaatatgaatagtggattagttaaaaatactatatagatgttaaatttattgagcttgataactgttctatgggttatggaagaatgtatccctttaattaggagatacacgaagaagtatggggatgggggagagagtgagaggatggctgagcaaatgataacatgaaacattaacaatagttgagtgtgggggtaaagggcatacagacactcttcatactatttttatttttgcaatctaaccgttagtttgaaatcatttcccagtaaaaagtcttttaaaatccagctctcagataagaggcaacagaggatagctgtccttattcactgccttctgaagaccagaactgatgccagctgcttttttatttcccccaaaatgtggttcacgctagttatttgttgacttcaccaaaccaccgcataatttcacacaacccaggatggagggtagcagcgtctgtttcacagaacccaaggcctgaaatagcaggagggctgtgttgtggtgtggcgtggaagcctgcgccctgccagccacacttggcctggtttcagcagtttgctatcagaccctacattatggaagaacagccagggcaaataaaatggagagtcagacttacaaaacaaagcttcctgcctcccaactagtactgccttgcttcctccttcaggatagcacccatttctgtagatatttcctggtagaaatgttgtgacttccctgacattgctgttaaattgtagttcctgcaaaaggaggccaagtcctcatttctggtgtccagataacctcctccaggtattttctcaatatggttcagacctaagttactttatttcctgtgccttttaaagacacctctattcaaaaaacacattttccagagtgctgtaagttttaaagaccccaagtgacaatgtgcctgaagaggaaatcagccccctgttagtgcaaggagctgagtggctgaagaagcccagactgtagtgggcttgggaactggctagagcctgttctctgcacgggctcccactgccacacaggctgcagggggagtatcagtgccccaccccactccccagattccaagggcgcacttaatgttcaccacgtgcagtgtttgtcacctgggcttcagtgttagtgccgccaggttccagcagtggctgttctctgttgccttttacctgagagctggcttttaaaagactttttactgggaaatgatttcaactggctaatacggccatgggcagttagtgagcttcactaagcctcagttttggcatccaccaaatggagataataatagtctccagctcctagagttgtgaggatgaaatgcaacagacaatgcatataaattatgaagcataagtggtggttcttgctgttttcttgtgcttgttaagagtattactatgtgagcctggcttctttcctttctccctcccttccgtccccaaacttaccggtattacacagttgatacaacagtgttcaagatactcctcgtttgaagataagagtcctgcaactgggtacgagtaaagtgtcctttggaaaactgtgatgtactcaacaaatgcataaagatgagcatgttttaattgtccaggcccacacaatgtggatgattttcatattctatcactagtattttctgctcttccatcctgcaatgccctaacctcccagggtgcccatgcctagaatatccctttccttcaccctgtatttattgaactcagtcctcaaaggctggctgagtgtcacctactgtgatctttgctcacaatgagagcagaagaaattgctcctggaactccctttacctaacactgtaatatgtaatactttttatgttttatgtaaccttattacataaaatgatatggttttgctttttatactcatctctcctacttgaatataagtttctggaggctaaagcttgtcatatttttcctagttccttcatagagcctggaaagtatgctgctcattaacaattgtgctggggttgtttgttgttgcttgtaaattttttgaaagcgtaaaagcatgcaggaaagtactcaaatcaggagtgtacaacttgatatttttgacatgaacataccatgaaaccagtcttcagatcaagattcagaatataaggagaaacccagaagtccatattcagtctctcctcccccaagggtaaccactacatcatagattagttatgccccttattaaattttctacaaatgtcatcatatggtacatatgcattcatggctaacatctttcatttcacattatgtttcagaagcattcatgctgttgtatgtagatgtggttcattcactaccatgactatgtagtatttcactgtgtgactatgccattatttatttatccattctgctgctgatagaccttgggaagtaactgttttgtgaactgaaatgaatactaacatctggctcttaagaaatatttcccaaggaaagggtgacagcacagaaggttagattcacgaatgctagagaagtagccctgatttctcactttttcaaagagcattgacagatggctccccatatcaagagccagcacaatctttcagaatcaggacagcccattttcccagaccatgtgatatttattctattctagcctggctggttgctaaattggtaaagatcagagagcttttgggcacagtggtgttcttagaattctgttttgctattaaatattggcctacaaatatatagctaaatgtgttttactaatgattggggtggcattaattgtaattacttgtcaatctaacttgttgctggtgtcttaatttccagcatatctgagaggtttttaaaggatttcactagcagtttggtaagtcatttgtcaataaatgatgaaaaggttgggctatttatatttcaatgttaccattttaatgggcaactgtctatgtactgtccaccgcagaaatgctttttcctcccttttcttgaggaaagtgtctaaggtggagggaggtctggttgctatggatatctgaaattttatgtttacaatttaagaggtaagctgaaacctcactatttggtctccacctgagtggcattcacatttagaaattacaagattgttattggctatctggagcttgaggatgtggctgagtcctggcagttaattaaaactaggctggttttcaatatcagaattattcagcctgttttggtaggatgtccgtaaagtcctcactaccttgcaatgtgtttttgatgtaaaaaaaatatttaaaaaggaaacataacagggtagcttgtcctcatttactggagaggttggttgctccataagcttttcagagtgggattctgcccccattgtttcttgtctgttagctctgtaggttctaggctacagtatttcagtgttcacaggacagctaattggagaacaaagccctggcattttcctggaaggaagattgcttcatgtgatgcttattgggaagatcgtagaaaaactggttaattcagagtattgctgcattaaatgtcaggtgaaatattttctaattattcttttattatcagtttaatcttttaaatatgtttttaagtatagaagtaactcatgaatactttttttttttttggagacagagtctcactttgtagcccaggctggagtgcagtggcgcaatctcggctcactgcaacttccattccacctcccagttcaagcaattctggtgtctcagccgcctgagtagctggaattacaggtttgcaccaccacacccagctaacttttgcattttttgtagagatggggtttcgccatgttggccaggctggtctcaaactcctggcctcaagtgatccacccactcggcctctcaaagtgctgggattacaggcgtgagccactgcgcccggcctatgactacatttttaacttaaaagaatctaataatactgataaagagaaaattccacttgacttattttcatcagttctagtttgttccacatagatattcctttcatcagactagtttgtattgttctagttcagaggtcagcaagttctaacccaaaggccaatccagctccctacctgtttttgtaaataaagttttgttgaaacacagccacgcccatttatttacatattgtccctggctgctgtcacactgcaacagctcagctgtgtagccgcaatacagaccacatggcccccaaagcctgaaatgtttactgactagcgctttacagaaaaattttgttgatctctgttctagatcattttcgtttgcattttttatatttaaattaatatacagctaaatgttattttactattgattgtggtggcgttaatcataatgacttgtcagtctaacttgctgccagcgtcttaatttccaacatgtctgaaaggttttaaaggatttcacaatatgcaattttatatttactatttatatatgtataattgtgtctatttttacataaatggtattatatagtacatattgctcaatacctatttttccatttaacagaataccttcaagatttgctgttcatgtcaaaatatgttgctctctacctcattctgtttagctgtcacatattgtccatagcaggataaagttaaacttattttatcatctcctatgggtgactatgtagcttatattcagcttttactgttgaaaggaatgcagcaataaaaactggcaaaagtctctatttctcctaccagtactggaaaatcacatacacactatggcggcacattttcacaacagagaaattaatgtgataatcatggctactataaagaaaaaaggggttaattaacttggtcagggacttcaaacatgacagtgggcattattcagaatggacattttatgcttctaattgctgggcagggactactctagggaaaggcctgagcagaatggaaaaatctgtctacctaaaggacatatgaaggaattagaagtgtccttgggtagggtatttgtcagcttgaccccgcctgagaaaatgtcaagatcacactgcatatattagaaacatgaaaccattgaatatgtcaagcttctaggaacttccacaattatcaagttgaaccctttccatttttagatgaggacaccaagcctcacaaatgttaagtgatttgttcaagatcatagtagtaggtttcgatcatggcttagcttgtccactgacactagaaccaggggctaaaagttgaaatacctgatttttacaactcagaaggcataagacttacagtagcacatcattttaaagttttctagtttgtcagactatctttatttattttttaattttttttttttttttgagatgacaatgtctcactctattgcccagacttgagtacagtggcacaatcatagctcatttcagccttgaattcctgggctcaagtgatcctcctgcctcagcttcctgagtgtctgggcctgcaggcttgtgtcatcacacttggctaatttttaaatgttttagtagagatgggggtctcaccatgttgcccaggctggtctcaaaatcctgtcctcaagcaatcctcccaccttggcctcccgaagtgctgggattacagatgtgagccacagcagccagcacagagaatctttatttatactttttaaaaacataatctctaaatatgaaaattcatattagagtagcttcatttgtgataaaatatcagctgtcattgtctcagcaaccacagcaaagaagagtccaaatgaatccacagccggtttgagattctcattcctaacaatgccagtctgtttgttcatgtgtattaaagtatcattagaaaggaagcagcctcagatgaagccattttagccattgatgtgtctcaaaagggttaatcagatacagaaacttaacaatttctagaattgtaaggaaataattttgtttcttgtaaagcaagagtaataattgatgctcacgtgaattgacatttttggtagcttagaaatggcaccaaatgtgggttttggcaaaacctatattttcatgaagaaatggcttttaaacatgttggcatttctgttcatgatagacacaccatttgaatccaaacccttgcagaggtgacatgacactgcactgaaggcagtgacacattttttttaaaaaaaacttcacataaaattatgtaaacacttaaagtgaatgagacacctgcctttgagacacccgcctttcagtcgcccttgttatgccacccacagccttttctccttggctattcttagcaggatttattttgagcctagtggtggtaaaagatgtaacataaaatgaaacccgacacttagagctccctattattaattcataaattcagtctgggatcacccattggtgccaatgaaagattagcctagagaacaatcacggttcacattctatacagtagtatagaagaaagtttgccactgataattgtatttatgtaagtgctagcaataattgcctggtggtcttggaacagtgataaagaagaaaatgaccagagtaaactctgctgttcaatttcttggactaaaaactgcatggagacaggaaaacagcctgaaaacaaccaaccatggcccccctcaatgatttggagaaatgaaacaattttggacattttcttaggttaatagatggttactgagtacttctggagttcctctagggtataccggtacactattaggtactaggggtcacatgttaaattacaaacaaaagctttggttcccaaattatagcccttgttaggaaaagcaaagaaacaaaacatgatcaacatataagtgggaattttttcttagtaattcaagtaattcttaaggcttccattatgtaaacctgtggctgaacttataaaatactgaaacaactcattgaaaaccaatcagttacatatccacaaataaaatggtatgataaatagttctttctcatagacactgttagtttgttgtcttggcttcatatgaacagagaatgaaggcaagtcctcattgtaaaacaccaaagtcatagaataaagaactcccagaactggaagagactttaagttcacctggttaactgccaatatcatcacatgtattatccacctggtggattttacttgttttaaaatccctgcctgacttctccttgcctctccttgaattttaaaattgctatctcatactatcacttgagactgcaaatcctttttcatactagcaaaataaaaatataagaatataaatatacacaaaactacaaagtaaaaggaaatgacttgtagcatctcaaagttaagaaaaaacaccgaggcttttttgttcttcgtttttttttgtttttgtttttgttttttgttttgtgtgtgtgtgtgtgtgtgtgtctgtgttagaaacacttaacataagatctactctcccaacaaaaatttgtaccataaattattgttaactatagatacaatgtcctatagcagatctctagagcttattcaccttgcttgagtgaaatgttatgcctttgattagtaacttcccattttcccctccccctcagcctgtttaccaccattctgctctttgattctatgaatttaactattttagagacctcaggtaagtggaatcatgcagtatttgtctttctgtgactggtatatttcacttagcataagatccccaacattcattcatgatgtcacatattgcagaattttcttctttttaaggctgaatagtattccgtggcatgaatataccacattttctttatccattcaaatgtcaatgaacatttaggttgtttccacatcttggctattgtgaatagtgtttcaatttacataggagtactaataacacttcaagattatggttgcatctcttttggatggatactgaaaagtgtgattgctggatcatacagcaattttatttttatttttttgaggaactgccaaactattttccatagagactgcaacattttgcattcttgctaacagtgtgcaagtgctccaattaaaaagcttatgcacagcaaaggaaacaatcaacagcgtgaaaaagcaacctaaagattgagagaacatatttgcaaaccataaatctgataagtggttaatgtccaaaatatataaagaactcctacaactcaaaagtttttttaaaaaaactaataccctgattaagaaatggacgacagatttaaatagacatttctccaaaaaagacatacaaatggccaaccaatacatgcaaacatgttcaatgtcaacaattatcagggaaatgaaatcaaaaccacaatgagatattgcctcatacctgctagcatggttattattttaaaaagacaagtattagtgaggatgtggagaaatttcatgtttttttggtcttagctgaagtatacagtaacacagataatttctttctttccattaaaggagctagtcagatgtgacctcacgtacctcacatttctcataatactctcatccaactgctaaataggcaagcaaatattaaattcaagaatggtgtgtctgcaagagaatagttattatagagaagtagttactgagaaattaatgaaatatgtgtatttgtcatataaaataaagaactcataagagttcaattatatacatggctgatatgctgggaaggacaggaaaataattgggaaaactaatgtcaaaacgatagctgagtttttagtaatgaaccatttccctggacttgcattgatgatagtcacaagtagagtagctataatctaaacacttcttactaaaaataagatcctagaatatccatagactgggaagttggccatagatagtgcccagatttatagaaaccaccacagaatggcttttcatctgtatctggtttttaggtgaaacaaggtgtgtttaaaaagcatatactggaaaaagagaaaaaaagaaaaaatctgtagaggaaaaatataaggaagagaagaaaattaccaaaaaagagtactgtaattagtacattttgtgtaatgagatgatctcacgttcagaaaacaagaacaagatgttgtggaaaaagcagaggacaatagtttggaaattaaaaatacgattgttccaggagaaaaaaatcagacatagccagaatatggaataatctataagaatgtgaatgtctactaaaagggaatgtcattttttaaagtgtgtatggaataggtgggggacatgattggggacaagactgtattaggttaaaagattccaaagagaagtaacagttcattgtagcattattcacaatagccaagatatgcaaacaacctgtttgtccacaaaggaatggataaagaatatgtctcacacacacacacacacacacacacacacacacaaatactattcagcaattacaaaaaaagaagaaatttgcaacatgaatgaaacttgaggacattatgctaagtggaattagacacagaaagaaaagtactaccttatctcacttatatgtggaatatataaaaattaaattcctagaagcaatgtcaattaccagaggccagagtatggggaaaatggggagatgttggttaaagggtacggagtttcagttacgtagggtggattagttctagagctctaatgtgcaccatagtgactatagttaaccatagtatattggatacttaaaatttgttataatagtggatcttacatgttctcaccacatggacaaaataggttaactatgtgaggtgatgggtatgttaattagcttgactgtagtaatcattctgcaatgtagatgcatatcaaaatgtcacattgtatacctcaaatatgtacaatttttatttaaaaaaatttttccaaattcgatgtatggaccttaatttaatcttcgttcaaaaaaaaaaaagcacctatgaaagacatttagcaaacagctatagatatatgcatgtagatcagatattagagaatattggggtattatcattaattttcttggtataataatggtattatgattggtaggagaatgtgcttgagttatgagatgtttgctgaagttgttagtgatgaagcatcattatagctgaaatattctaaatggttccaaaaatattaaaacaaaaaaatgcaaaaatattattatactttaccttttcctattacaatgacaatccatttttaatgtagaagaaataaatatatacagaaaaacaagaagaaagtttacaaccaaccataaacacagctctcctccagacactgctaacaccttgatgtttgccatgtatgtataatatatacttatatatgtatacctccataatatataatatatatacactcacacacataataccctaatttattgtacccatctcctccagtgagtggagttttacttattacttgggcccacttcttccttttggtgcctgaggctttccttaagcgtgcaaaacttggggtgcttctcaattccctcttgttgagaccttagcagtttgttttcttatccattctgtcaatgagattttcctctcatttgcattagcccagaagggcaaggagcatttttatctagatgagtgtatcttacacataacaaattggttgcatatctttgctcactgatactttatttagcaggctaatctgataaactatttctcaagttataataacattcaccatggtggtaaacttgataaagtttctgagtctcgaaaaacagaagtcaattgcttgcaactacattgcattgtaggtaatccaataaagaatttcttttcatgttgacaggataaaaattggcagggagcaggggaaggtgttaacctgttagggaaaatgcaggataatcacatatggcattttattgctttggaatctttttattgtaatatcctcattttggatgaggtaacttggcatcagatagatccagcttcaaataatggctctgttactttttcaccttggacaagttattgattttttctgcccatttttctcatctgtaatatggatcatgaggtatgtatggaaatctcataggtctgttgtaaagatgtaatgagtaataaggtcatgtattgaaagctttttgtaaattattaagtgctaatggtggtgattggggtgggatgtaggtagtggttgtggtagtggtagtagcaagaattagcagtagcagaaatagtgacacaagtaaaaatattagcaatggatcaccttatttatttttaataaataaaaaaccattttttgtgatgttagggtgtcaattttggatctttcctgctttctcttttgggcatttagtgctatcagattccctctacacactgctttgaatgtgtcccagagattctggtatgttgtgtctttgttctcattggtttcaaagaacatctttatttctgccttcctttcattatgcacccagtagtcattcaggagcaggttgttcagtttccatgtagttgagtggttttgagtgagtttcttaatcctgagttctagtttgattgcactgtggtctgagagacagtttgttataatttctgatcttttacatttgctaaggagaactttacttccaactatgtggtcaattttgaaataggtgtggtgtggtgctgaaaaaaatgtatattctgttgatttggggtggagagttctgtagatatctattaggtctgcttggttcagagctgagttcaattcctgggtatccttattaactttctgtctcattgatctgtctaatgttgacagtggggtgttaaagtctcccattattattgtgtgggagtctaagtctctttgtaggtcactcaggacttgctttatcaatctgggtgctcctgtattgggtgcatatatatttaggataattagctcttcttgttgaattgatccctttaccattatgtaatggcattctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtttcttttaattggagaatttagtccatttacatttaaggttaatattgttatgtgtgaatttgatcctgtcattatgatgttggctggttattttgctcgttagttgatggagtttcttcctagcctcgatggtctttacaatttggcatgattttgcagtggctggtaccaattgttcctttccatgtttagcgcttccttcaggagctcttttagggcaggcctggtggtgacaaaatctctcagcatttgcttgtctgtaaagtattttatttctccttcatttatgaagcttagtttggctggatatgaaattctgggttgaaaattcttttctttaagaatgttaaatattggcccccactctcttctggcttgcagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaatgttggcctgccttgctagattggggaagttctcctggataatatcctgcagagtgttttccaacttggttccattctccccgtcactttcaggtacaccaatcagacacagatttggtcttttcacatagtcccatatttcttggaggctttgttcgtttctttttattcttttttctctaaacttcccttctcgcttcatttcattcatttcatcttccatcactgataccctttcttccagttgatcgcatcagctcctgaggcttctgcattcttcacatagttctcgaaccttgactttcagctctatcagctcctttaagcacttctctgtattggttattctagttaatacattcgtctaaatctttttcaaagttttcaacttctttgcctttggtttgaatttcctcctgtagctcagagtagtttgatcatctgaagccttcttctctcaacttgtcaaagtcattctccgtccagctttgttccgttgctggtgaggagctacgttcctttggaggaggagaggcactcgctttttagagtttccagtttttctgctctgttttttccccatcttcatggttttatctacttttggtctttgatgatggtgatgtacagatgggtttttggtgtggatgtcctttctgtttgttagttttccttctaacagacaggaccctcagctacaggtctgttggagtttgctagaggtccactccagacactgtttgcctgggtaccagcagcggtggctgcagaacagtgggttttcgtgaaccgcctatgctgctgtctgattgttcctctggaagttttgtctcagcggagtacccggctgtgtgaggtgtcagtctgcccctactggggggtgcctcccagttaggctgcttgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccgggctgctttgtttacctaagcaagcctgggcaatggcgggcgcccctcccccagcctcactgccaccttgcagtttgatctcagactgctgtgctagcaatcagtgagattccatgggcataggaccctccgagccaggtgcaggatataatctcctcgtgtgctgttttttaagcccgttggaaaagcgcagtcttggggtgggagtgacccgattttccaggtgccatctgtcacccctttctttgactaggaaagggaacttcctgaccacttgcgcttcccaagtgaggcaatgccttgccctgcttcggctcacacacagtgcactgcacccactgtcctgcgcccactgtctggcactccctagtgagatgaacccggtacctcagatggaaatgcagaaatcacccgtcttctgtgtcgctcatgctgggagctgtagaccggagctgttcctattcggccatcttggctcacaattaaaagaactagaaaagcaagagcaaacacattcaaaagctagcagaaggcaagaaataactaaaagcagagcagaactgaaggaaatagagacacaaaaaacccttcaaagaattaatgaatccaggagctggttttttgaaaggatcaacaaaattgatagaccgctagcaagactaataaagaagaaaagagagaagaatcaaatacacgcaataaaaaatgataaagggaatatcaccaccgatcccacagaaatacaaactaccatccgagaatactacaaacacctctacgcaaataaactagaaaatctagaagaaatcgataagttcctcgacacatacagcctcccaagactaaaccaggaagaagttgaatctctgaatagaccaatagcaggctctgaaattgtggctttaatcaatagcttaccaaccaaaaagagcccaggaccagatggattcacagccgaattctaccagaggtacaaggaggaactggtaccattccttctgaaactattccaaccaatagaaaaagagggaatcctccctaactcattttatgaggccagcatcatcctgataccaaagcttggcagagacacaaacaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattctctttgaaaactggcacaagacagggaggccctctctcaccactcctattcaacatagtgtgggaagttctgaccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatatgccaataacagacaaacagagagccaaatcatgagtgaactcccattcacaattgcttcaaagagaataaaatacctaggaatccaacttacaagggacatgaaggacctcttcaaggagaactacaaaccactgctcaatgaaataaaagaggatagaaagaaatggaagaacattccatgctcatgggtaggaggaatcaatatcgtgaaaatggccatactgcccaaggtaatttatagattcaatgccatccccatcaagctaccaatgccttccttcacagaattggaaaaaagtactttaaagttcatatggaaccaaaaaagagcccgcattgccaagtcaatcctaagccaaaagaacaaagctggaggcatcatgctacctgacttcaaattatactacaaggctacagtaaccaaaacagcatggtactggcaccaaaacagagatatagatcaatggaacagaacggagccctcagaaataacgccgcatatctacaactatctgatctttgacaaacctgagaaaaacaagcaatggggaaaggattccctatttaataaatggtgctgagaaaactggctagccatatgtagaaagctgaaactggatcccttccttacaccttatacaaaaattaattcaagatggattaaagacttaaacgttagacctaaaaccataaaaaccctagaagaaaacctaggcattaacattcaggacataggcatgggcaaggacttcatgtctaaaacaccaaaagcaatggcaacaaaagccaaaattgacaaatgggatctaattaaactaaagagctcctgcacaggaaaagaaagtaccatcagagtgaataggcaacctacaaaattggagaaaatttttgcaacctactcatctgacaaagggctaatatccagcatctacaatgaactcaaacaaatttacaagaaaaaaacaaacaactccatcaaaaagtgggcaaaggatatgaacagacacttctcaaaagaagatatttatgcagccaaaagacacatgaaaaaatgctcaccatcactggccatcagagaaatgcaaatcaaaaccacaatgagataccatctcacaccagttagaatggcaatcattaaaagtcaggaaacaacaggtgctggagaggatgtggagaaataggaacacttttacactgttgatgggactgtaaactagttcaaccattgtggaagtcagtgtggcgattcttcagggatctagaactagaaataccatctgacccagccatcccattactgggtatatacccaaaggactataaatcatgctgctataaagacacatgcacatgtatgtttattgcggcactattcagaatagcaaagacttggaaccaactcaaatgtccaacaatgatagactggattaagaaaatgtggtacatatacaccatggaatactatgcagccataaaaatgatgagttcatgtcctttggtgggacatggatgaaattggaaatcatcattctcagtaaactatcgcaagaacaaaaaaccaaataccgcatattctcactcataggtgggaattgaacaatgaggacacatggacaccggaaggggaacatcacactctggggactgttgtggggttgggggagggaggagggatagttttaggagatatacctaatgctaaatgacgagttaatgggtgcagcacaccagcatggcacatgtatacatatgtaactaacctgcacattgtgcacatgtaccctaaaacttaaagtataataataatgaaataaaataaaataaacataaaaataaaaaaataataaaaaaattaaaataaaataaaaaaccattttttaatacaaatgttttgaggatagtgtgatgttaatcagatgcatttatggtagtgtatttttagacactctacagatgactgtaaaataaattgtatgtatttggaggtagaggggggaaaaaagaagtattacttgcccctagaattttataataaaaactaatgtttattttctatttcactgtctctagaaagagttctattttattgtaaattataagagcagtttaataataaagtcttctaaataaaacatttccactaaatttatagcatcttctatctctgctcaagattcccaattttgcataaatattccttcagtttaaatttatatttgtcgtgattcttaaatcttgataaaagagaaaaagtactcctttagaactaagtgatatgtaacagctctctcatataataaattaacttcagaataaccttcacataatgcattcattttgtttttcctttgtttataaaaaaaagtgctcttgggaaatggacaagtttctgaaacactcagttcacagcattcacttttttagcattaaacatcaggtattttatgacccaactggcacataatgcaaaaatatatgtatatatatcttttctagtggaggattaatgaggtggatgtttattttgtggttatttttagtgaagaattagtagagtggctgtttaaagaaaacacactaacacatcaacaatatggaatgatatattctattataaagatacatggacatatatgttcattgcagcactatttacaatagcaaagacatggaatcaacccaaatgcccatcaatgatagactgaataaagaaaatgtggtacagagataccatggaatactatgcagccataaaaggaacaagatcatgtcctttgcagggacatggatggagctggaagccattatcctcaccaaactaacacaggaacagaataccaaataccgcatgttctcacttctaaatgggaactgaacaatgagaacacatggatgcagggaggggaacaacacacactggggcctgtcaggggggcagggggagggagagcatcaggataaatagctaatgcatgtggggcttaatacctaggtgatggtttgataggtgcagcaaaccaccgtgacacgattacctatgtcacaaacctgcacatcctccacatgtatcctggaatttaaaataaaattaaaaatatatatggagagaatgatatttaagacaaaaagatgttctttctacctatttagattgtttaatcttcaattagcgtgtttggaaaagcacataagcatgatgatatgaggtgctgaagtaaacatgtagataaatataactaaactctaaaaatgccacctcctccacaaaaatcttcatcagcaccctagaaagaggtgtgattcttttcacttgcaatccattacatgttcaaacatgtaagcaatagtcacctaggctctgagcctcattcattgagtatgagggcaccattttaaaataaatttgggtggaacagagtcatagtccatacacttacagttcattcattgattaattcatgcattgaacaaatatctagtaagtgcataccctgagccaagtcctatcttagatgctaagaacactatagtgaacaaggtacagtccctgccctgatagagcttatatcttggttgaatgacaggggaagaaatgcaataaattgaagacaagtagatacagatggtggtgtgtgctatagagaagaaaaggagtggagtaaaagagacagacagctggttgggaggagagtgctctctggcataggatggatacaaaggcctccctggtctgctgatgttaggacagaagcatggagaacacaaggaagacagttctggattactggagggaatggatccaaacagaagtgatgcaaaagccctggtacaggtagaaattttagtatttttaagggccagctcaagttaactagcttctctgagttgcaatttcctctgttgtaaaaatggggataataatagtactatgaaggacagtttgtgaagatttaataaaatagtgtgtgcaaaatacctagcgcagtgagtgttctgtgaaaatcttaggtgcatttcttctgtaaatatctactcacgtcagtgtttctgtaaatatgaactcatgttggtgtgtgtgttagtatgtgtcattatggtctctcttctttgacagcaatgtgccttttgaacagtaagcccaaggtaattaccagattgtgttccagaaaacactaaggcagcccctgcctgtgttaaacatttcatgaaccactttatgaagcttgtttccacctccacttacctttcttgagtcctgccaccattggtctacccagagccccctgctgctgaggccttctcctagaaatggaaggtttttgggtgggagatgcccaggatagctcaggaccagctctcctccatgtgtgttactcactccacccatgggaaatgcatgcacccatagtgaggggtggggcagatttctttccatccctcctctaaaccctgatatctctccagttccctcttttccaagcttagacaggcaaaggagctaaggcagctgaaatgctctgcataaaataatgggagaaatttaggatcagagtgggtgtttgcccttgagaggaatagctgagagaaaagaggtgaaaaacaccttttcaagcatcacggttatgtggctgagaagctttcaagaacagaaaaggccactaagtatttttaaggagtttgccctgttgcactgtaaattctctccatcttttcaaacttttaataaagtctgtcaaaaaccaggtctttgtatgtggcttttttttttttttttttttggtagcaaccaaggaaaggggctaagttctattttgtggtaaacagagctgaaatcaatgcaaagccccatgaccaacagtgggcgagtaagaatttagcagaggaaggaagcaggaaccagccatcaccatccctccatctcctagagttcctcagaagtgtttcgagggcgttggatgtttcaaggcagtagtatacctatcttaatgagcaggatggccttagctgacatgtgcatgtatgtgagacttgctttgggcagcaccccagacaaagataggcactgaattctctggataacaacatgaaagtgaggttgaagctgcagatctgggagggactctaggcctgcctgaaagtgtgtacaatagacaggggttgtccacatttgtcagtttcctcgagtagacccatgcttgtatctatcatcagtatggactcaagctgcattattgaggtcccaagaacacatccagtagtgggcacagtgggagtggctttgttaacctcaatggtttactagttggttcttgagttgacacctttgattccttagaacagaaaggaaataagtcagaggaacttgtcttgggctgcttccagggctgtacataggtagaaataatatcaaagctaacatttattgagtacttagtctacataaaggattatgtgggaactttatatgtactcactcacctagttcccccaacaactctttgagataagtacttcctaatattcttccaaaacaagtgggcatactttgacccagctacaggttttgcaaaactggagcacgtggaatgaataggagtgctgaggggaaattttgtgagaagtaggagttggtgaagcaaccaattcagcaattctttaatagcagataggcagttagctttatccagatacccagtgtctttgtcaggtttataggatgatgttgtaatttcatttacatttgtctgaggtttcctttgagaccataaagtttcccaggccaagtcttcccaggtcccagatcttactctgcttttgcaacttcactctgcagaggaggggatgtggcccatggcaagcaagaggggatggcgatgatgatgaaagttaggaaaaaattggacttcaaggagaaattaaggagggtggtcgaatgtagatcaaattaaggtcaacaaaaaggagagtgtgggcaaggttaaagactttgtgctaaaagcaagagttgtatgtatgcttagtcataaaatgtagctctggagatccagttcagggtctggttctgtgcacataaatcccttttggaatttacactttcccccatgcaagtgcactcatccttggagcactaagcgacccattactgccctgggcagggccagtcaggagtgggtggaagtgatgcgtaattcacctcttggaaaccccatctttggggaaagtgaatttactgcacatttaaatgtttgtctctcagtgaccattaacttaagcctggctcaccagagtatctcgcttttaatgaagaattgctttcctgcaagaaaaattcttgaaattgttggaaaaagaaaaagtaaatcctgagggattgttagaactggtagatgtgacatattcactagcctgactggatttcctttaaatgctgagatgaaagtcattcagcatggagctctcatcagtgaggatttaagaggttttgtttttgttctgtactactgccaggaactgtaattaacaggtaaatgtaagagatggaaatgtatgttgttcatctgatttaaataatactcctcctttaaaaagcaacatccatcataaccaaagtggacctgaacagtagaagtccagatgtacagaggtcttccagaaagccacaaaaatagtgcaatggttagtttttcttttggcctgagcattgataaagggccttaggctagttttagttttccattaatctctcatctttctttttttttttcttgcagtaatcttacctaaaaaatgctttaactggtatattagaaatcttttatttttagacgtattcactttgaattctttcctttttccttacttggtaaatatttatcacactcccaggcaactcaacatttctcttatagaaagaagtgtcccataaaagaaatgtgaaaaacgagccttgcgaaaacacaggtgccctgagagacatatttctgcaaggacttgtactgaaagagcactagtgacatataatcatgaacacttgccagcctttgaatatgaagatgtcactatcatcattcttcaggcatgttttgaaagttttgttttgttttggctcagtttggttgatttggtgtgtggtttttgtttgtttgcttgcttgcgttttccatgaactttcatggatttgtattgacccatccacatttactttgtcctctttagaccaaaaatgggctttagtgtgggatcatcaatgaaaaatgtgtattaattataatttgtctgttcaatatgtgccactaagtcttttataaagaagaagttatattgccagaaaggcaatgaatgaatcttgaatttcttttgtccttgtcctgttctgacatctgcaactctcatggcagaattcggtaaaactgaattcagagtcctaaccagagcgtcagtagatcagatggagtcaaagagacaaggaaagaattgggaagcaatgctgtggtcagttgggaaatgggcaactccagtcacactcagaaaatggaagtgaaaattggggccaggatcatcttagaagcaccaacaaaagcatattggtaaaatacccaacaataaagatcacaaaaattagccacacatgggataatcatgacacaataaagttatgaatcacctctacattagggtatgtgagcaattctgtagctattgggaaacatccctctgttttcttgagtcttactccctgagactagtctcataacacttcaaaatgaaattgtctgagccaagaaggaacagagtcgaatagaatagacaggtgtattttggtgtcaatgattataccattaaagttttcataaatatctttttactattatcattattttctcctcagcagacagcaccagttccagaagttgtgtgatataattgaaattgatttttctttttaagcagtgtatttgacatttcttcagcgaggctccagctctcttccttatgctcacccccaaatctgtggtgaagaaaatatgacttcagtccatctcatccttaatatagctttggccttcctcatcacaaaacccttacagcctaaaaggtcatgggcagcatttacgaagcctgggatatgctacaggagaggcagtcatgcttatgttctcacagtcgtgataaaacatggggtggcccaactcaggactaatttggggtagttttctctggatttagcttttgaatgttttttgggacctgagaaggccccaaaaagaaagaaagaaggtagttttctttctttccttcattacctatagttttctgttaccacttgaaacaatacatccaatacaacctattacagattaagattaaaatatcttttctatggcactatctgaaacttatgctttagctgcttttcaaatgcctctagttcatgaaatgggaaagaaacattttccatgacacgacggtatcaccatctgttttcaaggaggacgactgcacgcctacacagcagattttctctgtgttgtattcatgcagcgaagagctgcacttctgagtggtttcttgtgtaagctcattcatgcttcttaccttggagacttcatcagactctcagccaagtcaaggtcaggaagcacctgtcctgatgcttcttttctgtatatgtttctctggggttctccacagcctcatggaacatattccttttaatctctatcggaatcatgtatgtttcattatttgcagatgaaaagaaaaccatcttcacaaacagagaaggacctttttatttaataaggctctgatcgcctgattgattctgaagtgcttgctctgggctctatctgaatgagtcttacatagagaataagaatctttcctatcattttctcccttattttctaccttccttttatttttcctttctctctttcattttctcctttccctgctttcttattctgtctgttttacagccagtccttcccgccccagattacccattcatcctcatgatgaaaccttttcatccttgtgactctcagatttgttccaagtcactgttaatgcatttatcacttctgacataaggtggtagacttttttagcttatactttcctcccctttgcaactcccttcactaatggcaaagagtgacaactagtgattacagaaatcttgaaaatgccactgggaactcagcaacaagaggtgcctcatcaagactaagacgtagatttaagattggatccccagcggctcccctccccatcccttttatccccactttactagcaaaacctaagtaacctctttttacttcctgacctggaggttctaaactgaaatcttcaaccagcccaagggtgcacgtggccctgctcagtgcttttacgccatcctcccacagtctgtctattttgaagtgagcgctatgttatttctgtaccaggcaaaaacctttttgtttaaatggagatataaaatttgtaggtgctacataatatgcttaaaaaaaagcttcaatatgtttttactttaccatcctgctccctctgcctcgtccttcctctgtccttttatgcattgtgttgccctgtgtctctttcttcatttttggacttgcttcagtgtgtggctgcattcagagtggagcttagggaatgactgatcacctcagaccttcagggtctgcctgtccagcagagctcagctttcactagatctcaagagtccaggggtgaccatagagcaggattatgctgggcaaaatagctaatggcttttattttgcatggtaaagaattacaaaggtaggtccatatcttaactagtttgtgactcattcagcaaatgtttcttttgtatctcgtatgtacctggctgttctagttctcaagatatacagagaataaaacagacaagtgtcccttcacacacaccttcacactttagaacatattttcataatctctaaggcatcagcagtttttataagcaactgtagcatcttttggaaataaaattcccaaattttaattactgtaagcatcttactcagttttatgaggctttttaaaaagaaatgggtgctgtaaaaactgagttgtaactttttatgtgagtggaacagcatttctctccgcatttgctttctcctatcaagagagagagaaggaaagaaagaaagagagagagagagaaagaaaatgaaacgtgtttggatttttgccacctggttatggttagttctttattttaaaatcactttcaaaacagatcagacattacattgttaaaaacaattttcactgtaggtattgaatatcatactgcgcttgtagtaataactgatagatatctagaataatcttcattgtggactgaaactagaaagaactgtcaatcactgagtttaactttaaacacagatgatttgaattcatgttagcagcgtgaggaagccgagaagatggaacagtgctgcttggagaaaagatgataggattacctctgcagtttgccgttcttgctagttgtttgagtcactaaatcaaggcaaagtttgtgaaaagcctgtggctggggtctccaactcttcattcctgctgagattttcctattataaatctgctgtcagaaataagtgctttacttgtgacttaattctatgcaggcacaaacaccttggttcaacactttgaccagacggccctgactgtcttgagagaaacagagatctcattaatatgggctgctacaaagaaaaggggttcccatgctctccggtcgtcattcactgctctggaaacagccctgtgaacgctgaaagaaaacatgaactccaaggcagcagtagggccgggatattgagggagggaaggatattagggaaaagggagtataggccttgtggattcaaaagcattgtcattctcaaaacaggcaattccgtgttttaatacttcccatgtcacctggttttaaaaattggttatttaaaaatctgctattatcataattagctagatccacactatctagtatgggagccactggccacatgaggctatttaaagacaattaaggtcaaataaaatttcaaacccaggtcctcagtttacgctagcctcacttcaagtgcccagttgccacgtgtgcttcatgcaactgtattggacaacatggagcatttccattgacacagaaagttctcttgggcagtgctggtgtagacagtgcttatagaatctcttggtctttggccactcatcacttttacaatgatcaggcatttaagggcataagcaataaaagctgaatgctaaaactcaatgacatttccatttttaatattctgactttatgttaaatgtcttcttgtttaaagatgtatggacaatgggccgggcatggtggctcacgccttaatcccaggactttgggagtctgaggcaggcggatcacgaggtcaggagattgagatcatcctggctaacacggtgaaaccccatctctactaaaaaaatacaaaataattagccaggcgtggtggcgggcgcctgtagtcccagctactcaggaggctgaggcaggagaatggcgtgaacccgggaggcggagcttgcagtgagccgagatcgcaccactgcactccagcctgggcaacagagcaagactctgtctcaaaaaaaaaaaaaaaaaaaaaaagatatatggacaatgactttttttgccttcttttaatatgtcttttgaatatcatatgtcagtgctatgcaacatgtgctccccggaatgggtccagtccacaaactattagttatcagtctatagtgaagcaaataaatcaagagtaagcctttacaaatttttatagggatttaacattgctgtgacttccaggcattcatgctggttttgataagtatgtgaggtgatggatatgtgaattagcttggtttggtcattccacaatatgtacttgtatgaaaataccatgttgcccacgataaaaatacacactttgtcatttttccattaaaaaataatttttaaaacaatttgcaacagattggaaattttgatttattttatgaatttttttttttaaagacaagatcccactctgtcacccatgctggagtacaaaaatgcagtcgtagctcgctgcagccttgacctcctgggtgcaagcaattctcccacctctccggagttagctgggactacacacttagctgatttttaatttttaatttattttatttattatttttagagacagggtctcgctgtgttgcccaggctggttttcaaactcctggcctcgagcaatcctcctgacccagcctcctaagtggtggcaatttaaaacaagaaataaacttgcccttcaccacagagaggtgagaagcaaagatgtatgaaaatgttcactttcggaaacacattaaccagctcacgtaaaaatttcaaacaggaccagcttacgtgcaaggaacgaaagctcaattcaggaaaaagctatattaaatgtataattacttgacatgactgtgaacatagcctacagtagttttctcattcactcttaatgcatgttaaggatgttaatgccaggtgctctttcctataaatctggctccacttttatgtaacattctttatcttagggatctttgaccagagtgggaggaacaggtgcctgttactgagagtaacatggtgtttgtttattacacttggctaagtttggaaggtttgtgctttagcttataaaagtagctactacttgcagagtactacagtatttgaattgaaaagtgttatgctttactgtatctccatacaaagaagaggtttccctgtgatgtgattgacagtctataacaggagtattcctagccatgttccagtttcttctctgggtacctggccacatttcaatgcactcagcccacagagaccagaggctatgtggcacgtgtatgtggagttgctacataaataatacgtagtattaagtgcttatttgctagcttctctgactaaactcagagctctgcagagaaggtggctgtacttagccacctttgctatctccctcgacttacacaacaggtgctcaataagacccttctttttttctcttttttttttttttttattatactttaagttctgggatacatgtgcagaatgtgcaagtttgttacataggtatacatgtgccatggctgtttgctgcacccattaaccggtcatctacattagttatttctcctaatgctatccctcctcttgccccccacccccgacaggccccagtgtgtgatgttcccctccctgtgtccatatgttctcattgttcagctcccacttatgagtgagaacatgcagtgtttggttttctgttcctgtgttagtttgctaagaatgatggtttccagcttcatccatgtccctgcagatgacatgaactcattcttttttatggctgcatagtattcaatggtgtatatgtgccacaattcctttatccagtctatcattgatgggcatttgggttggttccaagtctttgctattgtgagtggtgctgcaataaacacacgtgtgcatgtgtcttcatttaattggctattggaactacatgatgcagttaaaaacatagttaataatcaagtccatcattcagttcatttaacacgataccaaatcactgctttgacatcattattttgcttcatctggtagttgtgtagccctggacatgctgagtttaaacttcagcttggtcaatggcttgttgaataatcaggaaactctgattccaaattattgatatttcttagctctaaaaacataatcttggtttgcaataggggcaatataatgaataaatgattgtaaaatacttcactatgaaatgaggctaaaatattccttatgtgaaatattactaccagaaattccccagcactcattggaactttctgtaagacatctctctgtcagaggaagttgtgagttgctgcttagaaattcagtatcagtggcatttttgtaaacctggcatttggaaagtgaatttcagaacaatcttcttcctccaccccaccccaaccctccatttatttgtatcacaaaactgcccctaaagtcaatatccccctccctaaaatgaatacattgtccaagatctttatcccctcctcctcctcctgctgctgctgctgctgtttgctcatcaatgcaggatttcagagttgttcgtcctccagaagctcccactcccttggtcttgtctgagaagttcttgattgggctcccatccatcagaagaaggaggaatttctggccctatagacatgcaggtgctcttgcagcccatgatcttgcatgaactggagatgtcaggattggggaagtgactcctgcagcctgaagcctttgttgggaggagcagtcggagccaggaagcacatctgcagcaggaaagtgtttgctgattgtgggatttataagaaaggacacacccgggagtaggctctgaaaggggtgaagagctccatccccaggatcacagaacttgtccttctggctttgatctttaagccacatttaaactcacaggaaataccaccactcacgagagccttcactgggagaaagtataggctgggtgttatccagctcgtcacaattgcaggtgtatgtcttcagtgagtgagtggttctatatgtcataggtcagagtttcctaatcttggcattattggtattttgggctggttaagcctttgctgccagagctgtcctgtgcattgtaggatatttagcagcatctctggcctctacccatgagataccagtagcaaccacctacagatgtgacaaccagaacatctccagattgaacattgccaaatgtctggttgagaaccagaaccatagaaagactctcaaaggattctagatgtgccattatttctcagaaaaatctagtaactttcttctatgattaagaaaattatatgattaagaaaggtaaatgattaagaaaggtatgctttacagccagatgcaatagctcacaagtgtactcctagcgttttaagaggctgaggcaggaggatcatttgaagtcaagagttcaagaccagcctgggcaacacagtgagactctgtctctacaaatgttttttttaaaacattggcccggaaagctaaagaagaaggatggcttgagcccaggagatcaaggctgcagtgagctgtggtcatgccactatactctggcctgggtgacagagtgagacccaatctcttaaaaaaaaagaaaagaaaaggaaatgtatactttatgttgtaaccaaaaagtatgtttaagcacccacttgtttgagacactcagttgagttctaaacaaatcaatcaaaaattgtatctctaaacatgaattttctaagctaattgacaaatttttgccttgtagagaatctgaagataaatcatattcagaatacattgacaaaaagttgacattgattctgtcccaaaatatgccttaatgaacttgtctgttaattccatgtgcagaaattgagtatctactattttccaggcatttgaccaggaaggaagaaataaaacacgattatggcccttgaggagttttaagcatagcgaatgctatcatttggcatacaaatgacaaatgggtgggctggtctacatagaggagaagcagctaaatcaaactgaggggtcagggtaaatgttctggggaggtaaacttgaagctatgctttgaaggatgaataggagttaagtgaataaagaagcaaaatcaagggcactgcaggtagacggagcagtgggtaccaaggctcagaggaaggaagtggcacaatgtggagatctgtgagaggctatgaatgcttgagtgaaggcgtcatgtggggctggggtagggagtgaggggcagatcttgcaaagctttgggttctgagcctgaaggcacagtggagatgcaatggcagaattttagcaggggcacaacagggccttttagcaacttcttccagcaacattggaagggttcagaccagcaagctaggaggcagcagcagtaattcatgtgataattgacaaagacctaaatcaaggccatgtcagtaggttaaggaggagaacggggaaggaaatctttcagagattaagaaggtcaaatctataaactgattgaatgtggtgacttgacatagaggagacatttctgacagatcccaggattctagcttagatgacagtgactggttctcaatcccaaagttaggatccaggaagaagattagtttggggaagagaacaatgagacagtatggtggagtagttaaaaccttcaattgtaaaattaaattagacctgggtttacataccggttctattctttacaactacatgaactttcttggactcatttaactttgctaagccttgatttcctcacctgttaaatggtgctattaatagaacttactcatatattattataagaattcaatgagagaatcattgagaagaacaatgcttaacacctagtaagtccttaacacatgttagccaagttagcagcatccccgagcccaggaagtccaactgcaaagttgatattcctaaccattttaatacactacctccttggggcaattgcatgtagattaaatggttgaaatatagattcccctaagcggacttgtgcagtgtaaggataaaaaactaggcaaaggttagatcacaggagatcatatattgtaagctagggactttggcctttatgttttttgtgaaatgagaaaatgctggaatgtttttgttttgtttttttgagacggagttttgctctagtcacctaggctagagtgcagtggtgctatttcagctcactgcaacctccgcctcctgggtttaagctattcaactgcctcagcctcccgagtagctgggattacaggcggacaccaccactcctggctaatttttgtatttttagtagagatggagtttcatcttgttggataggctggtctcaaactcctaatcttaaatgatccacctgcctcagcctcccaaagtgctgggattacaggcttgagccaccacgcccggccaaatgctggaattttaagcagggagatggcatgtcccaatttttatttcagaatgctgacatcaacagacagggatgacctaccagtgtaggaaggcaatggccagaaagacccaccagccttctttttcttgttttcctcctagtgtatagaacacttagttgacaaacttgatttgtctacttccgagtaaaagagaaggaaaagagtgatagaaacttgaggtgtttcaagtatgtcagcatggaatatcctttcactcggttggcctcacagctgcagataatgtggatccagaaagtttgactcctccttaaaaggacaatagttgataccgtgcagagcaggtaaggaagctcctttgcagatgaatacaagcagccaagcctgtgggaccagagcaggcaccaatccagataataaaccctgttcagcatcgtctagacctgtttgagtgatttggtttaattagcctttccaagaaagaatcttcaagttttaatggtgcatagttatgcttgtaaacgtctccgccaagcatgggctctagaagtgaggatttgatgggtcacagtggcttggctggaagccacagggtagctttaataactttgtataatctaatgatgtcatgcaaacagaaaaatttggattagaaggggaataagtaaatgaggtagtagcatgctcgacaggtgaagatggctgagagtgtgtcaggtaatcctctgcctagacatatttctccttcaaatctcattggaattggggcttctcttggtctctatgacaatattactaccacagcatgggtagtggagagagcactggagagagagtcagcaggtctgatttctaatctgagctcttccatcagctggctgtgcaagtttaggggcccttcaacttcatggatggcaatggctcatccattcagtgaaaaaactaaccaaggtaattaagaaggaggatggagaaaagaagaagaaaataataatttccacttacctagttttttatttaatttgctgaacaacatgctatgtggtttgcacacttgatccttccatctcatgacaataacttccatagccatctctctggatttttttcagctatttgttttcatgattctgcatttatgtgaaggcactgggaacaatatagaatggcagaagttgaatacaaatcctccctgtatagtaggaggtaatattttgaaaccttgaaggttcaaacagtggccagggacagaggatgaggttggcacatatggtagaaaacacgaatctggttctgtttcctttctcctctgtccatccacctgaagactgcattatggccagggctaaagctgtagcctgttgggaatatagctaccagagcatacttattttaaatgtagttgtttccttgctctcactgcgccatcaaaactgaaggccttagcctagcttccatgcttccatctagcttcctgcctttccttcccttgctccctctccacatggtttgtcttcccttgaccttgaatgtgtgctgactctctcctgacttcacaccctccttcatgatgtgcccaggttggctgaacccacaagtaagcagtctgttttggggccagacattggtctgagagctgagagtagagagaaaattcagtactcaattttattcactatgtttattggcctttaaagagagaagcgtgatgggagaccagagcatctaacctaaaggatgtagctaggaatgccctttactctgcccatcctacccttacctgcccttaaagctaagctcatgcttgcagcaagcccagctccatctgactgcccattctgatgacccatagcttacaccctctttctagtctcaacaggtctaggagactgtctcacacaacttggaaccttatttcatattttgttgtttgaactatgtttagatgctttatgctcctcattcccaaatcctattgcaactaaataatagctgcttctgtgggtctttctagccctttgtttctgtgattattattaactgaaataccttccttctctttcctattgcataactttcttcctaccttgcacatttttgtggctgggtgggccactggacaccaagaagcagtaattattatcacaattaccctgccttaataactaacacgttatagccttttaccctgacaaagcagctctgtatccattatctcattgtttcacacaacaattctgttatgtaaggagcacagaaattagcatccctcatttacaggtaataaagtagatcttaaagaagctgaagaacttattgtttacatgccacataacaaaatgtagtgaataagaccatactttcctgtgctgtctctggggaaaaaaataggtagataatttacctactacaaaatgtgtgatgggaaactatcctcctgggtcatggcactactaattacccaggaatccttagaaccctcttttgacatcagttgaaacactattgacttataatgctgcttctcaacagagttgagtggatcaaatagcaaatgtgaatgactctatttaacttggtatttatcttggcatttcaggccttccattatttcctctctgatctacctgccattcactgtttacatctttgcactgctatatatttgtacatgcttctttctcttcctgaaatgaaactctgcattctcctctctacgtccttatttaggtcccaccattcttcaaaatccaactcgaattgaactccataaaaaatccacttccctttcttccctctgcccttgtcctatctccaccacttgttaacctcacccctatttaattttcagagcacatctccaggcattctctcttctgatgtagatatttacatacatttgtcgtttccctgcatgaatgccaaattctttggcttcaagcttttttcttgattcatttgtgtggccatcataaagtttagcctatgccttcaatataccgcgttttgaagaacatgtgttcaattataatgaatagaagaattattgttaaagggggcaatttaggttggattgaggacacccagcatgaaactgaaatgactgagaacaggcaaaaaattcatgactgcatgctctaaccactagactattttccattctgaataggacaatagtggtcattattttgttgccacagtttcattctcacactcacactgagcctttgaagtgaaatctctcctagcaccactgaggttgggaggattgctcactatttggagggattgtcagtagaaagttatgaactctctggtgaaatgctgctcagtttattctctagagattcagattcttttgaccaacctgatgtttcaacagcttgaaaaacgaaggaaagaaccatgtctgtctagactgaccagaaagcaaaaacaagggatactttgaaatctgaccacaactgagagttgtacttagtccaagtaactggaaaatcagtttcttggattagacaaatgcttcccttaagactctcaaactactagctttcttcttttataattaatagaaaattattacactgacagacaagagacttcatatttgagccaatgggaaaacttgacgttgaaaccaggggaaataatttagcctcaaatagagttgttaatgccaggataaaagcaaacaaatgtgctaatgatcttccttgagaatctgactgtgatgaattttgatgaattcccagatggaaaatatatcagttctccctgggctgggaattggacactagaatgagaaaatggtgaaatgggagtcagcaaaaagcactccgaagatcttatttccattttctagagaacaagaattctaaagagatagataattcccacttcaaagaaccagatctgtgtggttgtaagcatctatgacaaagttggtggtgggcatgaggcagggggatgtcctgatttccatcatagaatctgccattgctctgctggcctatagaattgatgagaggggagagtttgatacagcagctgccttgatattctcctgtgcagtcatgttatcacccaacaaacattcattgccatctcccatatgcccagccctttcctaggcatatggcaaagaagagagacagtctttgctattgtggaattctcattctagtgggtctagaattctcattcaattcccaccactaaaatatgaacagacaataaatacatgcataaataaatgtagaaggtcagatagtagtcagtactatgcaattaaaaaacaagtgaaggtgaagggaaaacaagtgccatgtgccagggcacaatggatggtggtatgttgctatattaactggggttggaagaggggaggcctcacagatgatgtgacatttgaataaggaccctaaagacatcatggagaaagatgaatatttggataaagagtattccaggtacagggaataccaatgcaaaagctgtgaggtgtgagttcttgacaacatcaataaatgtccaagaagttagcttgattgaagtagagtcagcaaaccaaagagtggtagcccatgcattatgagatagagctggacacatggcgtggtcttgtgctggggaacacaaaactctccaaggaagactccatgcagtagatgagaggatggctacacgtacacatggattgtgaagcagctgactggccatgttgaaactataatagacaactgaaactggaataggcaaggaaaaagaagctggagtcagtttgacaggatacagctagcagctttgttttcaactgtgctccaaatattgttgcaacttccacaacttttcctttccactggacgtgcttactttcacctccaaacccattaatatatcttcatccttcacagcctagttcaggcagtctggcaccagtgtggacacagttgaaacagaatggaatgtggagcttcaaaaactggagttcaaaaatctgcctttgtaatttagtagttgtctgagcaacgtatataacctctttgagcctcaattttgtcatcaataataacaaaatgttttaaatgtataaagtgtttaaagtattgccattatccaaggagagtaattctgttatttacagcagaggaaactgaggggcaagggttaagtaaataacccatgattatttctaaattgtagaaatgtgaaaatgctagcacttgcaggatttgaactcgagcaatatggcaactcatgtatttaaccccacataccttgcaggatggtgggcttgctgaaagggattatcaagaaaaaaataacaaagaagatactcagtcattgttagttcttggccactcacacatttttgattgcaagtgactgaggaatcaacccaaaattacttatgccaaaagaaagtttgttggcttttataaataaaaattggccctaggcactagggtcatgctagcttcagctactgctcaatttaggttccaagttgctatcatgatcccatctcttagccctgctttatctattccttctttttcatgttccatgtggtgagccatggcagcttcagttccacagcaatacaacacccaatccagtagaggagaggagttcactttcctgatgggtgaccatgtgttctggtttagctggaacagtcacccagtccaatagaaaagaggagtctacttctataataggagatacatccagaatttcccaagacagtcacctagtccaaaggaggtggactgatggacaggatgaccataggtctggttttcccaggcactctttattcacatctgtcattgcagcttgattattaattgtacctccattctctctcagaagtgtcccaatttatggtagatgtatatggtcattttactgatagtacaaagaaaaatagtctcattaatctttgcctcagatacaaagtcttcctctaaatcttaagtagtatttacttagaggagagagggagaatgtgtccaccaaagaataatagagggcctgttatcccaagaagtggggtggtggttctggatggccaaaaccacaaatgtagattacagttccccttttctcttcatactgttcggtactgtttagctgtagaaatggtttgggagttggaaaaacatgggtttgactcttgactctactgctgcgtgtagctcattcaccttagtggaagcatcttccctttctaaagcctcggttttctcatacatagagaaagctcatcatgtttgcctcagtgagttattatgaggagtgaatagactgatagacatgaaggattcaataaatcaatagctactgtttttccatagtgcctggaatacatcttaccacacaatatgtggtcagtaagtacctggtgaccggtgactaggacaggaaacaaacaagaaaggaccgtgaacctcatagtgggtgcagggaggcacggggtgagtgtagacaagagttgctgtcagtggtggtggggcttagtgatcaaggaaaggaaaacactttgatgctgagtgaggagattcatgatccaactgaaacattggggaaaccactgagaaaacgtcctttttagaactactggggaaattagaaattattaaaatttaaaacagtaaaaatatttactagacacccacattggggcatacagatatgaataattaatggagcctactcccaagaatttgggaggaaaaaactcataaatatacagaattatgttctacttacaatttatatatcatagctagagaatgataaatgccataatcttaaacataatagttctttgattggatgaacaaaaggttgtaggaaatacccaactgaagtgctatgagaggttaaaggaagaagaaatcccgccaacaggtagagcaggaacaatttggggaactggggggttcttagaatcaggtcatcagtgtagctggatttacatgtagggaagatcagaaagtattggaggccttggacactccaggtgcactcttacccttgtgcttttgtttcctttgcctaggttgctctcccacaggggtccataagacctgatccctcacttccttgagtgtattgccaaatgccacctctcagtaaggacctcccttgctctctgtgtaaaattgtgacacctactactgtgtttttgttgttagtgattgcagctctctaacctgccatatacttcaactgtttatcttgtttattctccatcttgctgctagaatgccagctccatgagggcaggaatttttacctgttttgttcactgctgcatctccaatacgtagaatatacccagcacatagtaggtgctcatattttgtaacaggaaaagaagaagggagtctgactgaggggaagcatgaaccaaggtacagatggaatgtggaactgtgtgcagcagatactgtgttagtgcaggcagactggagtatgcatgtgtgtatgtgcatgcttgtgcgggggtgaacacagtagaggacatttaaacaggaagcacatattggggccagaccttagaggacttgaagactaggccaaggaactcagcttttagtctgcatgtcatagaaactatcaaatgtttccaccaggaaattgatatgaacaagttgtttgaagaggattgatcagacagtgttgtttgtagcaagagtaggcgtggaaagaggttagaggtagggaacaatgaccaggtgctgcataaaaagccaaggtggccttaaccgaaaaaaaaaaaggaggtgggaaatggagagaataaagggagatgtgcaaaagaagggtatacaaagagatagaattaacaatatttgatcctgttaataaaaggaatgctagagaacatgtactaatattagtgggatgacctatatatgcagtgattgatgtgacaacagctctaacattaatagtcagagatgatgactcttaggtatggaaggtaccactctgtccttaggaacaatttccttacagcgaaaatagtgcttctaaatggtttctatttattttactcttttttaaactagttaacataacacaataacaattctagtatgtgaagaccttgagtgtctgccttcctttgggacagatctacagtcactcctaaaagttaaatatcatgacatctctatctctgtgactctgattttctttttcacaagcaaggttcccaccaaaggaaactgcagatttgcacattgggaagacttaatagagaaagcagaagaatagagaatggaattgtctaaaagcggaagtagatagcagaagggatttgagtctgaaaaacagaggagtccctccttattttccaagcagccaagaattgcatcttcaattgttctgaattttttgctctgtgtgtgtgtgtgtgtgtgtgtgtgtgtgtgtgtgtgtgtgtgtgtaggcatgtgcatgcatatgtggacagctacacatatagggctgccaaggatggccataaaggctgtgtcttacacgcctcaaggaggctctattcacataggccataatggcaatgctgctttctggagttgtgcaatgggatggccctgcttacgagaatgtagagaagagaactaacttgagaagtggctgtgctctttcaaagtatctcaccttcccacatcccataaaatctgcaatttgccattacaggttaatttatttggattatcattatgtagtctatcagtttgagttagttcatccaactattctcttcagtggctaaagaatccatgactttctgagaaatcttggataacaagggcctgaaagatctaagactgaagataaggaagatggtggaggggtgggttctgacaacaaacttggcctattttacacacaattgagtcaaaggctgctctgctctgagcaatactggagaattaagttagggtcagatggtagtgggtcttaaatgctgagctaatctaggaaatagggagccattaaaggtttttaggaagaaaaatgcatggaaacaccgatcagtcaagcctccttgtctccaaacatcaaactgctgaaggtatccacagactcccacctgagtatctctgagaaggtccttgttctcttcctcatctctgtccttccatgcaagctgactgatccacatcaactcaattcaatacatatttactatgcatatattacatatcagtgctcttacaagtttcagaaacagctgcttaaacagtactattctctgacttcccctctcattttgaatattttctttcatttcctcccatttgcaatgccttgggtgacattccttcaggaagtaaactttccaagtactgtcatgttagagccttaggagagatctgatgtggcctagagtgttaacaggagtgctctgtacgatgagaaatgtatgttttctttactctggccagatgtttctagaccagaaagtgaaggttttttcaatattagcatgtagtatatttaacaaagtgcttactgaaaatcccacaaaatatgtctttcctgcatatttttaaagcgtagaggcgctcaccttggtttgtgtaagcattcagtggtgcatgttatactttatcttggctgctgtgatacatattgggagggtggctctctctggactcccggcgaagttggcaagctgtatccaaagttggtccaaggatagggtggcttgagtgagttatgtgcgagagccctcactgtctgctatacaaatacatgtctaaattcacagtctgattcatcacacccgctggcaactgcgccgaccaaagtcaggttctcaactgctgcttggactatggctatggcctaccttcttactgtgccctggctttagtcttgccaccctcctgcagcctccacgttgctgccatatccttaaacaaaatcagaatttgactcttgtgttttttaaaacctccagtttctctgcagggtagattgacagcagtgattttcattgagggtcaagccatccccagagagatatatccgaatctgcacaaagggtgtgctggggaagagagaagtgtggctttaaaagccatatctagcatcagcagtgccttggatttcttttgaaattgttaataatatttatggactgaatgtgattaatatttatttaaagtgggctactgatctctaggaagaagtccacacttcttgttctgccattcaaggccctacgtgatgtagtaccattagtaatttccagaacagtctcctgttttcatattaccagtctctgtacttaacgttgataatattaagaagagtaggtctttgagggacatttactctggttgtagagatagatgcaaaaaactaattttacacggtatgagatgtgttattgtagagatatttacaaggtgggtggcagaataatggaggggattcacaaatctgtttcagaggaagagttaaagctgctggagttgcatcataaaggctgtaaagacaggcagattcaagacagatgctggaggtggaattgacaggactgagacccccctcttactagtccctgatggaaaaggggaattgagggcagtgctcaggtatccagctgggattccatatgaacagtggcaccattaagcaggtcagagctctgctgtggacatgtcaggtgtgaggtgcccctgagatgatcacgttgtaatgtccactacagagtctggaacctagaagggatatcttggctggagaaatcaacttataggtgatagtggaagatacaggtgtaagagctaaccagagtgagcatataatattagaaaagataaaatgagacaaaaggcattacgcaaaaagatgaaaccaaagccagaactgcaaagaatatcttccaatatattttttaaaactttaatagaacttgaaggggttaagcctttttctattaaaaatttaaaaatatgttataagaagaatcaccatctgaatatccatacatggaattatataaaagtggccagggcatttgttcttaagttgaaaagaacatatccaaaaaaacaaacaaacaaaacaaaacagaaaaactcaggtctttatatctctccaagtctattctccaataatagtatactagtaagcttgatttagaattgcctctgtgtccttgccagtttacatcttggaagcttgtttctattcatttcataagccacaacgtatttgatcatttctaacattcacaattttcacattaaaattgatgatgtgttatagtttaatagcagtaatcgtctttctcagtggtatataaaataattgtgcatcttgcagtcattggcccattcaattcaaagtcaaagtggtaattgctttgtgccttctgctatgggcagcaggaggatgccctttggagctgagaaggatggagtgaaatggtcctgtccactccctgccttcactctccacccgagccagccttagcggtcttcctgaggtggcagatggaggagccacagtcctctcatgaaatgtcaggagcagagcatcaagggctctggcaggagctcagatcctcttatcccaaagttttgcaagccctaagagggctgaggaaagcaagaacccagtggactcgtaaaacacaaacccctctcttcacagagggtcgccttgtgtcgttgagggttctggttgcatgcagcaggcatcatctctggtgggacttactggaaggaaatctggtgctgacaacgcctctagtgggatttattggaaggaaatctggtactcacagaatcaacaggaggcagaaggaacaggtttgaaaaagcgtggggaccgagggagctctggaacactgggcctctggaacaatcttgccaggatgttgggcgtcactgctgctactgcgttttcctccaaaatgaatcctaacttttttctcagctctgactccaaggatccaaagacaaagcctgagttaggagcgaccagtctgactccccagatcctgtctgtgccctggccaccaggagatgaacagcaggaaactctttccccctgggcttcgagagaggaaagtaggatccagcatatcaccaatccggattgctgcaaagggaatatgccccagacagaaaggggttttgcattatactgtattgccaaacactgacaaatgttccactgcactccccttcaaatacctcacatttgtaaggctatcaaaacaagtcagcgagcagaggactgctgcatactaaaactgtctacgtcggcttcattcagagccatggactagtggaggaaacgaactcttctggagctcaggcaaagggtcgagcctcgtgctgagtgtgttatctgtgattgctgcataatatgtagttactcattcttagacctctgaaaatcttaagggaggaagacagtggttaccaaagatttttccaaccaggaggaatgaatgtggcaactggagacagcagaatatgggtattaaataaaataatgtatctaaaagatgccattgtttagaaattagccccttggattgacaggtaattaacttctgccactagtttaatttcttgtgtggacctggataagggaagccatacatgggtggtaattttattccctccaatctcaaaggaaacgtaactgggtatgaagtagtggcacaactcatatatcagtagtctgtagcaggtctacataaatccttttctttaaagttatttaactgttttgaaaatggtttcaacagaagtaattccaactgcaccagaaaggaaaccagagttttaaagaaaaatatactctctttgctgagcaaggcaaacatatcagtatgcagagaaacaaaccagtctcttgtgttttatttcctttgcaaatccaccaaaacacttactttatgtctttaaaaggctgatagacaaagaattctgtgaccactaaaaattaatacctacaactggtttgtagacactttaaaagggcaggtactattttttaaatttctctgtttttcacagtttctcattatgggactttgtacatactataaacacaatacatatttgttgtgagtgtttttttagaccgatcaaaaacatattctctggggaagcattttccattcaaggaattagataacctgctatttcctcacatgcttctatgcataaacctagacattgtatcacaaacctagtcctttttatagccaagcccttcacagaataatatttttccaataagctcgtagtggcatttttggtcatggtgtttcttttttgactcttctgagaattaatgtttaaaataaacacccttatagctgtgaaagatgagaacttgttactatttaagctgactaattcaaagtcatttggtaaaactactttcagttttaagaactagaagatttaagtgctcaaactagatggctctaataaatgcacaattattatctatagtcagtataactaattatcagtgaatccagaccttgatccattactcccctcacgtccatggattgagaagcaagaatctatttgttattagtcttatttcctccaaggtcttcacacaactcactcccttaactccattaagtttttgctcacatgtcacctcattgtggccttggtggaccttttcactctgttttaaattgagactctcccactcttgaccagaatgcctaatctctctttcctattttgtattttcccccatagcatttgtctgacacagtatatattttgtttttttatttgtttttggtttctctccactggaatggaagctccatgagcacagagattattttgtctgtcttgttccctggtgtgtgcccagcacctggcacatagtaagtgctcagtcaatatttgttagactctaaggcaatgtttgttttgaagatttatgcttaagtatgttcccaatgaccttgatggtttaaaaagcaattttgtattggttattttacttagttattcttacaacaacgtgttttaaggaaggattattatcccactccagcagatgagaaatgggggctcagagagttcctatgaattggataaaacccaggggccagcaagtggtggactccagcctggaacaagatcaaatacttcctttagggtgctgctctcacctaagctgtgaatctttctggctgggggaattaacacttcatattaagcattgccggccaggtctcaaagcagtggattccagaatgaaaattagaacagaatgtggttgtagaatacctgataaataaaataatccattatgtacagctctcaagggtgagaagcataccttctcagctacaacttgtatttgttcacctcctgagtgtggaagaacaatccatgttgaggccatgcaagtccacctcaaaaagtccctgcaaagcctccttaccttgcaatagaacattgcagctgcttgtatttcagtcctttctccatggcatttctatttcacatcatgctgtggttcaggaggcagtttgcatagtggttaaagatcacagaccccaaaacaggcagagccagacagaacttgaagcgggatgtggttgcagttccttcgggggaaattattctgtcttctcatctgtaaaactgggctaatggtactaagttctgataaataaattagattatacaagtgatgcactcatcactgccttaagtgttagtgaatatctcctgtatcccttctactaaattgtaagattgtagaaggaaatgcacttactggctttattagttttcaagttttgctataacaaaataccacaaactggctgtttaaacaacagaaatgtaatgcctcacagttctggaggctaggatctgagatcaagaagtctgtgggcttggttccttctgaggactgtgaggaagaatctgttctcctaacttccggtggttttctggcactctttggtgttccttggcttgtaaaagcatcaggccgatctttgccttcatctccacatggtgttcttcctatgtttgtgtgtctgcatccaatttcccctttttataatggcaccagtcatgttggattaggtgccctactccattataacctcatttgaactaattatatctgcagtgaccctattttcaaataaggccacattctgaggtactggggtttattacttcaacatatgaattttggggacacagttcaacccatagttctggccttatcacctttgttttttgttgtatttgccctgtacttaataagtggcagggcatggctgctgaatctgttaaagaaatgtctccagaaggttcagaaataaagccacttaccaacagctgagaggccttttgaaaactgcctcttcatccaaggattactgaaagaggaaacttctctctagctagttcttcactagactttgtgtttagtccttgggtcaggaagatacgtcatgtcgagatggatattttgattaggactttccaaatggaattttgtgtgtgtgtgtgaagagatagcattaatatgttcacatacggataaggacatagatatgctatttataacttaacttttaaaagatttatttgtttaaaagtctaggtaacagtgttcttttcaaaattttaggtgcgacttttcatctcataactgtgacctcaggtttgtgtgaataataaatgtcagttctttaaaatgttttacatcctttcttatatatgtataatgtggttataaagtagtgagcttggctccacagtctacctgcatgcctatagagtatgatatttcaattaaaattcatgttttcaaaattctaatatctaaattgcaatgctatattttacatatctgtatttttaaaattgatattcctaccacaaatcacttgcttaatattagttagaattctgtaagttgcttacttagaattttgtaagttacttatttatttgagcatttaagtgtgcatttataatgtattctaagtgattggtgctgaaattttgagttgataaatctcaggatttattgtgatggaaacgggactatctacagagcttgagattttataggtctgtaaatatttgttgaatgagcgaacatatggggtggaggaagaagcaaagtcatttcttttcaactctctttgaaccaatgaaatcaataacctacatggagtacaataccatatttaaagactgaaagcaaattttaattttttatgtcgttttattttctataatttggattttcttgtgacaccttgacactcccttaaaccttctacactgtgcctgatgctttcaaacactatataatggaaggggcctctaggaaaggcaagttgagagtagaggaaaaatgagcatacatttgcatagggcaggaagggcactgtaacatctggcaggggtagccaactcagtcgacttgttagtctcattaaattcacattaatgcatgaactgctctgaatgtgtaaataccattttgagttgttttctcccagaccaatggcattgactttgggggcccttcccttggttgtttacttgccaatggcatttgacctggggtcagacctgtatttaaccctttcctgtaggtcaaaaacaaattaatttggtgagaattaaattggaaatgagtcatctgtacaacaggtgttccctgtgggaaatgtgctccaggtggaaacattttaaaatctgttcctgggccatcttcgaagaagcttcagaggtcagggaggcaattccaagacatcccacgtggtgagggcctggagctggatgtacaggtgcccattcagtatggttttctcaacagcttggggaaattttcaaagaggccccttttggagataatttattcataaattcatgaacatttatcttgggcattcattgtggactgatttacttagatgttgccctaaatgattggaactttaccctttacccctacctcccactatcaaccaaagactttgatttggaggaaagaaaatattgtatttttctctttcttttttctagaggatgaggaagatgaggaaatggtggaatctaaagttggccaggactcagaactggaaaatcaggacaaaaaacaggaagtgaaggaaggtatgatatggaaaataaactgagtaatcattttattgttttgttttgtttgcctttactaatataagagactatagagctaagtaaaaattgaatttgcatcccctatatggaagattttctatgattgttcaatacattacatttagcaacataaactgtaatctccaaagcaagagtcatttatttcttgactgataaaggcaaataaagtgcaaaacgtccacaatttcagtaacaattttagtcacaattccagaacacttgttaccaattgccatgttatctcattcacagaaccatatattcccaatgataacagtaaagcaaaggactagatataattattttgtgaataaattctaaagtgttttcatgtgatctacatagaaacattaatagtgatcaacgctagtaactctgctattaaaatttttcttctgcaactctgcctgtataaggaggaacaacctcttacatgttctggtgataataataactaacatttattaagggctcactatgcccttggctctcttctaagcactccacagatattactcactccttacaacatcattttgaagcagatactgttattacccctatttataggcagagaactaggaagagagaggtctaaaactttatccaaggatacataatgtacaagtacatgagccaagatttagagttaaatccaaagtttacattttaccctgttgccctcctcataatagcactgtgcctgtaagtagaaagaaagaaaaaagaaaagaaaaggagggacatgaaatactgcaggtgacatttccttacaaacccaattttgtattactttgagattctcagcccatggagacagaagagaattttgaacttgtcttacttgctggcaaataaatgaagagcgggacctaagaactgtgtagattaaaaaggttcttccatatttcctaatgagtgtcccaagtatagatcaatataactctgattagaagctcatttgatctgtaaattttaaagatggttgtggctctggcacagtgtggcagatgttcagcactggggtctttgtaggaattgatacctactgatcccaagtactcacttcaacaccttgtgctctcatgagaaaattagagaagcccaaatgcctattacaaatgacatccatatcatatggagttaaatgggacaatttttttttttttgagacagagtctcactctgtcccaggctgcagtgcagcgacgtgatctcagctcactgcaacctctgcctcccaggttcaagctattctcctgccttagcatcccgagtagctgagattacaggtgtgtgccaccatgcctggctaatttttgtatttgtagtagagacggggtttcaccatactggccaggctggtctcgaactcctgacctcgtgatccacccgccttagcctcccaaagtgctgggattataggcgtgaaccaccacgcccagccacaattttagaaaattattaaaaatcacttcatattgaggctcatttgaagtgtgtctgagtgtaggtgtttaatttagttttggtttgttttttgcaatctcaggtatctaaaggccagtgcaagatagtaatgaaaaagcatagcctctggagccacactacctgggataaaatcttgtctctgtcaattattagctgagtgatcactacagactaagttagtttaacctttttttgcctcagtttccccatctggcaaacaggtttttaaaaaactcaacagggctagtatggaacaatacttggcacaaagtaagtgctgtataaaagtttgctaaattatcattagtagtcttgccttgcagtgcctgggtctataactggtttctaccctgatgggatggatgcccttgggggccccagctctctgtgctcagctttgccatagcccatagctttgaaatgagaacatggttacaggggccccagctagctagtacatttaaaaaatgtggaactttcaatagagatgcaagcaaagtcctttaaacttgttggagaactatcattaaaggtcttatttctgttactgtgctaggtctcagacattgagaagttcaatcgttgtcaagttctagggtgtgactaaggtttaggagaagattcagcattttaacagtggcatccacagaagacacaaggcttactctttctgagagtctaaatgaatttgatcgaagagatctcacatttaaacttatactaaaaacgtcttttaaaaaaaaagttggtgagtagaatatcatgattacaggtgtagtgaggtacaaaataagtcaggatctattaaagtactcctttaccctttgcaaaatattcttaaaatacacctggtgataaggagccagggtatattttgtgtgtcttggcatggattccccatcaccaccaccccagccccaatctccaagtcgtcttctccagcaaagcaaagcaacctccttcttaagttccaagcgaaaacacccttcagttttaactgttactcgtgcttcatggaattgattaaagtcatgttaaaagtcaaaaagaagtttgaaagaacatttcctgttcctgctgcactgtatgccttattctccattaatggcttttctgcaaattaacacataatgggttaaaaggatgtttatgttggcatcaaactctggctttttttttttttaaagcaagacagtattttgcaaacttttgaaagaatctctagcagatataatcgtggcgccattcacacgactgcatagtagttagggctgtgtcagcacttccattacgaaccttgcgtttcaaggatttattactcagccataaagatttgctctgggctgaaacttgacatacacagtttcaaaccagggaacacatttttgagaaatctggcttttttttttttttttttttttttttggagtgaaaaggaagaaaaaggtggtgagggggacatggggaaaataatcagtactcactaacttttgacatttttgcccacgtgacatcaaagtgcattaaacactaaagaaatgcagtcttgatttattactgtttcacttttttctgccatagagtaggaaaaaaatcaggtatattttagcttataatcaaagtttagaaaacttctatatgtcagtgtcctcatgtcttcatgtttagaaattcaaaacaatacaactgggaacctaacatttttgtaaatacaaatcaactcataaacctcacattgacgtcaaagaaagatgtccttcacttttagtttggtttggtttcttgctgctgtttatgaactgatttcactgtaaaattcccatgagagccactgtccttatttaatctaatgtttttcctggctacatgggttttattttttatctcttagagatccttgaaaaatatttttgaataatttttatattgaaatttaaagcagcatcactgaaacaagtcaggacatatttgtagtagatatttttaaaatatcttttaacagaaatgagatactaaaaaactcagtataagttgtgaacttcattataaattgtacatttttatagagggaaaaaaatcacaagaaggcagaacccaaaagatatagtttaaagtagtataaattaattaaagagaaactgacaaagtatacattgaggatagcaggaaaggtcaagaaaacacggcaaatgaaatacaatcatgcttgaaagatttatttaaaagtattttcatataaaaaataagaaaaattaacatttctacaataaaaagtggaccctaagtgaaatttatattctattgtaattttgcaggccacaaatttgtagaattaggctgtcttctgaatttcatgtattctgtaaaatttctttcatacatgttattcaaattcaatataactggttaaattttggtaactttgaaaattgtcttatcatttggattacatgtaagttacatccatgcattctacttttcatagtgtagaatctacttcttcttaaagagctctttaaatgcacaaagtattgttagctgccagttcttggcagaaacactccatgttttgtgttgtgaaaacaaagaaaaaaaatctgctataatagtattttctgcttaacctataagaaaaactattatccatgcccacattttgttttggtatgccctttgctattaaatcctatctttttaatgccatgaacttgttaaaaataatttattagattccagggatagggaaaagctgtagaaacagatacttgaggtagaatatggcatctatcttggagtaaaacaattctgattctatttgtttattcctgtattttgaactttgtggaatccattaatcaaccaattttctttcatgaaatatgatgcctggagaggtttttatctctgaatacaccttttggttgtggttcctggatactccattatgttttcatgatattgaacaacacttatcaatttaaagatctttgagtatgggtggttttgtttatttaatcaaaaattactatggccctatttaattaagttgaatattgtttatgacttttaaaaagtactcatctgcacatgcatctgattattttgtgctaacaaatcatgtcatttgatccctgtttgacatcaaagcttaatataaaatgtatcttttgtttgcttctgtagcattttaatttcaagccaaatattgtattgtcaatcataatatctggagaggctagtgctccacctacctgaacttggcctctgcaagcacactttgatcagccatttatgtttctgttagagaagaagttgtgtgtcttgaaagctgagatcaaagtgacaataagctacagggaagaaaaaaattacagaaaattacatagataccattttttattcaaggtaatggacctgtaaggaaagatacaggtgaaatagaagtggctcaaaaagataaacagagactagaaagattttttaatatcttaaaaaataaaggagaaaaattcctactactttgtttaatttcaagtgtgtctcaagtcatctattaacagtgaccaaggccaagtgagtctttttgaataagacattcttcttggcctatagtattcttgtttagtcaggtttattcatttatgtaacagcattaaccaaaacaaaatggacttagtagggtttgttccccttttgcctagttccattttgtagttttattatattctggagtgaaataattcaaatgtctcatttacaggagttttagaaagcagactagtaaattgctacttcattagtaattattgaagcccagcatatttagctttaattcttaaaccagacttaaagtttaggtatcatccccatttcatagataaaactactgctcaaagagcttcagtgcattgattaactaatcaaatctagcatatggcagggtgcttgattgcaggttggtgtcgtagagttctttgtgttatttatgacctccacctatttccccactacctagcctaagtctgagtgtgcatattgtctgattcagcatttcacaaactagtgtctcagcagcactgctcagtagaagttaatggggtccttggaaagtctcagtacacactggaatatttagggctctggagacctagacagcaaagaaatatttctaattttatttagggctgctagaaactatgaggtggggtgtgttaggagaaattcttctgctataatggatgaatcacgtgttgccctaatattacctggagagcatttcttaaggtgtgaaccaactacatcaggatcattctagtttcttgtacaaatagagattctcgtgtttctccagaccccctgcctcatggtctggggcagggaaggggaggctagaaagagggagatgttacgaacattggatccactgccatgacttgactctgtagaagggcttcttgacactacagatttcttaggcttcaagatacaattagtccaattatgtaacactttcataaaatattgtgctacaggtgatagtacctaaaagattcttctgaccatgtggccaggtggaaatcgattttgttgttaggatggttgtggaagtgcttggaaaaccctgtaggtgagtgattccaccagaggctccacctgtgattgtaatgcactaccctcctcctgtaagtttaacttcaggagcttctgtactacttactgaaagagtaaccaatgaaaggtttattgtaggctctctccaccagagttgaactagggttcctgaagaaccacaaaggttcagctgacagtttctgcccttgatggttttttggtctggggagttcctaatcccttccctaaggttttatgtaaaactctcaattgaaggaatggtttatgtaaccaaatggtgactctaaggtgagctcactttcagaaactatgacatgctactagttatttgatctctttgtctcattttttatcttcaaatttagtttgataagattaatcataccagaaaagtaaggcagaaaaacaattgtgggttgttttatagaagcatgtatttgttccatgtgtttgtttaaaagcagaagatcttgagtgaaagcaggtttggaatgatatatctctgcttttgaatataatttatataacaatcagtcagccttaccaactaaccatttaaaataaaatgaatttatgaatttactcagtagaaaaaggaaaggtactatgaggatcatattatagagtgttcctaattatttaatattgccagcttgacaatagtacaatagcataatagcatatataaatacatagttttgtgaatttatctattatgccatatttaagctgtttttcaagttaaaaaaaacatttagaactgattgctaaaaacacaccaatctatttttatttgtaatcttcttcaactcttcaaaataataattagaccaaatatgcaatctttttgtggggacatctgcagaagcctttggtgtgaatttgtaaataatttagaatcaatattagcaatgatttgtttcactgtgtcttgccactcgtttgataagcagtctctctcaagaattgggttcctcttgataagttttaattgtcactttttcttccctaacaatctcttttacaaaaaaataaataaataaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatgggttagtctcttgtgtgcattctttaaaaaatagcgtaagttatctgttaattctaatttatttatgttctgactaggaaaattccaaattaagaaatcagaggagggtgaaattttggaattgatcttgctgaacagctttgactatgggctttggtgataacttctggcttagagcgtccttgtaattatcatgtgcttctgtgaaatgcttttgaacttggtatctggggaacagtccaggtgatagagactggcagagtcacatgcattatcctctgagaaaacattcttttgagcagcaaaggagattcatgttgtatctactagatttattcctgatgtccaagcaaataggaaattgaagaaaataaacatgaggtgtgggagaagttaactgatgtgtgtaatgatgaacagagactggaaaatgtttcctttttttggtatcatgaaagtatgcatatgtgtatatgccttttaggaaacatattaatatatgtaagaatatatttccaggcaaaacaaaactaatcaataaaagcaagtgtccctaaatgacttcctctgtgactgtagcataggtattagaaaaggccatgactgtcaaccatcatcctggggagaataggagggactatatgagccttataaacataaatatagctgttcttagccacagatctcttttggccaagaatgatatgtgaaggtagggtcacttgcctttttcatcaggcctgattttttttgccatttctaaaatccaaatacattcttaaaggacgatatcttatcatcattgaggatgctcaagggaatgtaacagaggcatgaaaaccaatttcaaaagggagtcctgtacatgttctcaacagtaggcagcatctttagactaccttgaagaaacaacagtattttgaatatagatgctctacaatctttgtgtttttttgaaaagccatttttctatgactttcttgattttgttggtcctatttccctctgtgtgcctggctcagtattatcctaggctcctggcaggacgtgtgtgtgtgtgtgtgtgtgtgtgtgtgtgtgtgtgtgtatctcctgagtttgcaatggcggagctgaggaagggttaacagaaaaaaaaatgtcatattaggtttactaattagagcccaaataacttgttggaagccaggtcacccagtctgaacaagagccatataagttaagtgatgcagggcgcaagccagcagttgaagcaaatgaacagaggaaaggtgggtgtagaagaatttctgaaccaaagcccaagcaacttaggcagctttttatgcagatcccgtagttcctggtccagaacaaacattactcgatgtaaatactcagcttgtggagcagctgcataaccagcactgagttccttgaaggaggtgttatggccagttgagtgtcagccaagtaaacactggctaaagtgtaatcctcctagattcagatgctgttttggtccatggcagaagtgataagtatctggaacatatctggtgaatcctccactgtctaccacgcctgtctcatggtagaaattatcacttactattgagtgaggaggctactgctacagcctgtcagcatttacaagtaaataaaaacatgcatatcatttccggtctaaggacaaataaggtagtatcgatatcaaagaatcctctggtgtgctgtgctcccttgatagcagagatttctaataagccctgcttcaggccagagcctttcagggagaggctctggcctgaaccagggttggagaaagcttgggactggtcaagatgggaacttgaaacaaatctgacatttcataacagtcttggaacgacatggaaacccttgccaggtcaggttagaaagagcttttcataaagaagaccatctttagttcattaattttgatcagggtatgtagtctagattaacattttggcctcagagagtattgtgtgccaggcttttgccatatcagtgcttctatatgagcagcatagagaaagagctccatatttatctctgatgtttaaatcctcctagggatgttcaggctggagccaatctttctttcaatcgtcagttctatgatgaacattggtccaagcatcgagtggtcacttgtatggactggtccctccaggtaagaattattgctgggctgggacaaactgggcttgtgttctcgtggcatttgtataaaaaaataagagatttgtttacttgcctacgatttcctctctatgcctgttggtttttttcccctcattttattgaggtttcagtttcaattctctactcagttatttgtatttattgagtacctactatgtgctaggtaccaaacaagaagccagattgttctgtccatgaaactattccattaagattaccactgatttcctacttgtcaaatcctgtggatatttttaatcccacatctgtcctgacctttctttgtcaagcagcttagtcagcttccttgtgcctatagaaacatcctctttccattgaattctcactactcctctctactgtctcctagttctctgacttctccaggatttctttttcctctgaccatccttgaggtccctgtggtcatgctctcaacccctgctcttcttcctgaggtgctctctgcaggagatctcttccactgctaaggattcaaccacgaacagcctatttatatctcccgcccaatctccctgctgaatttcactttgtacaccagacagagccactattctaggtgtcccatagaatcttaaatgaattagtaactcattattttcatatatcccaaatccttttttacctgttatatgatctgtatgttaaaggcaccacaatatacccaaaagcctaaagcagaactttcatcaacattgccaacttcctcttctcttccagacccagtctgtcacgaagactttccatgtcttcactcatgtattcatcatctaatactattcttaaccttcaaactgatatttctaccttcatgcttgtccacatacagttttcccctggagaaatctacccaaacaatctttctaaaataaaaatctgatcactcggctgcgtgaggtggctcaagcctgtaatcccagcactttgggaggccaaggcgggtggatcgcttgaggtctggagtttgagaccagcctggataacatggtgaaaccccttctctactaaaaatgcaaaaagtagccgagtgtggtggcaaatgcctgtaatcccagctattcgggaggctgaggcaggagaattgcttgaacccaagaggcagaggttgccactgcactccagtctgggtgatgcagtgagactccatctcaaaaaacaaaaaacaaaaacctgatctcttcattccctagaccaaaactccccattgcccgtagaaaagaagtctaagcccatcagtgtggcattcagagtgaaagcaggcaaatttaccaaaagccaatttgctgaatggccaactcaactagttgacaatataccgggcactgagtaggtaagtaacatgcaaaggcacacagcctagtgtggtgacatcagaatttgaacctaagcatctgatgcctgagcccacattcttaacaacaatgttccttcctgcaataacactgacataagaacagtgagagaagcaggaatgattactcctaagcatttatgcacagcacagtttctgctttcttgttgtcaatgcttttattgggaataatagtcatagctagcttttaatttatttttcttatatacaaagcaccatgatagctgctatgaaggctttcttatttccccctcacaacaatcatatgaggcagccacccttactatttccatgacatatttgaagaagttgaggctcagagaagctaagtaacttgctgaaaaatcactcaactagggtatggtatagtggggatttataccaaagtattttagcatcccgtggcatatgctcttaaccactgcctctcacaaagagcttctggatctgaaactaaaagagcttgtaaaggtgcagaatgatatggggcagatagcaagtgctctcaaagttcagtggaggttggaatctgtctctggtcagacagagcttctcagaagactgggatttagacaaatggaggggagaagagggtgttctaggcagagctataaaatggtaagtcccaattaatcctattggagaacaggggaacaaaagaggggtgtaattccccacaactagaccctcatcagcaataaagtgggtgaatgttctctcctcttgaattcctttttgtatccaaacaacaaagcacacagtgagtgatcttgcagagacgaagacaagcagggtttgcccaaccactttccaccagtgtgtgggtggtctctgagcatgcttgagtgtgtgcacagaaatcagatccaagcctgaggaaacacttagctcagcttgttcacttgttcagagttggggaattacacaggaaccttatctgacacattcctcaaaggcaactacaaccttgttcccgggtcagctgataacactccctgaggaggcacggggtggggctggtcccgccttgcctcagtaggtgatgggccacattgcctgtggaggtgtttccacacagggtctcgcatgatgtttgtgttggaggaagtgaagttggaaataacagaaactctaccatggagagaccacatttattttcccctatttttgtgtgacctgcttacctacgctgtggggaagaggtttgcaattttgaaaaatgtgttgtatatgaggcgtaagaaaaagagattagaaccctcacctcctgcatcacaacactgttgaggggttcaaaggaccaggattacatacttatgggataaagagactttttgatggatttagatgcaatcgaatgatattaagaaagaagagagatagaggaacagtcttggtgtgcagtggtggcgtgtgtgtctaggatgatttcctgaatgtaacagaatagaactgagaggagaaaaagaaagaaattataaggtttcagcatagctttcctttgatctcctgggcttcttaaaccagaacactttaactttgaaatatttacaaaatatcatcaaacatcattccttggaagaaatctgggaagctggaggattatgtcaactttgtcacccattgaacattatttaacacagtcagtcaataatactatcacataccacgtgacagttttcagatgtgtgcagaatcagactcatgatcttactcccaccatgtatactcactcctctcacatgtacattgcatcttccactcctgcagtcatccaggatgcaaacctgagtaatctttggcaactcagttagttgctaaatccaatcaaatttacaacagcaaaaagattactattgacaccagtgccaatccacgaacatggatttgacacctactttatgtcatgccctctacttcttgcttatgttaggaaacagcgtcttactggtctccctactgtcagtctctataaggttaagtcagtataagtacttttacctggttaatctttgtaaagattacttatacactctgtatcaacttgggcaaattgcctaacttctcttggcttaagtttcttcattcatgaaatgataataatacctagctcacacacttattgtgagtgttaaatgaattaatgcatataaaggaatgataatttggctggacacagtggctcacacctgtaatcccaacactttgggaggccacagcaggaggatcacttgagcccaggagttcaagaccagcctgggcaacatggcaaaaccccatctctacaaaaaatacaaaaattggccaggcatggtggtgcatgcctgcagccccagctatgtgggaggctgaggtgggaggattgcttgagcctggaggcagaggttgcagtgagctaaggtctcatcactgcattcaaggctgggagacagatcaagaccctgtctttaaaataaaataaaataaaataaaataaaataaaaataaaggactaataattttaaaagtgtctggtgcataagaagtacttgataaatgtgacatagtagtgagaagagcagtagcagtattatcattagttgcaaagtgtgacttctattgtcccccagaataaaatctaaaatcattagcctgtgttcagtgacttccgtgatgatgccctgaggcatttccaggcctttcttcttttatacatcttgatatagcctgcctcctagccacatattaatactacaacctgatgtctattggacatattcttcttcactgtattggtcaaaaagacttcacctttggctaggttaagtagacagaggaatttactggggagccattatagtagttagggaattcatgaaaaagatgaagaactaaaacttagaaatattaggaatctgggcagcccgagggacctcaccaacaggctgctgtccttatccagacccctttgccagctcccaggtcctgtgtctcagttcaaagtttacaatattctggttagagaacgcctttggctcagctgggtcaagtatcaaccctgcaattaattaattatccctgggaagttaggcttctgttgactggggtaatctccaaagagagagattcacatgaaccaggcagataccaagaggggtctcctgcacccctctttggactcttgtccctgctgtcatctgtcctaataacctacccacttgacaaggctcaaggtctcatttcttctgagaaatccctttcaatttctcttcctgccacaccccacaccagcttccatgcttatttatttatttattttgagatggagtctcactctgtcaccctagctggagtgcagtggcatgatctccccttactgcaacctctgccttctgggttcaagcgttctcgtgcctccccatcccgagtagctgggattacaggagcaagccaccagggctggttaatttttgtatttttagtagagacggggtttcaccgtgttagccaggctggtcttgaactcctgacctcaggtgatccaccctcctcggcctcccaaagtgctgggattacaggcatgagctagcatacctggccccatgcttctacagaaccttgcttctgcctctgtcttagcacttgtcatggtctgcttttttatttgtcttgtagttacttctacgtgtgtcttacctccctccatctaatgataagttcctatagagaagagcctattattcagggcattcatgtcacatattttacctgtcatggtgccttacatatttataggggacacttgaggcatgccacagcagacaggaaaggagaaggcttttgaagcccaacagactttaagtggggttcttgctttatcacttattagcaacatagcatggaatatgttatttaacccaggactctgggtttctttgtctgtggaaatgagtaaaccattgcctaccttagagggttatgaggaccaaatgaattaacatatcagtgtctggttcataacgggcacttaaaacatgatggttccttcctctccagtaaatgctaggttcttttttttttgacggagtcttactgtgtcacccagactggagtgcagtggtgcactcttagctcactgcaaccttcacctcctgggttcaagcaattctcctgcctcagcctcccgagtagctgggattacaggcacacacaacctggctaatttttgtatttttagtagagaaggggtttcaccatgttggcaaggctggtctcaaactcctgacctcaagtgatctgctggcctcaacctctgtgttggaggcctcaacctctgccggcctcagccactgcgccccaactaggtttcatttatttgttagaaaaaaaatggggttgagagcatatctggtaatttccaggtaaaattctcctagggtaagtattggataattcagctctatgagtaaccaaatgatcatgaatttcataattctttatattctctttaaaaacataacttcgaacaacacttaagattaaataattgtttagagattttttattggaaaaagaaaatatgactagtcatgttcaaacaaacagtggaaaaagacatactagagggcaccttgaaatcccaaaaacttgcgtgagataaaatttaaatcagtatctttaggccttatgatctcagttatagaaattatgccaatgacatttcactggtaattttactaaagcactccctgttttctaaaggagttttaaagctaaataattttaaatatttttaaatggaaaaagaaaagctgcaagtgggtaccaacaatgagacccagctgggtgatattattgcagaaacatctagctgctccttagcccctgtggtggtggtgttgatgtttatagagttgccttttcacatgtgacatagttaaacttcagatggacagtctggagacttctgtgtttatctggatgttagtttctttgaatgggctttgaatcaaaggctttcttaataggcctttgattcatccgctgcagagtgttttttaataaagaatgattacttcccctggtggccacatacatgtgtgtcactgtacgcttatacttcctctgcacaaccagcacattgtaactctctgcagatttctttagttgaggctgctggaagaatgaataagacttagatgtagttatttttaatagaaaaaaaagatctgtgttcaaattcataaaggcaatcttccattaaatatatgtatagaataatgaaaaaggaggaaaaaattaaattataagaagagagtgatacggtctgccataatcctgatactatttttaataggactgccttttgagactcctatgtaggaatgacattttcatgaaatgtgtcctaactcataagtacttcctatgagatttatcctcagtttatttagtaacactcaggacagagtttttgtagggtgagtaggtctttctaatacctagaatcactatagagtccttcttgttattttactggttatgtttctggcatttaagcctttaattattagcattgtttgacaacaaaggatgatatataaagcctttctattgagcacagaattactaaaattaaaaattttaaataattaaagaaattttggcacaagtttattatatgctaggaattgaccctggattcagaggtcaacaaaaaccagtccctactctcaaagagcttgcaatcgagtgaaagacacaggtgtagaaaaaaaattataatgcatttgacaagggctttaattggcaggacagacacatgatacaaagggagctgataacaggcaaggaaggaagtggttggttaagtcaggattgtctggaggacttgatgcctgtgttgagtcttaaaggatgagttaattatgtaaacaacaccaaagggtcatcccagtgagagtgagtatgagactcataggtacagagatgtacctgtgtgcctcaaaactagtccagtgaggctgggtcataggctgtgggaggtggggagaaagagggaaggttgtaggagagtaagcaggaaaggcaaaaaatgacagattattaaggatcctctgtgacctgcattttgccttgaaagtaatgatgagccattaaagtattttaagctgaggaatgacttagccaaatacatattttgtaaagtcttcctgataaaggatggagaatggagtaggtcagtataggaagccatttatgaagctgctgccttcatccagataagaaattaatttagcaggctctgaccttaaagatagaaagaaaatattcatttgaaaggtattgaggaaatagggaaatttagtgtgtgggagtgagagagagaaagaagtaaaaataaatgggccaggcatggtggctcacgcctgtaatcccagcactttgagaggccgaggctggtggatcacgaggtcaggagatcgagaccatcctggctaacacggtgaaaccccgtctctactaaaaatacaaaaaattagccaggcgtggtggccggcgcctgtagtcccagctactcaggaggctgaggcaggagaatggcgtgaacccctgaggtggagcttgtagtgagccaagatcaggccactgcactccagcctgggcaacagagcgagactccatctcaaaaaataaataaataaataaataaataaataaataaataatgtagaatggctggcctgggccaggcgaatgttagtgcaagaccctaaaatagggaacatggaggagcagtaggtttcgtgtggaagtcaatgagatcatttttctatgtgttacaattgatgggtctatggacagccctgagaaatccccagtaggcagtcagatataaagacctgcatctcagagagaaattaagcctagagatatagatttgaaaattaccagcatgttaagcttattaaagccactggagtagatgaacttactcagcgagaatagccctccttggaatttatgtaatagaaggagaacctgcaggaactgaaaagagaagtcagggaagaaaatcaggagagaaagatgtaatggaagccaatacaggagaggaagggagtagcacaaagtgtcaaataatacggagaggtaaagcgatgtttgtagtttgatagttaccggtgagtatgacaagcgcatacagagtgttggaggcagaaacaagattgcaggaggttgcagcagtaagctgatagtaggtatgccacaacataacagaaagcaccatttacactgtgtagtataccacgtgtatgtaggaataacaaagttttccttgtgttgtcatcttagcataattcatccttgtgacctcttccatttagtaccctgagctgatggtggcttcttacaacaacaatgaagatgctccccatgaaccagatggagtggccttggtttggaacatgaagtttaagaaaaccacaccagaatacgtcttccactgtcaggtaggagtcagcgtagtaaaaataacttacatctcctgctagaccaaatatagtttgtgctgcattgcatctgtcttatgctgagaggaagaactcagtttaaaaatgaaattgttgacaattttggaaaattcccccacagtaacctaatgttttgggaaagtggcaaccctccccaaacagttaggaagcttggttagggactgtgtgtcattttctttctatttaaaacagcccccatgaggatgagtttataaagacctcgcacttatgaagaaatcgtggtgtaccacttcctctgcttaaaagcaacatatgcttgcccacccacgtggacatcctcagagcactaccatttcaagtctcctactctcttggaaatgcagttcaatggattttgctgactttaagtttatgggcgccatactacttaacagataatacttttgtagctggcatggggcaagacttaccactcgtatttcttgagttgctgggaaatatagatgctgtttctggtttgaaaatgcagagataatttcaaatatgtttgtatttttcattccttctctctgcggacacgtcttctcttccccttgacacaatacaggctgaaattatggtacccttgtacacgttcagcattgctctgttgccatgactctgcctaaataataggcctcagcataggccaatacaccaacccctttattaatgctcctatcctgtgattatgcacaggcaaataaaaaacaaacatttcagctcaaaattgcagttcctcaaatgttaacaattcagaggtactgagtggcagattactctgaatacaaagacatcatttgaagagggtgggtaaacctgttgatttttggaagcttagtgccattttctatctaagagccaagtatctttttgaactaaaatatgtttagactttagagcattatcagatataatttggggaataggagctgctggaatagagtcccagcctcaacctgattgagtaacctctaactctggccatgtttttctaatttgctgtctcaaaaacaacttaacaagaagtctagttctgtatggtaaataacctttattttcttagcctttgaaataagaacggttctttctttttttcttttattttttttaagattttcaagtcagcttgatatgctccttctgtaaacatagaagcacaaaatcctaattttgttcagttttacaaggtttgccgaattcccaggaaaatactgtaaggattaagaaataaagagaagcacatttttgaaaaacagtgccttttaaattattttgatattacagaaagtctttgattttaaaaatccaacaataatacattattataatcaatatgtatgatctttatcatgatttttaaattttaattatattaactgactacaggtttctggaatcaactgtaaattacttgttttaccacacaacaatagttaatactagtattaattgaaaagggcattcttgtgtgtgtgtgtgtgtgtgtgtgtgtgtgtgtgtgtgtgtatctttgggatcattgactaaacatttctccaacaaacattttttttagtttctcccttaatgatccaatatatgtcattgagaagaaaatatactcgtgattttaaaaaaaaagcaagaggtaccctaaatatagtaacaagatagtcataccagagttaccaaaagatgctgagtaaaatagttgattccaaaaacttgtagtcagcactttgatacaggtgatactcatgaagttgggataaaggtcaggtaaatatcactggctgccaaagaaaaacaaaattgctatgatatttagtatttctgaactgttgggagacaaaatcaggaaactttcagcagccagggaagtcctagatgaaatagtgatggaggttaggtagacagataacataataaaggcaatttggttacctttgtactaaagtgtaatacctgtagcaatatctacgtgtttctgtattttaaattttcccaacacttctgccttcatgatctcattgattgtacaacagggaggtaagaaaaatgttattattctctttttccagttgagagattttatactttagaggttacccagctagtgagcagtagagccaatcctggaactgaggcttattctatcgcatacatcgtgccatcacctaggctgcattctaaaaatgtgggcagacatgggacttgatagcaaaggctgtacagcccattcaaggtatatttttggccacctacccttataaggtatcgattagacatggttctagacgtggctatctttaccaccttctaaccctaaatggaaatttagagatcccacagaattaaaatgtatatgtggaaaaaccaaagccttcactcactgacctataacttttcttctatcctatctgatctttgctaaatcttatttattacaactggtcatttctagacactaactcagggaaatcacgtcgtttgaatgtgcttccgcattctcctgtgatgttctgataatttcaaaattagacaattcattacttagaaaaagggcagaggtagagagtagcaagagtaccttatgatgactgtacttttataattttggagtaattgcgtagctattcatttcctgctgatctctgctgattcttcatattttttaaaagtgtataattgtaaacaaaaccaatggatcagagaagcattgtgtcagtcagtggaaagcaaatgcacaagaaacagacatcagctccatggtgttttgtaaagactgacaagctttttgcctactcataaaaagattttagtatatagtttcatttctctctgttatggatagcaaggccaaaaagtatcttctactgtcacaggcagtttttgtgtctttactaaactgaatttttagtgtgatctctggtcctgcattttctatttttatttcaataaaagctgtctgtacttggaaaatattggtggaccctgcatagaaatcagccactcagccccataacacactctggcagtgctcctgctgtcttctgtagtggcttccacacactgtcattagattatgtgtctgaccaccctgcattgcttaccctggtgtggtctttctcttttaaatggaatgaatagaatcagaaatatataccttagaattatctgcgttgaggtaaatgtaaaagctatgtttagagtcttagcttggtcagaggtttttatttttacttttactttttggtgatttggtttctttgttcttggcaatctcttttagaggtggacctgacaatgacctgaagctgacaatcacctgaaaccctcactatgtcagggcaaagcagagtgtgaagtggggtaatatcagctaacctcgtttgtgtcagtgtttaaagccctcagtctttattccttcatgggctttgcttcccgttaagattctataaagggtacagatgtcattgctgcacacggcctcagctgcccagtgtttgattctgtatgacgttcctgctaacctcaaagagagttccgcctgtgaagagtgatggtaacagaggagggagtgtgggctggtggttaggacagggacagaaagttaggactcggagttccattcctagctgactgcactgctgagtgaccctgggtgagtcatgggggctttattgttgtgtttcctgatcccatgcaaagaagactttctctagtctctggttcaattgtaaagtttatttcagtaaacctcatttcttcctccatcaatttttgtccctcccccaacccagattgtggtctgtaatccaaatctacaaaacggctgtggacacagagatataaattaattgacattaactttgtaaagtatattttgaccagagaagtgttagaatctccttaaggatttttatttatttttttaaatgaaaagaatagtaacttgcttatggcccatctgataaaaagaaaagggcatcttctaagcttttctcttggctaggctaagaagtggttattacaggtcaaaaaagaaaaacagataaaagaacagaaagttctttgacaattactgcttcatatttagtatgaattcctgggattcaaaatgaaagcacatagtaggtgctttataattgccaaataaactccatggctaagaatatgaaaaccagagtgagacccaaacagttttcaaatgtgatattcaaagtgcctcaggatgggaaaacagaagaggaaacctcaaccagtgttacattgattatcatacacattttgaagaataaaatcatggaaaatttaaacttaacttttgacataaaggtaaaattaaactcttacataaaagatacaacttacatggatcagaccagagaaatagtgccacaacattgctactttgtgcctttcggaaaaggcataagggaataccagtatacatggtgaaatgaaatgcagacatcccaaaacacttcttttctgccaattgagaatgaccgatccgatgagctagacagtgattcttattaaatcaaacagcaggaatttcattttgctttgcccaggaagctggaagcagaaaacctgcccctccagctttcattctttatctaccctcctctagagtcttctccaaaaagcaactcatgaagaagcagaagtgatcactgggacacatctggggaagttagaattatcagctggattctagcaaagagattgtattgtaggtgattcctcatctgaaaacagcaatgaaggagattatttctatacctcatggagtatgcgagggaccaagtgagctatttgatgaagaggataccatgagaatacacctttaaacaagttgttttaaaatcgttttatttgtcttgccatgacacattgcaagtgatcaagctaaagtttcatatcattacaaaaactagcctcttactagcatttgctgcatcccgttaatgtgcacacatgttgtcaacacagaactccagctgattctatccagttccctaaatgcccttcccttctctccccatccactgtgctacaaccatctgaaccaggctttctccactgtgcttcattcaggaagtatcctgggaattatggatgctgtgcagtgagagccagattgcaatatgagcacgtttgctgtcttgtccctcccttccctgcaatacccacccacctccagccattcactgaggtgagagaagccttggtctcaggaagatgggtgttctgaggggtctgggttgaagatggatgggattctaactacctcttaagattataataaggataatagaaacaatatagttatattagcctgctcaggctgctacaacaaaataacattgactgggcggtttataaacaacagaaatttatttttcactgttttggagtctgagaagtccacagtcaaggaggcagcaaatactgagctaaaatgagatcagtattttaataactggtaaggttatactgtgtgcgtagccttacacataatgtaatctgtgagagctctcttcttggcttgcagatggccactgtcttgttgtgtcttcacatggtggatggagacagtgagctctctgatgtctcttataaggacactaatcctatcctatcaggtccctaccgttatgacctcataaccttcattacctccttctggtccctatttccaaatacagtcacattgagggtgggggcttcaacatatgaatttggtcgtggtgggggaagtacaattcagtccatagtaattggtgaacttgctttgaaatgataaaagtattctctttacatctgtttgttttactattattgcatgatagtcacgtgggaagaagcttaaaccttggcatttttatttttcttgctaggatatattcctgaagaaatttcacctaacttagattcattcattgacccattcatttgttcattcattcaacaattattttggaggtacccaccatggccaggccctcacagcagtgataggctggaggtgagaccctctccacaagagcccttcagttttccccaaccccaaccatgcttaattttccatcacctgactggctcctctcaattatttctattgcctaggccctgttcacattggtcaaatttatatgtgtgttctttatattaaaatgccagttgatagagggaaactgagacaattccaaagttctctcatcccaactatttaaccatttgttttctaactaaatgatgatgaggtattttctgagttctgggaggaagttaagtacatagtggttaagagtgagctataaggccacacagcctggaattataatttggattctaccacttagaatctctgtgaccttgagcaagtcaaatggttgttatgaaactataataaataaataaatgtgatgtatttagtgacaggcccatagtaagtacccagtgagtgtcagcaataattattattgaatatacaagaatgaaattcaaaatatgtagcaatctttgtgtattgtccaaatagcatggatgtgacctccctccttagttgctgaatggggggttgtgactgaggggttctccagggaggtaccaattcattcaggcaacaggagagtgctggggacaggtagagaagggcatcttaccaatgagtacaaaataagctcagcattttttttttggttttggtttttttttgggttttttttgtgttttttttgtttgtttgtttttgagacagaatcttgctctgtcatgaggctggcgtacagcagcacgatctcagctcactgcaacctcagactcccaggttcaagcgattctcctgcctcagcctcccaagtagctgggattacaggcgcacaccaccacgcccagcaaagttttgtattttttggtagagacaggatttcaccatgttggccaggctggtcttgatctcctgaccttgtgatcctcctgcctcagccttccaaaatgctgggattacaggcgtgagccattgtacccggctgaactcagcattttaataacccataaggttatactatgtgtatggcttgaatatcatcctgttattgtgcttttgccacttgcgaggtacagatgcattggcttccttggctagactactcacactgatggccccatgccccagcttcataaatgaaccctcttgtacctacgtagctcacatggctacaatgaattatttagagactaactggccatttgccgtgcttaacacactctgtaggctatgaagcaagaataaggatgatggggctgaccaatgttttctactttcatttaataccagtttagcatatctgttaaaagctgtccctcttagagatatgtatgacccaaggacccctttggtagggcttccattctctggactatcagattatgcattttctttatcctacaacattttcatataggcaagagcaggtttaaaagaataccaggtggtctgaaaggaaagagaagtctcagaagggcaacaccctccctcagagatatgtgcatgggggccctcctttcaggaaaggaaccagtacagagcaggagtgggctgtagttgccccaggccagatgagtccccaccaagagtggacagaggccactaccacccccgagagggatacttgtatattgctttgtcttgtttatattctagggatggaaccacttctagactccagaccatctattttttaaaaatatagctttttctccctctgcaaactaggtccacactttctgatttgtgtgtgtctttaagttgcctaatattgttggatgaatggggctttttgaacacactgtgttattaataaatacagagactcctggaataaataaataatgtgattctccaagagtcacattcttattgtaatacattttagacagtgactttgagcaaaacttaatttttggaattatttgaaaacatttactattgtagagaatttcttcaaatataattatctttacttcccggggaagttttctaacctctattgtaacaaatagtctatactttgctttttccgtttttatatccgattgtttacttttaaatggtatgttcattatttgccaaagacttgagcaagatgttgcttttattaggtgaaagatttatcttcgttaatttttaactctaatctccttgaaaatatattgagtttatgccttatatgctacaaattattgtatccataatcattttataacttcactgttttttgttctctaaagccattatgtttttttccttttgagtttttaaaaagtatttccagcacctatgaacaataagttatgttatgcagcattacatctttgcttcttcaataactttgtctagtgttatgttgagtagttgaaattaaattaaaatctttatttctttaaaatgttcatgataaatatagtcttctgaaaactaaagaaaacaggagcaaaaaattgtacccaagtgctcatgctcacataaatgcatgcacacacacacacacacacacacacacacacaaccaagactctcaaatcctagtcaaaagctatatttcacaaaagagaattatagtaacattgatggtttgccaaaacctcaagcagtgacaaaatccacagtgtcctgtaggggatgcctttgcaaaaccatgcctctccagatggtttagattagagatgtttaaaaacacatggcagcattagcttggtttagaattcatagttaattcagtagataaaataatgcaaatttgaaaccctatcctgtctatcagaaaaatcatcaaatcttatgattgctcttaggagaggttggtatgtgatgtgttgatttttaaattatctaattgaaataataaaattaaccaagaaaaagtaaaaagaggattaaaatataagagtatgagtaaaaactttcttctctgcagaatatttcttcctttaagctgtcatatccaatcagtttgtatgggattcgacagccaattgtcatttcctgagatatactctgtaaagaggttgtgttacagagacggcatgaaaaaatggaaaaaataattccagagcatcatgccaagagaagccaaaatgtccttaaagaccacaaagtgttgccaggatcccttcaccttgctaataatagcagataagcagcttacacacaaatttttcctttggcttatttagctttccctcctagacactttctaaaagagagtgctcccagtccacattttagtaaattattttgccttctctgtgatttttcatcttgggtgggcgctctttgtgaacagcgatgttgcatattgcgttatctgacacgagacgtatagtagttcccccaggaccctaaaaggcttcatcactaaaagcttggctcccactgtccccttccttatgtctaaaatcaacagtatcccatcctctgatcccacagctggacagccagcaaacaactcctggaaaagaactgctgtatgggaacagtattaatttaatgatgtatattatcgtgtatcctaccagcagcataaatgaaaacattcggcagatatgttgaaattgccactggaagaacgctcactcaaggactcaaagcctttcagaaaatccacacggggaaaatatgggacaaagattctacaaaaatagaatcagaagttttcaaaacgccgttgctaggctttgaagggcttgactcaaagtggcccagtatttacttccccctgaaagtaacacattttgagcatttttccaaatataaaaagtagaactgtagcttttaatggctaaaggagctccactatcaaagtaaatgtgcttctctggcagcaaggacacatgtgcgtgaagaaaacaaggggggagcaggaagagtaggaaggtccctgtcacaggaatttgtgtggattcatgagtatttcaactgtagatttcattttgttttaaacatggagaaaatgtgttagccaaccttaacaactgatcaatagttctgcatatatccccacttaatatgtgtaatgggagatatattttgttgtttcatctaataatcaattttttaaataaatgggaatggatgatgacttggcaggggaagatgcgagcattcgagagaatccaggcgcttcatcacaggcataaatgacaccatgccaaaagacttcacttttggagcaggtgctcagaggagagaaaaccccacctgagcctttctccccctccccagtcacactcctcatgatgacccttacatgttttattgcatcttctcttgtgtgctttgtcaaatttgtgaatatttagctaattttcagaacaggatttcactggattatcacttctctatattgaaaactgctttacataaatttcctgcctttagaacattccaatgtgttcttccctttgtatgagggattttgagccaagttctgtaaaacatcacaaatttggacaacatggacagagaaggccaattctcaaatcagatatgatttactaaagaagatcaggataattaaatgattctttttgaaaaacaaatcatcacagtctccaaactatcctttgtgcaaatagaaattttcactatatcaggtcctctgatatgacagctgctgatttgggacattgttacagaagtgaaacagaacaccaatgctatgttataactcaaacttgtaattaaacatctgggacctgcctgctttaatgaagagataagaatatttggttggttgtgtatcatatctctaaactgatactactgtgattcaatcattacacattgtgtacatgtatcaaaatatcacatgtacccccaaaatatgtacaactatgatgtatcaataaaaaatgcaaaacaaaagcaaatacaaagattgaaggacttagaaactatttattttttcacattattcttttagttagcaagtactctttttttcatacacagtgcaaagagaaaaaaattaccctttattgttctgttaaaatttcactagttagctagtacttgtgttacaggaataatggcaaaataaatgggaagtggactctgtgagcctctcagacctgtattattccaaaactaaatgtaaaatattttttctcaaaaacctttacaaattcttaaacaatgtctgtatcatggatacttatcctgagggatccaacagtgttgaatcttgcctagcaatggaatgaattcaagccataaatatattacatgactgttctccacctcaaaactcttctaaagcaagggaggacagaaatggaaaagtaaataatatagttcctgttttatattctacatagttcctgatgaaaacccttggtgagttgtatgtgtgactagttcatatcaatgatgtttgggtgcaaaattcggagatagcaaagagctgcaaaatatgatacatcaggagaaatgaaagtgtagaggtagggcaaggcttttcattgttacctacataacacaatttgccatatccttaggttgatggcagatcaacccagcgaaaaaacactctaagcctctgtacagcatttttaaaagaaggctaatggatttttactgcctagttcacacatatcaaagtaagaaagatgacaccttgggaaacaggcaatatcagttgaagcaaagcatattataaatgccaagacctatattagaatttatatatgcccaaagcctgtttatttggggactgaattctcactggctctgagcctgaggggccacagtccatttctctggttaagctaggtcagtaccacctgtgttcctacggtgaagtaagagctgctgagacccatataccctccagccactgtatttattattgcacttgggaatgctctgctcttgaaggctgatctgacgagggtgggatcacaggcagcaggtatgccatgaacaacaaacccatattcttaacatatgtttaatttgagtaactctcctcctttaaaatacctcttgattctgaatccacatcctgatttgcccactcttgttaccattttctgctgcctgttctgaattaatcctttgaggtggtcattccccggaaagaaaaaaggaaaatgagaagagagatgcaaagttgggaatgtgaatgaaagagaatgggagagagcagagggaagggggtcattaactagagtctgctttcatgagctagattttctttgagctgtataagaaaggagaggtagaggaagaagagaaatacaaaaaaaaaggcacttgaaaggttatccattaatacccctactgaagaatgaaaatcattttttgcaatagagctcaatttacagattattttcatttctctgtcgtacttcatctcaaagaattgatataatctaaaaagtggttaaaattattaaaatagtttccatagtagaaaattaaatgattttactaactgtcaaagtcagtgtttaaactgagataatttgaattatatttcatatagtgatcatgtcactaggatgtctaaacattctttggaaaagtaataatccctgattctgatttctcatcaacagaaaactgactaaaggttaagaatattagccaccaattgctgttatttgcaaaaacctaaagagaaggctggttttcatgaggaattttgaatttaaatatattctccaccttggaacaattaaccctttaggagactttctgcatttttcttaggtgtattttctgctcagagggtcatgaaactgcttcaaatacttgatttaaaatatatttgaaagttaaatagcaatatattatgctattaaatataagatggcaaaatattatgttgcttcataacatcaaatttgttttccatctatttatctatctgtttatctgtctatctagcaatcaatcaaatacaggttttcctaggccacagcacactggtttttaaatgaagtcatattaacagagtaaaacatatttctctggtcctcacctcatttgcaacttaggccctctggggtcttcacattctcccacttttttcccgggagttctcagaggatattgcaaatgtgttcatgaataaggttccaatgactgcccgtgaagctaaaagcagcttgcaatgactccagcactcaagccccaaggccttgccctctgccctgtccccattagcatctgagggctggcctcacccactccagagcaagctccaccactaggtgctggtttccattgctgcagtgccattgttgctgatgatgctctagacccctgagtagccctgggccttccagaactgaagccagcagagtcagggcatattccatgaagaaggagacaaaaatgattctctcccccaaagtgtgtattctttgtctcaaggaagcctaaacacacaggctggatactccacttgttcataacaaatacagtcttttctgttgttccagtagcacccttttgcaaatagagctctgcagacctctcccactgatctgctattcatgccttctacactgtgaacactacttaaactcaaacctgaccacctgtttaattatatttcaagtttgaaatgtaatgctgtttacctcatcactggggcagatgacttcttttttttttttaagacggagtttgactctttgttatccaggctggagttcagtggcacgatctcggctcaccacaacctccgcctctcgggttcaagcgattctcctgcctcagcctcccaagtagctggaattatagccatgagccaccacacccggcaaattttgtatttttagtaaagatgaggtttctccatgttggtcaggctgatctcaaactcccgacctcaggtgatccacccgtctcggcctccccagacgacattttattcagaacaattcaagatatttattgaacctagcactgtgctaggtactgaagctacaatgataaatacgacctgttccttgtctttgaggaatctgtccctgccccactaggtcaaaagcaagaataggtgatctgaggtagaatgcatggtacaaaacaaataactagtgcgtggttgacccggaacaccccagccgccgcattgtcacctgacttaaggtggtcagtggagtggaggcgggaatggttaggttcgtttgtggaaaagggctttggaagtccgagctagctcgcattaggagggaggcgacctcacatgaagaatacctacctcctacctcaagatcctgcaaatgtttggggatggctggtgaaccacaggtattcctaagcctggttcttattaggcagggaaaactagaagcctcgcttttcctcatccttgctgtggaatgaaaccaataaagtccattactatttagacaagtgagtgaatgctgtttgtttgagaaatactgttcctggggagggtctgaccaatagaagcctctgaagggctttttgggggtggagagaaagcccagctagagggtggttctagtaatataagaatcaatggcaactctgttaatgtcattaggttaaatctacctaatcaaaatcataaggaaagccttacctttgcatacatatttttgttgttgtacaaataaaatgagtagctcaaaatctagcacaatgactgtctatacagggctgaatatctgtaaaagaaaaacacctaaagaagtttgcattgccagatgcttggcatcatgtaatcaaaacattttgaatgtattttaaaatagtcttccagatgtgtgacaactttgagcttagctacagccattatctacattttggaaggggagtggaaaactgagttcattatttaaattatacgggaaaattgaattcttattgccttcctggcctgattgcctcgggaaaaggtagttttattttattttttgcctttctaccaatttcttcaacactgtatttgacctgacgaatgtaaacacagtagaactttccacagtaccttgcatttgccataagaaagatgttattgccaccaaggggtgacatttcttgactgtggaagtagtctagttatttagaattcaacttttattttgtgcttactttccctagttcttgatattaactatacttaatatgtaccaatctgcccagtttcttttcattttagggctcatgctcaagaacatggaattaactaaggaaaaaaataagttaaataaagtagaggggttttttgcctttggactagattttcccatagaaattcacgttcttcagtgagagttatgtgctatgttaaacccactgtaggatatttatctgtgctcaaagtaggtgccaaatattaaataacctactagaactataggaaaaattgctcaggagaattttcaccttgtgaaatttgcagttatttcctccaagcccacacagaaatattctatttgtacttaagtccatcaataagtaaatctgtgaattttgtcattgatatggtatcactgccaattttaaaagaagagaacaactcacatagaaaatttcgaagtggtggtgtgtgtcaatctagttctcaagacatatctttctgtcaacatacttgagtgtactgttcaattaactttcaattattcctaattagtctttgacaccagttatatatatgatacattggtataactggcatttggcaaatataatagattggcgtgtctttctgaagctacggttaatttaaagataagacgggatccctgtaattgtactggtagaaaactggtagaagttttcccaagtgacacataccgatcagcataaaatgttaactgcttcaaaacaattgaaaaacttaaaaaatgaaaatatgttcctatggtctgccaaaactatcctgaaattttatctgcgttggtgggaggagggttggggacagtggcaggaagcttattgttacatttttttcatgccatgagaacaaatttgaaaaagttttgacagaaggtatatggattgtgattgatgtgatggttgatagcacctctactgagagagtagttccactaatgtaacttaggcttgaaagatttattttgaaggaagagggtatatgcactcatgggttgcaaataacagcagagtttgggtttttgctagtaggtctacagtatgctctgtgcgtctctgcttctgtctgaagattaccatcctttcttttttgttggttgttctgtttgaaatggcaattgggaaaggagtttagtaagagataggaagtagaaaggagttttaaatctctattctgcctggaactttagctgtctcaatatgggagtaaacaattcaaattaacctttttaggaaaatctcacaacagattatattctatcaggtgaaagaaagtgaaatagaactagggtacatttttaaagccaaaacataaactcaggtgaacatgagctcgagtgagtatgaaggttgtttgtctgggagtgtacaatatatatgtgaccatgactttagctagtgatgggctgtgggaatcagctgaatttacatatactttgaagtgcttaatttatcattttctcaaaatatttacaagtttatcaagtatttgttgaccacgctgatagaataatggccacccaaagacatctctattcttataccaggaacctgtgaatgttacctcaagtggcaaaagggactttgcaaataggattaaattaaggatctttttttattatttttttaaattttttccataggttattagggtacaggtggtgtttgcttacatgagtaagttccttagtggtgacttggggaagggtggatgggggtgagggataaaagactacaaatagggtatagtgtacactgctcaggtgatgggtaccctaaaatctcacaaattgaggatcttgaaatggggaggttatcctggattatgtgggtcggcccagtgtaatcacaagggatctcataagtgaaagagagagagagaggcaaagagggtcagactcagagaaggagatgggatgatggaagcagaatcagaaggtgtgatgtgagagagagacttgaccaacccttgctggctttgagggtgaaaggtggcatgatgcaagaaatgagggtggcctctagaagttggaaagaaggccaagaaattgattctcccctttaccctccaaaaagaaacgtagcactgtctacccctcgattttagtccttccaacctccagagctgtaagataataaatttatgttgttttaagccactaagtgtgtcataatttgtttttgttttgttttgttttgttttgtttgagacagggtcttactctgtcacccaggctggagtgcagtggcatgatctcagctcactgaagcctcaaccttctgggctctagtgatcctcttgcctccgtctcccaggtagctgggactacaggcatgtaccaccacgcctggctaatttttgtattttttgtagggacaggtttttgccatgttgcccaggctggtcttgaactcctgggctcaagtgatcctctggccttggcctcccaaagtgctgggattagcaggtaatttgttactgcagcaagagcaaattaatgctaatgcctaccaaatcttaggaactggctgaggcacaaagaacaacacagagagaagagaagcccatctcctgcccttctgaggcttccaactccaaaggatccattttattgtacccatgaagaaattaagcccaacagaattaacatgattttcacatagaaaatcagtcttgagtaccagttcatggatctttccactacgtctgtatcctatgattaggatgaaggggaaaaaatcacatcctgtcccttccccacaacctttgtgtgttaccgtaagggctgctgtcctctgaccagagcaggaaacaaacagcttaatgacattcaaatcattttttacttaggaggactcatctatagaacagagtcatgcttttgcattctgaagagctggaactccctacagccattaaagaaagggaagatggcctgttctctcaggcagtggcccttaacttaattgaagaaactacgtcctaaaggagttaagtcccatgaacaaagtgacacagctatagaaagagagtctttccagaacgtgagtctcctgactcccttttcggtttttgccccttctcccagcagacatgtaaggttccagctgctttttcggaatctgaaataggaacccagtgcctttcactaacctacttcccagcacaccgtgtggattacaaagggaaattaacatgtaaagaaaccctttggaaactaaaggagccatgttagttctcttgctatattatttggctggtctcactgttggtgtcattttcaagtgtggggcttgatttaatagagacagccaacaactgtggatctaatcaaatggggctcaaagcacataactttctgtgtggggaactataagaaatattttcaagttttggaatgttctgacaggaatagggcagaaaatattcaaaggaagctggaaaatcaagctacggatcttgtttttcaggtctgttatagtcactttgtgaagtactgcagacaattcattataatttatcacactgatattcatagattggatgaagcccaaacacaactgagttagatgcatattaaattacctcttacttaaaaggagggtggtcttaccagggcaggatggagttcattagcagtcttagaagctttccttaactcttcattatctggtttcatattattcctggctccacaggatcattgaacaccttcctttttttcaactcctggagaattgcacaaggcactttgtgaatctcaccaatcaacaattccaaagataaaagacacatcatcacaagtctatgcacaaagcagaaattactgggaaatctgttcctattctttgtataaaatcatttttttcttttttagggaaaagaaaaaaatactgcccttgtgcattttaatttagatttatatgaagcaaaatgttgctttttattatgataattgactgacacatacattgggtgtactctaacatatgtttaggaatttattatcacatttattctagctgacccataatatctcccatataaattcaatgaagaacatggttcagaatagaatcctacagacagatggtctttaatatgcctctagactctttttcctgaactggaaatttcagcctctatgtaaatgccccttaatgtgtacatcctacgtcttatgattgaaaatagtatttcccttgtggactgagaaaaatccctgaagtgttgtaaatttaatcatttgatccccccccagaatttttattcacatatttttctttatctcttggtttgttattttgtccttttaaaaaccagctcaagttgaactctggggaatttgattcccatttgtctgttgaatttccaagtacacataaatgttccggtaagagggaattgccttcagcttagaaatgaacccacaaggacacatttctggtattttctatgctgcagccattctcagtctatgggtctcttgcaaaacttcagactcttcggtggacacgacaatggtgtagaaattgagggctcagtgagatttgggattggttaacaatttaaaacataagtttacccttgtctcttccatatatcttatagtaagcacttaaatccagtttttccaagttctttttagtacttcaaagtagcagtttatcaatagaaccaccaaggtagacatagtcctagaggtcacctggttcatctttgtgccttagacataagcatatctaagtcattctaggcagatagaaaaagacaaatcttcactaagactgtttctacctttggcctcattgctttgttgggcgtaggtcttcacttcttattgtcttgcccaaggtttatattcaccacatagttttaatatgaagaaagacctattcgtgccaaattattttattttcttgctaaatttagaatgatccaactgattctgtgtactgtcacagctggcaaaaccaccacagttattcagaaaaaccatgtgaagatgctgtgcttagtagaacactttaggtttttttttttttttttaatggtctctctataatttctgacctaagtgccttggtaatgatctaatgtgggctagtccatgactctttgggtggatcctccaaatgtagatttattttaccagcaagggattgagtgacatatggagactggatgtttttctttctttctcagcctcctcaaacaacaaaccgtgaatcctacaaattcaaaaagaaattgtccaaagcaggacacacatatcatgcaattgtttttagacactcttgccaatacaacagctctgaatctggttagcttatttttttgtattgtgctggtaaaaaataatacctgataactgaattcttctcttggattctgtagctgatgaacgttattgcttcttttatatggcccaggaagggaacacagattaagaagctggctctttttttacatgcttgctctgtcaagaaagagaaggaagtaccatatttttgaatgctatattttccccctttgcaaggagttagtactttttcaataaaaataaatttaatttgtggctacacttcaagtaagatggtttgatgtcaatgtacagcagtctcagctctgaatttagagaagtcgtgtggctgactcccttagtgtcactttcatgtggttgggtgagccattctcagaaaccccaaacatttctgaagatcctaaactggagacattcacaagtcttccctccctttttgctactaatccttcatattttaacaagcaccgaagttaatgctgcctacactttttcctgtcaaattggaactctttcttctgtcttgagtaatctgttctctctagttcatactttcataaatcaaagaggtggatgtcaacacacaccatatccaaatatcaacttcctttcttttaattaagcaggatttagacatttgatttaaagaaaactgttgctttttaacatacaaaggcaaccatatattcatcttcatctcttcctgttattttttatctctataaataaaacaaagtttgccttcgccttgtaccacatcgctattccagtctaggcctagcaacttgggttttatattttctaaaaaagagacaagaaactttagtgaactgttggcagtcagtactgaaaaagccacctttgttctgaacgtgcttcagtgagcattattgtcagatattgatattttttaactttttcctaaatgcaagccatccttttatttctaaaatatgaccattttgctgaagatgattctctctctcaatgagacaactgtgaaaaaagtatgcatattatttcatatcatgtgagttcagaagaatgttcctcaggtcctgtgtttatgtctgtaagtaagaagttccactttttgttaaagcacacaatagtggccctattcacttttcataataataaataataattcatataattattttgaggaatagacacactcaatttcaaaagaacttgttggattgtaatggcatttttcctttggttatatagtgacaagatgaaaacaaagcattttctcccaaagtggcagtcaatgcagagcttgtcaggagtgatccaactggtttccaagctgctagctgttcattagactctcttgaaatgattaattggtctcaatcagttcccagcaggaagtacccacctcatagtaaatatcaccacaattggtactaattaactctgttatcacctgtcgcaactgatagtctgggagctgagtgaggtgagcgatctctacaccagcagcagaaacccaactggagagaggtcagagactcactgccaaggccactgtaacaggcagggagcccacaagccctctctgccatctgggtatgcatgaggcttagcctgtggctaccagtcccacagaggtgaggaagtaagaaatgtagtgctcaggcgggacccatgtctcaaagagaaaaggcacctgcattcaaccgatgcaagttttcacagtatattggtgtcaaagtcagccaagctgtggttcaaatctggactttgccacttactattaatttgatcttaagccagtggcttacttctctgagcctgggtttcctaatccaaaaaatatatataggcaaaattacccacctagtaagactgatacagcgatgtgtagtatatgcttgacactcatttagtaactgcacaaaaattttggaatgctggccgcaagtaaatagccatgtagccggggatgacagtgataatgttcattagcattcctgacaataaacaagaaaactcctagtgtctacatggagagtgatgctgaagagaagttgggacctaaaccttcatttcatttttatttatcattttctaagagcctcattatttctgtggggaggagaaacaaggagagatgtaaaaactaacaaataaccttgaaggaaattaaggaatggtattctagcagagggaaatatcataagtttctcagttgggctggttgtgaaaatgacacgattccataagggaaatatccagacctacattgatgcggaaggaaacttatcccacaatgatactgggtcatgctccatgaattaattgtttcagaactgtgttttccatttttctccatgatatgaagcacctagatgtgtttgttaaatacacagatcactagatgtctaccttggaaattctgattaagtatatcacagtgaggactcaggagtttgtgttttttgtttcttcattttaattaacaagcaaaattgtatatatctatggtatacaacatgatgatttgtttgatatgtatacattgtggaagggctaaatcaagctatttaatatacacatcattctttgtagtgagaacacataaaatctgctctctgcaatttttaaatatataatacattgttattaattgtagtcaccatgttgtacagtagatctcttgaatttattccttctatctaactgaaattttatatcctttgactaatatctccccagtccttctattccagcctctggtaaccaatgtgggtttttaatgaactctccaagtgcttttttttttttattcagataagcttaggaaccattaatttgaaacagtacttttcacatttgacggcaaaatactaatgccccagtcgcacccccagaaattctgactaaattggtataggatgtggcctgagcatttgagattttttaaagcagcccaactgatgctaaggtacaggcgaatttggagtagtactgatttagaaaatagtctgaagggtacctgtaaatgatgaataagtaataactagatgtaaagtcacatcacagatcaatagagtccagctctaattcaaggtgtgaaagaactgtcaagaataaggacttaaaatagttaaaccacgtaagaaatgatgtagtaacatgtgttactagatcatcaggacaacctccatcaacaggacaggaccaagaattactactgaaattattggagaaagatttgttgagcaagaagagtcctctggaccacttacagtgtttagagatttttcttcgaatcaggaggtagtaatttctaattctatatgggaatatattgtttatctgtctttaaactacattacctaattcaaatcttccaacagccccagggaaaataggcaaagaaaatgcctgttccataggtagggcaagaactgtcatgctcctattataaaaaaaaaaataaggcttagatacctcatatccattagaatggctagtactaaaaagaaagccaaaaaaaaaaaaaaagacagaaaatagcaagtgttggtgggggacatggagaaattgaaacccttatgtattgtgggtggaatgtaaaatggtgcggctgcttgcattagtctgttttcacactgttgataaaaacatacccgagactgggaaatttactagagaaagaggtttaatatggacttacagttccacatggttggggaagcctcacaatcatagtggaaggcaaggaggagtaagtcatgtcttacatggatggcagcaggcaaaaataaaaataaaaaataaaaataaaagctcgtgcagggaaactcccccttataataccatcagatcttgtgagacccacccgccagcgcaagaacaccatgggaaagacctgcccccatgatccagttacctcccactgggtccctcccacaacacgtggaaactcaagatgagatttgagtggggacacagtcaaaccatatcactgctatagaaaacagtgtgatggtttgtcaaaaaatcaaaaatagaactacattatgatcttgcatttccacttacaagtatgtacccaaaataattgaaagcaggatctcaaagagttagttgtgcacccatattcttagcagcattattcacaatagccagaaagtgtccattgatgaatgaatcgataaaaccagatgtggtttatgcatgcaatggaatattattcagccttaaaaaggaaagaaattttgacacatgctacaacatagataaaccatggggacattatgctaagtgaaatagccaatcacaaaaggataaatattatatgataatacttatatgaggtacctcaagtagtcaaatttgtagagtcagaaagtagaatggtggttaccagagcctggtgaagagtgatgagggatgggggatgggggaggaatgaggagttagtgtttaacgggtaccaagtttcaattggagaagatcgaaaagttctggagatggatgatggtgatggttgcaaaacaatgtgaatgtgtttaatgtcactgaaccgtacacttgaaaatggttaagatgataacaaattttatgagtatttcaccacaattttaaaaataaataatttgaaaatgtgtccctcaaatatgcaaacaaacaacttaaggcttaaaggagtcacacagctagtaaggtgtcagagcagaaagtcagttcttgggactctgggtctgccaatcctccctttctacctccctgcctctcaggaagtagaaattgaagatgatgctcaggaagaaggaaagagggagaaatagttgtttgaggaaagagtgatccacggggtccagacacagttgtcttgaagataacaaataaggttggtaagtttcatgaggtcagaaacatgtctgcacaattttaacaattaagatatattttacatgccacaaatttacccttttaaaacatacaattttgtgtttttttagtatattcacaaagttggacaattagcattgtctaattccagaacatttttatcatcacataaagaaaccccatatttagtagtcattcctcattccttccaagcccagccctaggcaaccacgactcagctttctgactcaatggatttgcctattctggacattttatgtaaatggaatcatacaataagtggccttttatgagctgtttcagttagcgtaatgatttcaaggttcatccatgctataccatgcatcagtactttattctttttattgccaaacattccattgtatggatttaccacatttcgtttattcattcctcagttgagggacatttgagttgtttccactttttaacaattatgaataatgccgctgtggacattagtgcacaagttttttgtgtagacatattttttcaattatcttgggtatatacctaggagtggaattggtgggacatatgataattctatgtttaactttttggggaactgccagactgttctccagagtggctgcaccattgtacattcccacaagcattgtaatgagtgttcccatctctccacatcgtcaccaacacttatttccatttttaaaaaattatagccaacctagtggatgttaaatggtatgtcattgtggtttgcacactacctttgtattctcagcataaaagccaggacaaggcacgtgatagggtctaaatactgaaagccatgaaaattccaaggaattctcagaaaggttatcaggatgatgggtttctaatctatgggaaatcaaattttagaatcagctgctttttatttcttagtataaagagtgtcaagaaggagcaggtaactaactcaaactttgctccagggcacccccacattaatggggtgataacttttgattgatgtttactcctcttagaatttagaagaatagcctgtgcaccccaggacagagacttagagagaggaagggagagttttagaagaaaaaagaggctggatatgttggctcatacctgtaatcccagcactttgggaggttgaggcaggaagattgcttgagcccaggagtttgagaccagccatggcaacatagcaagaccccatctctacaaaaaaattttaaaaattacctcggtgtggttgcatgtgcctgtaatcccagctactcaggaggctgagacaggaggatcacttgagcctgggagctcaagtgagctatgacttgagctatgactgtgccattgcattccagcctgggtgacagagcaagaccttgtctcaataataataataataataatataaagaaaaaaagaccctttcccttcatctcaattaaagttaagtgcctgacccatgactcatgtcgtcttgaccagcttcacaccttccatgttgccaaatgcctggtgctacatgattgcctataggaggggttttcaacagcagtcttctccaaatacacttttccattaacaaaagaaatatctttgtgggtttcttaggtactcgcagaaatagctactagttcactagtagctagaagcatctgatctgtctgcctcaaagccctctgacagtgaagcatttgtttttaggcaaataaaacgtcagccaccatttaacagcatatggcaacaatacgaccagtccctccctgaggaccatcctctccccagaagagatggtacttgaaataggcgatgcttttgagagcagaacccttatttctcccacccaggcatgatggctggggagtgggcagagtgccacgcacggaaggtcacaggcaaccagatcaaatgggagcctagagggtaggcttcccagccaggaatgaccaaaggttgttcaccctgggcatctgggtctgtggttaaggggaagtaccatctctaagctggcctggattagctccacaaaatagaaaacagcctccacagccacttaaagacgggtctgggctaacttgaattgaatgtagtgatggtgtgcggtgagtgcagggagacattccaagctgaatctcaccctcatctctgtggaattccctgtgaatggtgtaaaataaactgacttctctttaaatagatgatgaagaggtggaactctgtttagtgggtcagctcgtgtgcaagtgaacatgtggctatatggataaggaggtggtctgtctttgcaggggtggccagtaactgggccatctgctcaggattaaaaaacaaactgttttctcaggagcctctgggctaaggcatctgctaaaaacattggaaactgtcaacagagatggcttggtcttcgaaatatagtctcaaaattttgcttgtccgaacttgggaggaacatattgtgcaaataatcaaaatgtgatgcttgccctcttagaaattgtggttcctaacgtaacactgtctttgtgttatgtgtgttggaatattgacagtcagtcttaccagtttttcatcaagcttgttacatatgagctcatcgtatttctgagcccctgatttgaccaacaatgtggccacatcaatgaaatcaatagccttgtgaaaatagagttcaaccgtagcctcaggaaaaattactttgattagttaacattattgaaagatcctcaccaactttataattattttccacttacgtaaactacttgattggtttttcttttttaaatattttgtagagatggggtttcaccatgttgctcatgctagtctcgaactcctaggctcaaccaatcctcccaccttggcctcccaaagttctgagattacaggtgtgagcctctgcgcccagcttgatttgaatttttaaaggccatacgttatttttcaaagtaattctaagacattaacattttaaggaataaaataaaataggaaataattaagactataaaaatatctatacacatatatattcttacagtataacaaggcaaggaaactttttgtttccagttaatttcatttgtctgcattttattagtctccatttaataatgctttattataacactgaataacaatataaaatttcaactgcatagggaagtaatgaaattttttaaaataaaatggtgttactaataatttttttagattttatctccagaaaaatgtactgttaaaaatgaaggacaaaaaaaccccacatttattagtagtgtcaaccaatttttctgaaatgttttttacttttaaccaaatagaggtaattgacaggatgatatcatttgctctttttattcacagtcagtaaattctatgacaatcagcagcaacagtaatgactagataggtagctgtgtgaacagcagggggttgcaacagtaaaaggtttctgagaccttttactctgaggattgttgatgtagactttccaaattaaaagaggagccctcattgtccaaactgtagttaagactataaatatatctatacacatatattcttatagaataacaaggcaaggaaacttttggatgaaaaataaaaaattaactcactcatccaaatgttggccaccattacatcaaacatcagggtatgtaaagacatcttgtgaaatgactgaattctcaagtttacatctaagcaattgaaatcttactacgttagcatttttacatgaatgatagtgcatagtgtggtgtaccctggagacctgtgttgaacacaggatatgtaaatatatctgtatttattttaacatatatgtcatgtaatacatatatgtcatgtaatacatataacatgtaattaatatgttgagcttaagatataagtgaaattgatgaacataactatacctcatcttccaaacagaaaatgaaaaaaaaaagtctaatcttatttatcatggttatattgtaaaaataggtttgcagcaaaacaaagtagactctggaagcagaactctggtgctgcaaggtggtgttactcttttttagcattaacttgactttttatcaaatttaaatagaattctgaatttgagatgggggcttttgtgacatttaaaattttttgaaatggtttagtagtcctttgttggtggtaagtgttggatgaatgaatgaatgaagaatgaacaaattaatgaatgaacaaataggtattggagttctcactctatggggttgggttctagttgattgccaactatgtgtttcagttttatataaatacctccactgctggttttcctctggtttagtctcaacaaacagtacaagcttgcgggggggggatatttgcttggatttagctgaaacacagaagcaatcaagtggttgaattctgcattttaaaaaattgaatgacattcctttatccatatcgatttgagctttggtaaattcaattgtcgataccacctggataattttaaatctttctgaagctttaaaaaaaagtttccaacgtagctccagcaacataagaatttcatcaattgaaagctaagaatcatttctgtgggatgtgtaaaacaagaagccgaccagcattattttctttttctttaattcagtatcattattgagagttattcttgaactttatgaaaaccagattggggcatgagcatgttctccattgaatcatgttcaaggaattgaaactgaaaatcattcaaagtagggaaacatgacattgaaaaatagtctacattctttattctccctcagagtatctgaggctgtttctaactaggaagccttaggctgataggagatctgggtttggtttcttgttttttgtcttgttctgttttattttttttaatagatgtttagtttactagtcaaaaagaggtcataggtttttttttggggtttttttgttactactttgctggtgtatcagttatgatgttggatcctcttactcatttgctccaaaagttgtgatttctcaccattgtccacagaaaaaaattccaaataatgtcattcaaggctttctgctgtctagcccaggcaatctcttagtcagacttcctactatctgattcttccatgcaatccccttcccaaccaaaaaagactatgagctgctcacaagtctcattttgctgcctctagtccttttccttcattatcctatccttcaggaatgcctgttgcttctctccactgtttgaatgttccatatatacttcaaggtgtgattcatcctcttccatgagttctttccaaccatctcaccatttccagcctcctctccccctccctaactaaaacaaatcttccccttccatctatccccctcacacacagagacacacccacacactccacatgctcctacaatttagtcatagcatgtatcacattcaaggctgctacttgggtgtgcaagttgtgctctgcacaagaacatcaggccaaagggacacgtggggatgaaaatccatcttactctccatttgccaaggcatgcacctgcccatacgactgtgtttctgcagaggatacctttttctgttttccacaaaggcaccgtatggactggtagcccatctgttcatctgcatccatgttttttagttccctttcccagagcacaaatttgctgagggcagtgactacccttttattcctaccattcctggtacagtgccttccttatacatggtaagttctcagtgacttcatttaatttaattaaggcatgaaatgtattgactaaaaacaattactttagcttataaatgcaaatatgaaaagtaccgtaggaatcaaaatggtcttagcagatgcaaaacagttacttctctgactttaagtgcattatggttctatctcagctaagtaatttcctacaaaatgtactgcccagtagtcttttatggagcttcagaaaccacatttgtgacagactatgacagaccatggcagagctggactgagatccatttctggttgtttgttaaaataggcaaggaataacattaagaattttctgaagtgggcagaattaagatcaggaagaatgcccatgggaggtgagggaattttaggaggagccaattggatcagtctgaggtcagtatacttcctggaagtctacattaagggaaaaacaaaaagaagacctcatcttaaaggccttgaatctagaattactctgcctttaccaacactgcaaattgtgtaacttgatgtggccatgctctcaaagtaaagaattgcttagtaaaggctttagtggagaattaatattagttctgttgcaattctatgtgacaaatgggaaatgtccataaagcaagatttacagaccacaaaacaatgatgtacttaagataggtttcatacctatttgataaaatggacaggacttcaaatttcagatttcaagcagtaaccattggtcagcctctccaaagaaagtcctgtgcctatgtacaaaatttcttagtaactatgcacttttacagtcccagctttaaattatttttttgttttccaggatgtgttgagtttatgtgatgaactgttttcaggaagaaacaagtcacctacaaccatttcacattgcatctctctctctctctccttttccctgacagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacggtaatgcaaacttttgccatatccctgtgagccgccaggccctgaaagagaaaataactctactcaaaaaagtatggatgttttcagtaatgccaagttaggaggatctactttattatgattgaatcctgaccagctaaaagttgagtgaaaagtagatgaaggaagcactggctttagggatgtctcttaataacctacatgtgctagcatgtagggaggatctccttggctctcccaaaggccaccagtgaagagaaaccttggaagaggcatctgtggaattgttttcccaaagaaaccctatgcatttacattataaggtggaaacacgtattttcaaatagatcctgaagagtaaggatttcacatcaagggatgatatatgggacttttgccaactggccttttccatgtgtgatttgagagagtactttgactttaaattctggaatgtgtggtgtaagtctcaacataaagtctacagtgacaatataatccctggggttaaaagtcaacatctcaaaaccattacccataatttagtagaagaggttcagtatagtgttcataagacaactactctgtcatttcctttaaaagaatgacaggtgtgtacagcaattgttcagaggaatgagaagacaggcgtgtctccatcaatccttgctaccttgacactcagggtaactgatgttctttctctgaaatgcccaaattatgcccaaggatacagctttactcttgttttcaatttccttaatgtgcttgctgcatttgtttcatatgctggactcaaaagcactctggcatgaaaaaggactgccagctgtttagctaagtccatgaggaggaaaaatctcctactcttgtaagattatcaatgggaaatgacaaataccaagtcagccccaattctgattgactggggccaaagacacttgcaggtgaaactagttcttgggaatcttgggaaattgctcttgcctgccccatttccccaaactaataacagaaaattgtggcccaggagaaggtgggcttgatgcaggtgtttggtgaagtagtgtgaaaccatgccttggccctgtttggatggctggtgtatttctgaacataccttctgaaatttccaaaattgtaaatccaaatgttagaacatttagcagtaagcttttggggaaaattcaaaaccaggagctcttccaaaaaattaacatttcttttgtgagtaacttagagtgtgatcatcacaactaaaatactattattatcaaacttactgatgttatttctgttagaaaataaaataggccaggcatggtggctcacacctctaatgccagcattttgggaggccaagacaggtggatcacttgaggggttcgagaccaggctggccaacatggagaaacgctgtctctactaaaaatacaaaaagtagctgggtgtggtggtgcacgcctgtaatcctagcttcttgggaggctaaggcataagaatcgcttgaaaccaggaggcagaggtaggagtgtgccaagattttaccactgcactgcagcctgggcaacagagggagacttcctctaaaaaaaaaaaaagaaagaaaaagaaaggaaaaagaaacaaaacttgtccacttttcgcttttgctgttttgttgttgttgttgttgttgttttggtttttttcagggggattttgtttgtttgttttctctaatctatagctaaaagtgaacagttaattttgtgactgtctttcaactttcactattggctgactgattggtaccaggatcaaaaaggaaaaagaggcccaccacagattactcactaatttcctttcacacccaccacacatatgcatttgagacaacaggaaatcataagtaaaacaaaatccctcaggcacacagtaagtttatttccaagataaataaaaacaatctggcatctatactggaaaaatgggtatactgtagctttcttcttccttaatggtagagttgtgtgtgtgtgtgtgtgtgtgtgtgtgtgtgtgtgtgtgtgtgtgtaggcatgctccagtgtctgcttctgttttggtttcattacacctcttttttctcttaaactgagttttattactcatggaagcacaggccagtagtgctgattaaagcctgggaggggctgccacacacactttctccgggcacatggctctacacattcttctagacttgctttctttctctgctggacctttctgagtcttaatccattagtgtttaatgatttgtgttgatgctcagtggttatcaaagaagccccactggactcttgttgaaaaacaagatggatttcaggttcataacagtatttggaccctgccttcccattcttcagttttactaagtctataccattttcaggtgaaaatttgttacatccaatcttccatttgatttccacacagaggttagcatgctgtgtggctccgggcttgataatacactgcctggggctctacatacaccagagacttgggaaagagcattgcctacaatcccacaaccagtcagccttcctgatacttagagaactgattgggataacatttagcttcagatctctgctgtacttactatgtgcagatccactaaggctgactcatttggaagtttcagtagggacatggtgtgaaagacatagggacttagctgactgtccatcagcacgggggaaagaggtgatataattgtcaaaaaagcagatgtaatcttagcatgcattaaatgcaggcatattttttatcacatgagaagtgataattcaatgctacccaggtttctatattctgctggtcagaatataggtagacagttctgttttattctcagaacctcactggaagaggaatcagacaaaatacagcattttcaaaagagattcaccaggataggaaaggttttgaaaaccaggtacccaaggaacagatgaaggaattagtgacagtctgggtaagaaaagatttggcagggagaggagtaacagggaacaactatctataaatattcaaaaagctgtactgttttgacttgattagtttggtttggtcccacagggcactgcactggaagtatctccttgaactttctttatccccattagtggaagaaaaaactcccccaggatactacgaaaactggctgccctttaaggaaggtgtttaagcagagtttggaccacctcttggttgaggcagatgagtagctacattagatgattattaccactccttctgaccagcagtttatatgataataatagtttgggaaccatcctttatacaatagcaactttccaatattaaatattgtttcattgtagttgtggctaggtattatggacagtaactcaccaagggtaagactgatactgtcagctatttgcacaaagaagcaccaagtaagtgtggtttggccactggtggctgaactgcctgaaatctaacccaaattgctgtaggttctgctcatagtaaccttccattttgtgtttaatacacagctgcaaatgattttagcctaccgtttagaattctgcagagtgggataacccactagagtatgacagagggttacaacatcttgtgtatggttcctgggatgtataaatgacctttctcaatgccctggccaaatctaagcctctatactactgcaaacggtattttgaaaaataaatatattattatcctagattttgcagtaacatagaagaacctaattttatctcaccaggtacattgtgccaataatctcaccactagtatctctcccccagattaaaatggttatgaatattaaccactttttataaagaatgttaacaaatgtttggcattgtgactataatgcattaaactccagatttagtaacatgtattccttccaaaagtcagtagttctacccttttgaagactgtctttttccatcactcttgttgagcttagaagccaaactatgcggtggagacttattcaagtagttcaaattcacctccctgcattgcctctgccccatcaaacctcatttgttctagcgtccttctgttccactgcattgcattctgactgagcaaggtgaagctttataagtatttccactattatgtgttgctgccagagcttttagaaagaaatcaggttcaaatcaaaagcggcaaatgacctgacgcttgtattatagtaggattatgttactctttaatccttgttttagagtaatgtgtttgacactcaaatgtaagcatttcctcttggatctgtctctgatcctctttgtttatgtttttgcagcatcccgtgtactgtgtaaatgttgttgggacccagaatgctcataacctcatcactgtctccactgatggcaaaatgtgttcctggagcctggacatgctctcaactccacaggtgggtttgtttttccctacacataacaccatcctggttaaaagagatacctacttaatggaacatagttcctaaaagccaaaccctcacatcctagaggagctaaaacaaatggatgcacttgaaagagtggggcctgctttcagcaatcttctcttgaagccaaaacccatttcctttaccacaaatcatgtaattattgtaatacattaatccttaggtcagtttcaagtgaaaatgaaataatccattctaaatcatagtaattatggaagttgcctatggtatgaattgcacttaccctacagcattgttgaacagatgcagacgaggttggagctcagcagagcaatcccttatgggtacttgcattggagggaaggtaacccagcaaaacagaaatccaagcccttgcttgtatccgtagcctagacaacagcctgtgtgtatgaagaaaccatctgttttcccctctggaatgttttttagtatggctcctgtcattccttgctcagtaaatgagaagtcaaaaatgaaaaagttccaaagtctgcaaaccaatactgattgcaacagtggggaccaaacaaaggaatagaagtgggagaggctgtcaaagggagacaactaaatgcaacttgcaagatatgcatatgtagacaaacacacaagacatgcgcatacacacatgaacacatacacacacgctttttccatatttctttgtgtgaaaaaacagtattcactatcctccaaccaaaaacaacagagaagtcattgttatagactttgacaaaaatgtaaggaaacatggagaaaactgcaaaacaatatctaggagataattctcaatgttaacattcccatattctttcccaggataaaaaccctagaatgtctctcacacaattttagaagaagttaaagtttcaaaatgtacataaggagacagggcacggtggctcacacttgtaatcccagcactttgggaggccgaggtgagagaatcatttaagcctaggagttcaagaccagcctaggcaacagagcaagaccctttttctactaaaacttaaaaagttagctgggtgtgctagcacatgtctgtagtccatgttccttgggaggctcaggcaggaggattgcttaagcccaggagttcgaggttgcagtgaactattatcacaccactgcactccagtctgggtgacggagtgagactttgtctcttgaaaaaaataattattattattattatacacacacacatgcacacacacaaaaggaaatatggaaactgtgaagaaccaacctcctttaagcctccacaaaatacggatgtaaagaatactacgtttttttaaaataattttagggagaaaaaggagagagtgctaataagctgcttacaattgaagttccactattttcgctgatctttaacattatagagggctggagggattggtattttatggctttgtcttaaaattctcagcaatgttttgttttcttttaaaagcctgaagattataaacagacataagagcaagcccactatttaggaatttttaattgcccattttgctcattacacatatttatttaggttaaaaccagtaatatggtggctctaagtccgtttgtattagttttagcatgctcacagactcctgtgtctatacaaagatggaggatttcgtgacatggcttccatggatggcagggaggaataggggcatccaacagttggcctggtctttctctctcccaaatgggtaaagggacttttccttccttgctgctaattttagtgatgaagcagatcattggatgatccagttatctgtatgacatagtcacagcatcctctcctttatcccagttgctgatgtgcaccctatgtgtggatatcacaaactttgaacacatcacaggatcagaatcagtctgtgttgcttagactgttagcttgcactttcaatttaatggactccttggctgaaatagtttatttgcacaagaaagactaaactctcaagcaactataatgatatgatacctcagaatgattttttaaaaattatttcagatgcacaaaataggctatttgatgtaaatagccagaaatactcagggatattagttataattgattattcttttctgtcattaaacttaactcagcagtatatcttttaagattaggaatctttaattctcaattttaaaaaatcatattataaaataaagactcccatttgctattttaaagacgtatttaaatattgttcttttcaggcttatagcctattcacccaatggctgccctgcatgaaatctagtccctgttgaaatctggtttttatgacctgagtgacaactttctggttttagtccatggaggacacatactcctgctttgacaaatttgcttagtacatctgatattaatacatgtgtattctcacaaacaattgattttgaaaatgtttgtaaatacaagggtattgtgtgttttattaaagcttggagctgacaagtgtaaccattattatctttagtttctgcaccattagtttcaaaattctcacctgtcatctttgcctgacttaagaagcagcagcacatgctgatgaaatccagccggcttgaaaccagagatccacagaagcatgaatgtcaggggcagtaaagcatggtttctggcacagccggggtcttttgtaacgctgtgtgaaaagcaaacacatgatttagccaaatgatttttccgtgctatctttggcatggcaaggagttgacagatggaaatgtaaccacaccgtgttttggtaggagagcatggagctggtgtacaataagtccaagcctgtcgctgttaccggaatggctttcccaacgggagacgtcaataacttcgtggttggcagtgaggaaggtacagtctacacggcttgtcgtcatggaaggtgatttttctgtttctttactgatgacatgttcttcatttccgaaagtctgttatcacattctggattttaaccaccttgcattatgagaaagcatctctggaaaaatggaaagcacgacttcaactcttcattatcttaaagagctgcatctgctctggtcattagctgttcataagactgtggtggttcacactgccttgagggaaaaaagctcgagcttctgagcctatcataacagaccacttgcaccttcccagcatctccgcataccttcagggtctagccatgtgcccatcagagataacaatccccaaatatttcttatccctccatgcctcaatgagtttgcatactcaacttcttttaccagttctagcatttctccctttttggcctggttaattcctcctcatcattcaagagccagcacagagatcattccatgtgaaacattttctgactcttgggcaaagaaaaccactcccacctttaagtcccatagaattttcaattctcttattcattcactcttccaaggaatatttactaagaacctaccatgtgccaggcatcatcaaaaggatacattaaagaacaagacagacctagagttcatattctagttgagggtaaaatactaataagcaaataaatatatagtttaggatggtaagtgcaatggagaaaattaaagtagaataagtgggataggactataggctgtcaagttgacaatttcatatattttccttatgcttctataatagcattaatcgtattttagtttattcattcatctgccatttttctcttactacattatttccatttcatctttgatttcctgcacagtacctaggacatagtaagtgaggagctaaaaatatatattggggataaagaaatgatatataatgtaatccatccaatctaaagaagtgccttaaaagctttcctcccagtcagatgggtcagaacagagtgagtcacacaaaccaccatgcagttcccaggtgataagaactctaccttaactgagagattcacaatgcccctggaaaagagttgtcagtataaagtggaatccaatagtttggactagattgtaaaattgcatgcaaaacttaacaggtggcctcatgtcttttgaaagggtcactatgttcacactggtgcttaatttgtcttttactttagtagttcttattccattgattttttttcatctcttgcactcatccgaggctattaagatttaatgaagaaccacaaattgttccaagttcatatccctgtgtttttgtgatttgtagaaatgacaagcatccatggctcagctatgtgactttttccattcaaactatacaagctgttatgttcctgctgttctgcacgtagaaacaagcagtatttgtcccctcacatgattcaaagatgacttaggaagatatgcctcacagtccattcccaatgatcctccttcataaaccctggctaaaaccacacattaaagctttatcaaagcataaaaatatttgataaagttattcattcataaatatatttgttgtatgcctactttgagcaaagtgcattgttaggttctgcaaggcctgcagacgtcatgtaaacctggtttctctcttcaaaataactgatgacggtgagaaagataaatacacaaatatctggaacatgagtagaatgtcttaagtggcatgagaggcatagagagtatagtaggccagacctggagtcacagctttatctatatgcgtattagaatcaacatggcataggttcagttaacttaacccatggttttacctaggtccttgattatctacgaaggctatagaatacattcattgataatttccagatttttttcattgctataaagtgaataacattttacatgatgaacattcttgttctgtggctactgtactttctaagcactatcagaatatgcactttggttcaaaagaagggtccctatggcacacaccacaaatctttttacaacaagctgaattttgctttacattggtccatccatctgaaatataaaatacagaccttagtaacattgtaacgtagcaggcattggctttgtagtcattctaaatgggtcatataggtctatgggggagaagcaggggattgctatttttcacctaacatagagaaggtgcaaatccacttccataaattaaacaaggtcctcattttgcaccctataaatcctttcaggatgctgttaagagcaagtggagtctcaccaggggccacttcaaagatcagttcctcgggttcattagaacaaatttaaatgatcatgtgtggaactgctcttagcagtttcactgggcataatttttgagtgcctgttacatggaacacgcactgccacactttgctcatgattccaaattttgctaagcacattgacatttattggtgctccagaggcccaaatgttttaataactgagctcgtttttattcttagtgacataatattaggattctacaattcctacatatttgtcatatttataacctcatgcacatgaatattttaaatatagcatttttggtatgttttctcacatcttcctaattgtatatgattgcatgcagaatactatgtgataatagagggctgcaaataataacagcttagttaaataagcaagatatgtctgtgtgtaattttttaaatgtctatcattatttctcaaatgtgcttctgttttaaaaaaggactgagacataagtttgtctctttttcttagctagtttattcaacaaatatttattgagcacttactatatgccagacacttggcaacaagaaagacaagatacttgcccgtatgggatttacagtggatatgtaaatctgtcttctgttttcagtaaagagaaaacattattttctccatattatatttaaattatgtgcattattttgtggtgacaagggtttccacaaagtgttacattttcagctatgttaaagtaatttaagaaatttacttgaaaaaaataaatgattgttccttcaaggatggatggagttttatagtcaataggttccccaaaaggagataaagcagaccatgtgcaaaatgctatctcaagaataaaatagtcttataaatataaaagcttcagagacctaagtgtatttgtttccattaaaatagctgcatcagcaatgataggctttgaggaattctgcaaaaagaattaaataataaatattgatattaaattctgtattttaaaaagatttcattgccctacattgtttttaaataatgaaaaatagggtaacatatttgcaaacaatttctttcaggataactgtaaaaatgatttcattttggtggtgtgtggttgttctaaattatggagatgcagagttgagggttttttgttttgttttgtttttaagcaatcattgcttttcagaggtcactggaattctgctcatgtgtgctcttcctacagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaaggtaagaatatcttgactgaaattctcagataatacataagggcagaggatggtttttcattccctggaaacagttgtccctaaagcctcttccaggcaacctggcattgggaattcatataccttctggtgagctcagtctacctcagagctagttaagtccattttatttacttttacacatataggtaatacttgaaaatattctaactataaaaaattcaaacaattcaaataatgataaagctgcagtcctcctctacctaccccaaccccaaccccatccacaacacccccttcactgcctgcacctcagtcccctccccaggggtaaacttttatcagtttcatgtctatgttctggagcttggtggtatctacttacttacatatgtacctatggaaatatatgatttgggacttgggtttttttttgtttggttcgttgattggttgtttatttttattttgagctattggaagtttttaagctggtaaatggccctatgttatgtttttaaaggtaattctggctgggagctgtggctcacatctgtaatcccagcactttgggaggccgaggtgggtggatcgcttgaggtcaggagtttgagaccagcctggccaacatggtgaagccccatttctactaaaaatagaaaaattagctacatatggtggtacatgcctgtagtcccagctactctcgaggctgaggcaggagaatcacttgaacctgtcaggcagaggttgcagtgagccgagattgggccactgcattccagcctgggtgacagagccagactccatctcaaaattaaaataaaataaaataaaataaaatagtaaaataaaatataattctctccatgcttgagagcaagaagaaaagctgagaccacttggaaggaaggcacaataatctaggaaagaaatgacagtgacttaaaccagtagtctgagatggagagaaataaatgcatttgagaaccatttaagagataaaagccacagaaactggtgattgatttgatagaaggaaggtaggagagggagtcatcagcagataacccaggtttaagacctgggcagctggtgagtgtagcactcactgcactggagaacagcaggggaaggacatgctggggcagagctttgcatatgttgagctaaaggtgcccgggagaggcatttcaagatctccattaagcagtttgatatgtgagtcagaagaagagagagccctccaaacagaacgtatgcactagaatagcagtgatcttcacaaatgagtagttttttttttttttcttttttttgaaacatagtctcgctctgtcacccaggctggagtgcaatggcactatcttggctcacggcagcctctgcctcccaggtgcaagtgattctcctgcctcaacctccctagcagctgggattccacagcacacaccaccatgcccacctaatttttgtatttttagtagagatggggtttcgcatgttggccaggctggtcttgaactcccaacctcaaatgatctgcccgccttgtcctgccaaagtgctgggattacaggcatgagccaccacacctggcccagcagtggattttaaaagaaacactaacatgcaatctggagggagagcaatacttaggaaataaatagaaattgaactagaaaagggagatgaaaaagtaacccaggaaatagaagacaaattagaattttctttgcagcttcatgggtattaatggaaaaaaccatgttaagaggacagaatttgcttttaactatatgaaaagataacaacctcatttataagagaaattaaaattaaaaccaagttgagaaacatatttccaactatcagattgacaaaaatctaagttttgcaacatactctgtgatgaggccgaaagaaaccagctgttctcatacatttccattggaaatgcaaaatggctcaacactgtggaagaggatttagcaatatctaaaaataatacatgttttaacagaacaatttccacttctaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatgttctattatggagtgatccctaagatacatttttaaatgagtaaagcaaagtggagagaagtgcaaatagtatattatcattgtttataattatataattagaagttgaaaggataaacaaaaaagttacttatagcaagacaggaagctaaaagaaaaaaataatagctagacttctttgaatataccttatttttacatttgattttggaaccatgtaaatattttacatagttataaaagaaaatgaaataaatttaaaaattgattcctaaaaaatttaaagtaacatgaatcaactttaatgtggttcaaattggtagcaaaatcttacatgaaagaatgatttgaagtgactttaaaactctgtatgtttggtatacattcctaaagggatatattttaaggatttttttaaactaccaaaaaaaatctaaaatctaaactacttctagtactcatattgctggttgtcatattgctactgctatcctgaggccattgtatttatatcataacataagttaaattactatgttggtgtcattgagaactgagattatcagcttggttgaaaggagatacagatgcatgcagttaagtaacaattctgtagtaatcctgaatctgagtgggaagtatactaagaactcatggtgtgtattatctttcaatacaaaagaatacatattcactgctctgttcaccaaaaagacctgggaacggtgaccaattcaatagcaatgacattcctgatgcccagaatgtgctccccaaatacagcttccactcaaggaaaccagggatcccagaagaaattactgattctaagcgcggagcaggaaatttataaaataaactgagattattttattataacaagcaaagatgctaccaaacactacaaagtttttgtcaaaggacttggaaaccaagttgagtaagcttctgttggcccagacaacatcaataagagtaatagattcatgagttcctaacaatactgaagaaaacaaacaaataaaaaacctctttggccacctatggagaatactaggtaaacaaactcattattttgaaaaccagtgagtaaatgaaagaataaaacatgtagtctgtcttttctatatgaattgtatttcagggttactaaatcattgatgaggggactttttctttacagaattccagctaatataggaataaaaaatgggccggggactgtggctcacacctgtgatcccagcactttgggaggctgaggcgggtggatcacgaggtcagaagatcgagaccatcctgcccaacatagtgaatgcttatctttactaaaaatacaaaaattagctgggcgtggtggggtctgcctataatctcagctgctagggaggctcgggaggctgagtcaggagaatcacttgaaccagggattcagaggttgtagtgaaccgagatcgtgccactgcactccaacctggtgacagagtgagactccatctcaaaaaaaaaaaaaaaagaaagaaagaaagaaagaaatgacagaatttgaaaatcaccattttgcaaacaccataatctaggcaatgattattgctgataatattgtaaaaatagaaacaacctttttcataattacagaatacacaataccacctttgaagtaggcttacactcaaaattgaatctgaatcttatcaatcctccagatctctgaatttagaagatacagatgcaaaacattaaataacaccacagggatgcaatcaaccaaacccagaccgctggcatatctacgggacacctgatttagtttctgcaacaaaaccaaaaatttttcctcaagggcaaattggaagtggaaacaatgtattaaaaaaaaaaaaacagaacaaaacaaaacttgggacatttcagtggatcttaaaatatggatcttacatagatcttgattcaaacaagcaaccaggtgaaaaactttacaaggctaccagggaaatgcaaatactaactgtatatttgatgatattcatgcagtactatttttagtaattttttttttttgaaatgtagtctctctctgttgaccacactagagtgcagtggcaccatctcggctcactgcaacctccaccttccagttcaagcaattctcctgccttagccttccgagcagctgggattacaggtgcccgccactacaactggctaatttttgtatttttagtagagatggggtttcaccatgttggccaggctggtctcgaactcctgacctcgtgatccacccgcctcagcctcccaaagtgctgggattacaggtgtgaggcactgtgtctggccaataattgttatgatcactttaaatggtgttaccttttagggatgcatattgaaatacagaacaaattatatgatattagggatttgcttcaaaataagcagttgggaatgggagagcttgtgaatgtaggtgactaacattggtcatgattgctaattattgaagctggatgattgatattagtctctctatctctgaatatgtttaaaattttctataataaagaacctttaaaaggcagaaaaagcaattagtaataatggctaatacttcagagaagaaacatcaggacgggaatatgtccattgtatttagcaactcagaagccactagtgtccatggcaaaagcagtgtctttggagtttgttgagggtgggacaaaaaattacaatacgttaaagaatgagtggaaagcaagaaagcattaaaatcaagatgttttctttcctttttttttttcttcttgagattagagagagctcaaggatgttgctgctgtggaagagcctgtgaaggagagtagaaaatctgtaagtgtaaggtagagaaagggccgtgaaaatgttgccacaaatgaattcatagcatggacagggaagtgaattttaaatctgagcagcaacatctcttctgttgtaacagaagagcaggtaaggatgggatcatgtgtgtgtccgtgtgtagagttagtgaaggaaagcagagcaaactctcctgtgatggctattttcttaatgctgtagggggttaaatactctgctgagtgggaagtggagctactgaagggagcagatttcagctgatcacagaggagaataggaagagctgattagggaatgaaagatggactgtggtcagtgtggtgggtccagttgcggtcagaaaccagaatgttttagcagcttcaatcttcaggactgatttcctccaagaaagggcagcagtggaaatatgggaatgaatgaagggcaaagttagatggatgtgggcaggagccttaccagagtgtgatggaggggcaatagagcaaggaattgggagatatggacaagaaagcttctgatgttataggctaaggatgctaagctggagcagaaaggaaataaaaacagacaggagaaagtaaagagagcaaaggattggatgcccctataagatcaaagaacaaggatgaaggaagtaattgaataagagaattagtaacataagatattactgttagaaagtgagatgtttggatttagtatttcacaactgaaatcattccaagtgatttttttaaaaagtcaaggatgtggtcatgtgtatagctgaagtctagtgagggtggaattcactgcaaatgaggacgtcacaaaaggtcaaggtgctggtgtgttgtgggctttggagtgggccagaaaatagctagactgggatggaaaaggaaacagcgatcacagtaccaaagtcctcagtgaattaggaggagacatcaaaagaggtagagaatgatacagccagatggcctgagcttaaaagaaataggactttttactggaggcctaagaagcggtaaaatagccctgaagagcaagtgagaagctgaccctctcactatcttgaaatagaatacatgataatgaacagcttctacatgaggaaatggcagaagaggtggtgaggttagggcagagctaggattccactgaggcaggcaggagaagtagcttcccatgagaaggctgaggttggaggcaaaggcatgtatcatggaataagagatgtggggcaggggaactgtaggaacatcgggaaagaagagtgcagtgagtgatttgttccggtgaaataagtactaatagagatttctagaaaatgctctgagaccccactgggaatgggaaggggagacggaataaaaggggccaaggattcagaagaggatgctaatcgttacatattctagcacaatgaggttagcatgaagggagagggaattaaaacacattacattgccctccctctactcccacagcacctcctgccgcaccacgtttcatcattaaccactgtcagggaagaccacattgaagcagaaactttgtcggagtggtttacctggcaaacagagaaccaggctgcattccaggcagctgagtcaacaaatgtccaagcagccattttcatccaaatggctggaaggttgggatccatttagggaatgaggctggaaagataggtctatacttgattgtgttgatttatttttattttctaggtggtgacaagtcattttaggagagaattaatcaaaatttgattttaaggagtttgctttggaatactgtggaagatgaatttgtgtggggagccaagatcaacatttatcgaggtcatactatgtactaggcattgtgctaaatatttgaaatacattagttcattaaatgctcacaataaacctgtgagtagatgttagtatcccattttatataagaggaaataggcacaagagagcgtaaataacttgcctgatgttcttagtgaataagtggggaaactgggattcaaattcagatttgggtgaccccaaagactgtgttcttttccacaccatcgtgttaagcctggagacaagaagcccagttgtaagtctggtttggtcatccaggtgagagccagaatttaggcagtgagcttgtggaggagaacaccaatctgagaaataaaatcaaccagatgcagtgaccagcagacctgatttgagaggggagtcagtgatgattctgatatttctgtcgttagcatctgagtgaagaatggtggtgccagtgactgagacaggacatgcaaggggaggagtgggcttgggttagaggtaggaaatcagtggtctgggcatgcttagactgaggtgtctggaaattcccacaatgtaattgaagatatttgtcttagtccattcagggttctataacaaaacaacttagagtgggtaacttataaacaatagtctttattgctcacagttctggaggctgatatgtccaagatcaaggtgccagtagatttggtgtctggtgagtgctcactgcctcatagatggtgctttcttcttgcatcctcacatggaagaaggggctaacaggctccttgaagcctcttttataaggatactaatcccattcatgagggtggagccctcatgacctaatcatctcctaaagttcccaccttttaatactatcacagtagggatcaagtttcaacatatgaattttggagggacacaaatattcaattgacagcgtaatactgaagctcaggggcaaaggatgagttagaaatatagatatgacagtgatccatcatttattccaaaggtgaacattataatagaacatgaattgaagaggctatgaatgcaatcttggacctgctgatgctgcaggtgctgaggcgtgagaacaggatgctcaataaagaatgtgataaagactgttaaacaccagagatatcaagaaatacacagatggcaaggcaagaagagggtcacgtggacctcagtgagaacacttttagtggagcactggagacagattgtgagtggttgcagagtgaaaagggaagacagtagacacagaaaatatagactagtctttcagacatgaggcagtgaacataaggagatagagaggcgactagcagggaaagccaggccaaggaaggattttattattatactctctgagagacctgagtatatttgcggcctgaagaggagccagtgaaaggtgtatggtttaaaaaatggaggaacagaattcaccgctatataactcatccatgtaacaaaaagcgacttgaactccaaaagctattggaataaaaattaaattaaaagaaaaaaccagaggaagattatttcaagtgaccatgtcaggtttaggatagggagaagaggcaggatattggcaagactaaaaaaaggcttacaagtaagtttagctacatggaagtggagggagaaggaggaaagaagagaaggtcccccatttcttcggtggagtcagaggcagttatctgttaacgatgatgggaactgggatgtggtagggagaggaaggaggattagaccaggtcctgtaagagatgggacagggccctgaactgcatagatttgaggaccagctggggctaaatatcacagatgtatttcataggtgatatctaatttaaattttatgaggtgataagaagagtgccaagaattgtgtaaaattgccattgtggaatctcttacaggaatctcctgaatctgacattcaaagctgtccacagtctgtccccaccattactagagcaggtgaacagatccaggtttgggagatgcaccacttctttacaattcttccaagccagtgttctcaaaatgtggccccagatcagaagcaacagcattacctggggcttattagagatgcaaaccgtctgggccccaccccagaccttctgtgtcaaaaactctggggatgggagccaacaatctgtgttttagaagccttccaagtaatccagatgttgctaaaatataaagagccatgccctaaaccaccgtaaagttctatttcaaacatcccatcctacagagctggtggggcagttcagttacattgagggacccttcctttctcccagggttgtgttagagaactggggatctagtttagggttcagacaggagaatgaaaactattgtcccacctgcaacaaggtttcctcatataatgaatatgctacatgttctggccagaggtttgtacggtgaatgtatttgaaaccccaaattaattctaaccctttatgttgtcctaaacagttacgcttgaaacttgacaatatgggctaatggctttctcctcttcttaatctctatgagcgtaaaatttaaaggaagcaatcacatctcttaaaattactaatcacaggccgggcacagtggctcacgcctgtagtcccagcactttgagaggccgaggcaggcagatcacaaggtcaggagattgagaccatcacggctaacacggtgaaaccccgtctctactaaaaatacaaaaattagctgggcatggtggcgggtgcctgtagtcccagctactcgggaggctgaggcaggagaatggcgtgaacccaggaggcagagcttgcagtgagccaagagtgtgccactgcactccagcctgggtgacagagcaagactccatctcaaaaaaaaaaaaaaaaaaaaaaattactaatcacattttgcaggactatggctgaaaataacctttatcttaataaaagaggcaaagtaaaaaaaatactctcttgaaaatattggaaatggagttttttggcctttttccatcttactgacaatgagaattttcatggaagtgtagcggagacaaagatatgagatgggtaattattgtagtcccttttgacaataatgattaccttcataatctttactttaaacttattgggtaacttggagtcatcttatcatttaaacaaggcaaagaagtttataatagagtcttaataggattagtgatagcctcacacttcagcttgtaaattaaataacataaggaaaaatcctccaaatcgtagaaagaattggtgctaagagacaacactatgaaatagaatgaaatcaaattttttaaaagtctgcaatataatactttgttgataaaatacagtatagtggtggggcacagtggctcacacctgtaatcccagcactttgggaagccgaggtgagcggatcacctgagctcaggagtccgagaccagcctgggcaacatggtgaaaccccgtccctactaacaatacaaaaaattagccacgcatgatggctcatgcctgtagtaccagctactcaggaggctgaggcaggagaattgcttgaacctggagggcacaggttgcagtgagccgctgcactccagactggatgacagagagagactccatctcaaaaaaaacaaacaaacaaaaaaaaaaacagtatagctcaaaaagataaccagaaaagatcaaaagcaaacaattcgacaacaagaaaatttggcaacagaaatatgcattttatacactctactgcccaagaattcacatgtctaacataataataaaatattaaaaaaggaagtctgtattcgagggggaatgtcatgctggaattagcacagtgagcaaaatgaatctcaccctgaagcctatagagaagtccatatgaattcactttgcatagctaaatgattgccagagagacaataacacttcacatactgaaagagagaagtgatgattttaaagatccaaatttaaaatgaaacttctctacatgggatcttagaaatactgtagttaaatgaaaaagcatatttagagaaaatgcaatcattgtcaattctctttgtgatttgaatagttaatatttccattaattttatagggttttatttaaactttccatgaggattgaacaggttgagtttttgaagtgggacaaacatgatattacatattttgggggtgctaagttcctaaacaataccctttcccattcggtttatcttgtgcctttttctaccaaactgcagtttcaccctctacagcctgtatttatccccatgattgccactagacctgcttcttcaaaagttgccctgacctgctttcttgcctgttccaggggtcatttttatcattttccttttctttgatgactttgctgctttaataatgttgattagtcccttggaacatccttttttcaatgaggctgcttttagaggatagtaaaaaaactacatattttagtctgtccattatgatcctttaaaaaaaagtactaaaaatgcattgcctgaataaattctgttgagtaccaactcttaccttttactgtatcttagcacattaaatttcctgtccatcaaaacatgctggagctgatgctcagaaataaagtatgtactcttggctggattaagacattcattattccactcagcttgtctgtttgctgaggttttggataattttttttcctgtgctgcagtttagtttagtggctagacaagttctgagtctttggatttttttattaatgcatccagtttggaaagtttcagtggattccagttaaattttgggttaatatttattttggtcctggtacaacttcagggggatttaggttcatgatactgttcatgtatttgccaggtcagtccctttctttagacttcaatgggcttatgtttcttctatttgtattaaatctatcttctaaatcctttctgctctcaacttttgggtcttaaaattcaattccattatgtcgactgatcaggtatatggcctaacttaacccatgtgtttgtatttggtgtggattttggacaccaccctggggtgctgtcatccaagaacctttcgtgatacacatttgattgatggaaatcactgacttcccctgaatatatcttgacattgtagacattgtacaatctttcctagcagttaacatgcatctcaatcctctaatcttttaacagtgactctgctctgagaataaaattttctaagtgactggagaattatgactttgcacaaattagaaagataatctttaattttcaagcaactactgtgaaatcaataaatattacctatttcacttttacatcctctgatggggttaaaatataagatggctgtcttagctgattgttttccctgttagctactagaaaagaataatttgaattttatgaataaaagagacaagaaacattttttcctgaggaagaacatttgttattcctttttaaatatcttcatttaaatgattatgtattacaataaatgttaagtatgggtatattataaataatacaatgattaaaaaatttatctcttgaatcacagtgagtatgcaactgggacagaattgccatcctttccctgtaagactgtgagctccttgagagtaagtccctgtgttttttgtctgtatcccattacctggcatagtgcttgggacctggtaggcactgagtaaatcactgaattaatacatgaataaataaatgctggtttttaaaaagatgtacattgaaagcatactatagcaaatatttagttagcagtagttttgagcagtaaaattcatagccataatttagaaatataataattagaaactgaggttaagctttaaaaatcctactaggaaatatttaagaaaccataacattgaaaaaagaaagcagaagtttgaaggaaatttagttaggtaaagggagaaaggaaagggcattcaagcagaatgaacagagtatggaaaaacacagacacatgagatagttagtactctctagctgtgtgaacctagaaaagttacttaacctctctgtgctgcagtttagtcatctctaaaatggggattaaaatacctcctatttcatgaagttcttgtgaagattaaatgagtgaatagttgtaaagatgttaaaaccatgctaagtatagggtaagaatattaaagatgtagcaatagtaataattaccactattactgttgaatattatggtaattgttgctgttgttatttggatgctaaagtgctttagtaaggctggagcagtgggtacaaggtgactggaacagaataatgaaaggacagctctcgggacaaaatgggatcagatgacaaaaggcaaaaaggcagccttgtgatgccatgcgatggagtgtagactttcttctgaagatgacaaaggtgacagcttatgtgaaagtagggccacatcacctcttgcctgatgtcatgtagactgaaggtgggcagtaaggacatcttaccttctcctcagtattttgaacaacagtgatagtgtaatgtcctacctctgatgactgctctatcaaattaccagcagtatttatgttccagagtaacccctggatacatcacatgcatccctcctatctccacagtagttgattggattatgaatgcacactctcacaattccacctcataaaatgatagcgacttcattgactggagtatttacttttgcaatccttcatgaggctgccccgcccaattcactacatctaagttttcagacgaagccaattatgattacaatagtcataataataattgtagctgcatttaactgaataatcacatgtgactggcattatgccactgatgtcacataattttaagtgtatttctgtaaatacattgccacacgacctcatctggaatggatcactgcagaattatctcatctggcctttctgctagctttatgtttactggcttctatattttatcttcagtttggcttttctttttatcaacttataattgtttttaaatttggggggccaaatatatattcccttcctcatccttcttggttccaacaaactcctgtcactagcacttctaatcctcacccaaaaccccattagtcttttcacacctgctctccaaagtcctgacttcttgaaagggatttaaaagtggcaagacaaaaagacagaggtactttcatttgtcttagatctcaggaaagtatgtgtaggcatatctaggtatattttaatatttcttttatgatatctatgtatttctttaacttgtttcacaatttagtgcatacttacacttttttttagaataggatattgctttgttcatctttatcccgtgtctcacatatgttagtttcctagtattacacacaatgtggcatgagtagaatttgcccattaaaaataattactactttatcaacatgggacaaaaaatattggaagattattctcattcttctggtactttgtaaagaatagatataataagaattttgtagtggaaaaatataattaattttttaagctttctttttttattatacttctgggatacatgtgcagaatatgcaggtttgttacataggtgccataggtttgttatatacacgtgccatggtggtttgctgcacccatcaacccgtcatctacattagatatttctcctaatgctatccctcccctagcccctcaccccgcaacaggccctggtgtgtgatgttcccctttctgtgtccatatgttctcattgttcaacttccacttatgagtgagaacatgcggtgttcggttttctgttcctatgttagtttgctgagaatgatggtttccagcttcatccatgtccctgcaaagggcaggaactcatcctgttttatggctgcatagtattccatggtgtatatgtgccacattttctttatacagtctatcgttgatgggcatttgggttggttccaagtctttgctattgtgaacgatgctgcaataaacatacatgtgcatgtgtcttatagtagaatgatttataatcctttgggtgtatacccagtaatgggattgctgggtcaaatgatatttctggttctagatccttgaggaattgccgcactgtcttccacaatggttgaactaatttacactcccaccaacaatgtaaaagcattcttatttctccacttcctctccagcatctgttgtttcctgactttttaatgatctccattctaactgacagtgaggttttgatttgcatttctctaatgaccagtgatggtgagctttttttcatgtttgttggccacataaatgtcttcttttgagaagtgtctgttcatatcctttgcccactttttgatggggttgtttttttcttgtaaaattgtttaagttccttgtagattctggatattagccctttgtcagatgcatagattgcaaaacttttctcccattctgtaggctgcctgttcactctgatgatagtttctttggctgtgcagaagttctttagttgtattagatctcatttgtcaattttggcttttgttgccattgcttttggtgttttagtcatgaagcctttgcccatgcctgtgtcctgaatggtattgcctaggttttcctctagggtttttatggttttaggtcttacgtttaaatctttaatccatcttgagtggatttctgtataaggtgtaaggaatgggtctaatttcagttttttgcatatggctagctagttttcccaactccatttattaaatatggacacagggaggggaacatcacacactggggtctgtcgggggcttgggggttagaggagggagagcattaggagaaatacctaatgtagatgatgggttggtgggtgcagcaaacaaccatggcatgggtatacctatgtaacaaacctgcatgttctgcatatgtattccagaacttaaagtataataaaaaagaatagttttcaaaaaataattatatttatttttccactgcaaaattcttattatagttattctttacaaagtaccagaagaatgagaataatcttccaatatgttttgtcccatgttgataataaagtagtaattacttctaatgggcaaatcctactcattccatattgtgtgtaatactagcaaactaacatatttagactcaggataaagatgaacaaagcaatatcctattctaaaaaaaaacagtgtaattatgcactaaattgtgaaacaaggtaaagaaatacatagatgttgtaaaagaaatattgaaatatactaagaaaaaaactcttctttttctttccagagtgaagtaactggccctcccataaattctagggaaccaggcctcagtgtttattactggaaatgcaccagctttgtggaagtttctggaaaggaatgttgtggaattggtgattaagtggaatagctttctcttctgtcccctggttcattgacttgatctaagcccaaggcaaaagtaagaggaggtctcttataatctgtcagcttccttctcacttaggaccttccttaaggattaaaaacttaacttttaaaccagagttcctctttacctctctgccagacccaactacattaagggatttgacgggtcaccaatccaggagggttatgcatgagacacttggcttccacccacctatggaatttaatttatgcctggttggtttgattttttttttccctcaatcaccctcctttaacaaaggccagtcaatgagctgagttttgctgtcttctgctattaggaccattttcttaaggtagcaatccatagaccatcacaatgaagtgtgtttgtgtctatgagtgtgtacctgtgtgtgacattctttcttttctttacagtattttatgtttagcttgatctgtaataaattaaagtggtcatgcttttctctaaggatgacctcctccagctccactcaagaaagtctatttattgggaaaatagttccttaacagcagagaaagactatatcttctttatcaagtttgtgacaaaattattaccagtttctctgaggtaggtctctccccatgctcattcttcctacataatccttttagataatctacccaaaatatacttttcattatgccatttccttatactacaacatacagtagtgtttgtattctgtggaactctaacaggcatttctcaaaggcaagagttccatgatttactctctctatatatatctatatctatatatagtatatgcatatagcatatgcaaatgtatatttactatatatatagtgtgtatatatatatgcagaaagttaaagtcaacaagcatctgtagtaagaaggtcttttttaatttattcttcacgaatgagctgcatatatggcatgtgaagtttatcagagtgacctaaatacgggattggtttttaaccaagcataccaaagaatagtagtcctgaaaaacataactctggaaactaactgataattgcattacttgctttcttaatcatttcaaacacctccacctgcatttcatggttcttcacacttttagacaggtgtctaaccattagtctcataaactaggcacataaatgtccaggggcaggtaaagttactggagaagtgtgtggtgctcctgggtgtaggaactccagggagaattaaagaacttgttaaacaaggtggccttaatttgaaccccttaaagtttctgggttttgactggaactggagagatcagaagttgaggagaatgaggaaagtattggaacttttggaaatgggtgtgctcagtctgtgcgagtcagagtccttgaaactgggccttttctacgtctgagtcctaatgaagattccagttttcacagtagaagttaaagaaaaaaaatgtctagaaaggagtgatttagagatctttctaggcccatatttttcccatcttatgttaattgtaattgggtcagttagaatttggtctgttaaataaaatggtttaatattttgaactgtccacctattcttacataccatttagtagtggactcagatgcctaaattatctaccaggttttttctggctcaataatgcaacactcctatagtcagaaaacaattattgtaataattttaatcaatgccagaaaatttaatacctgaatatgatgtaaatgttttttattgcatttatgtgttagttgcttccctcttttccactgagctgtagcttcttaaggtcagtgatcatattttacatctattctatactctccatagctctcagtcagggtactaaatgattaatgtgtcatataggctgattgtcttattgaccaattacatatcaattaaattaagttgccagcagtcatatttctggcaacaattataggacaggataatctctgaggttttatatgtattgtgaatttatttccatcctcatttggacaccctagtgactgaaacacaactgacccccatggacctacaaagacacctcagtccattccttattgatgtctctgactactccattctccatttatcacctttttttcactccattgatctttcctcttctgtccaatcaaatgtacaatgtttacataccaaccaacatgttatcattgcaaaacatgcaagaataacagcacaaatataattgacattctaccatgaagtaagggcaaatattgtcttctctatcctcgtagtcaaaagaatactagatttgttagattttatcaattatttattcattaaaccagcattcatggagaacgtaatgtgtttttaaattcatgctttgtgtttttaactttgataagaatagaaacgtgacacgatctctggtgccaacaggttcatagcctacatcttactactcaaacttgtgtaatcaatagaacttctttaaaaagagatgttttgtccacctttagtattgcctgaagttagtttcatgtaacttaaatacatctagacaaagaacaagttatacattccttatacttattcattcaatacatgaccatttattgagagcttactatagttcagttactgggagtatcacagtgacaagggcagacaaaacccccccgacttcacaaactgtttattctggtgggaagaaacagtgtggaaaccaaagaaacaaatatagttaattatgtttttttgagacggagtctcactctgtcgcccagtttggagtgcagcagtgcgatctcagctcactgcaacctccacctcctgggttcaagcgattctcctgcctcagcctcctgaggcaggaaattacaggcatgtgctaccatgcctggctaatttttttttttttttttttttttggtggagacagggtttcaccatgttggccaggctggtctggaacccctgacctcaggtgatccaccagcctcggcctctcaaagtgctaggattacaggagtgagccaccgcacctggccagttaattcttgttatgtacaacagttgtattctataaagttgccacaaatgccaaactgacaaatactaaatgaaccattgcttctgagggagatactggatttgattcctacgaccttctggttacaacattttcatcagcctatgaatacattatcttattgtatgtgtgtttctgtttaaagacacttgatttaatgtgtattgttggttcattgacattggatccttagccaatagctcatgcctgaaggatgcttgtttaacacatgtatttttccagtagggcacatcacagccttctggcacttaggaacactagacagcacttcagcactatgcttggggccattccaaacagtgaaatcgaaaaaaaaaaatgcaaaaaccatggcaccaaataggcaacaaaaaaaagatatttgtttacaatatgagagctgaaacaagaaaggagtgtagtcttattctgtctgagctgggaacaggtacatcaggggactcaaattttttgccactctttgcttattcatgaatgatctaggaatatttattttggggttacaagtaaatttcagaaagtaagagaatttgcaaccatggaatccataaaaaatgaggactgatttcatataataaatattcagataggaatgaatgttgcaaaaaaaaatgaaacagatctggagagtgatgggggtttggaagaactgtttgagctgggtgactaggacagtctgccctgaggaggggacactttaatagatacgaatcttcaaaagtagttagccctgtgaagatggaggacagagggagcaagtgttaaagtctgtgaatcaggagcaagcttgacttggtttgtgtgaggaacaggacagaggtcttcatgcctgcaacaacaacaacaaaaaactgaaccgacagaagatgagcttgaaaagctaatcagtggtcagataatgtatggtctttttggcctactaagtggcttagactctgttctaaagggtaatgagaagccactgagggttttaaaatatatttgagctatagcttattagataattttacagccttcccccaaagtttacaaatcaaatttacccccaaacaataaccatttaagtgaatcacattaacttaatgtgacaagtggatgcttcactgaaactaaagttctattcacagtatgactatcgggctgacttccctggtgcaggttcttcccagttcagccaccttcgtgaccctgtgtgggtgatggctccaagaaccaccctcctgtggcacaaatccatcattacatattcatggttcctggatgtggtctcttcccccaagtctctcacgactgtagcaaagacactccagcaggcctgaagtccgacatacatggttataaggcagcagcaagcaggtgatccctagcatgctttttgactctcatctaaaggaaaacataaaataaatgtttccattagagaactcatagataccccacaatccctcaagaaggaaacccacagccctgcaaattgtttgaaaaccttgctctcacagaggattattagggcagtgaaagtattctgtatgatgctataatggtggatatatgtcatgataaatatgtccaaacccatagaatgtaccataccaagtgtgaaccctgatgtgaactatggagtgtggatgacaatgatgtgtcagtgtggatccatcagttgtaacaaatgcaccactctggtaggggatatttacaatgggagaggctgtgcatgtgttggggaaaggagcatatgggaaatctctgtatactttctatttaattttgctggaacctaaaactgctctaaaaaataaagtctaaaaaaaaaaacccttgctctacatgcaaaactcaatgacgcttcagtaatgaaggaagagtgtatttaaatactataacagcgtaaggcagacacaaaggcagccccaaaatggaacaccgaaaaagaagtcagaaaacaatggctgaggctggagaaaatgagacatctccctgtgttctgtcagtgtttgagaggggattgtggggtgagggaggactttatctggatggcaagatcagaccctttgcgaggagagagaatagtacattctctaagagcagaaagcagtgtgaacaaaggcttggagaccagaatgcgttcagtgtgtggaggagatggtgaatgcagccgactggctggaacagagggttttaattaaggagcgaaggggaaaacacacttggaacgcctggtcctgccatttcagcacgaatctgcccagtgggatcagatggtggtattcatagccctggactgtcttgtcaaagtgttggctgtggaatctgtagcatggaggtactttctcaatgtagctatttgtactgagcctgtcactagctcgggaagaggtaaaaattacttgacagtgtctctggactctcacccatccaaagcgtaagagaggatggggagtgtcagagtgggtgggcattggggaaagtgagttcttaagaactggagctttcagtgaaagagaataaagggcattaggaggcttacctagagttgggcggcagtcatgccaggcaagcaggcccccacagtggaatctccgaaccctcccacttcccaatagtgagccgttcacccccagagtgcttgatttggtatggaaaaagagtctctctctctcttcctctctctctctccctccctccctccctctctctctctctctctcacacacacacacacacacacacgcacacaaacacacacacacacacactccaatttatcaaaaatcactttggaatttaaaatctcagctaatgacctttctcagaataaaaaagtcacattttcgtcaagttctatgggttccctattaaattgcaaatgtggaccatttggcatatgcagttcacccatttaaacccatttgactttgtaaggcggggtgataacattttggatttcatttttgtttgtcctataagagtcttgagttttagccaaaaacccaggccttggatgaatgtgctttagacctcactttttgtcacaaggccaagtggacttgagagagagggtggagcggtctgttgaaacatgatttttagttttgcccttcgcctctggagccagggccctggcccacgtccagctgcaggaagagaagatgatggtattttctaggtaattttaaggagcacaaacctaaagtaaagtcaggtggtttcaagtctgcactgaatttttcatgttaaggatttatcatgatttgggttttcagcagagctgtattttaaatgatgaagggagctgtattcctgtattcttccggagacagacatgttttggttgtttgctaatgacctctggttttgcttatggggagttttgttaacaaatggaaatttagcaaaatagaatactttccttcttttgtttttttctttttttttttctctctaaacaatgggaacccttgcagtaaactgtcaaaaccaggctatagatatttgttactgtagcatcattaatactgtgtaaatataagttagtcgcttcggcaatcagacatattcttctgatcttctgtctttgcttttaaacagagcctttgccttgctgtttgatagatcctattgttaagagaactgcagaaatgtattcaaaaattcttcaaaatttttccaacctcaggaacctattcaacagtaattagccttgaaggcagctgattaaggactctcccaactcactccccatctcaccctgtagccaccatttctaaaataaaaagaagtctgcagagggtgacaaaattaaaccaaatgaaactttaaactccggtgcagaagacttctgtctcaggaaaaagtagctgtcttcaaggcagaactgactgactggattgaactgaattataatttctggttcaagctgagttgtgtccctggggtggtttgacctgtttgtattagctttccactctccatccatatttgtcccggtggtatcaggaacatcacagaactatgagtatgacttaaagctaagttgaaaagaggctctgctgtcttcagaaaggggaatatatgtgtatgtgtgtgtgtgtgtgtatatatatgtgtgtgtgtgtgtgtgtgtgtgtatgtgtgtgttttctttcattacaggcagcctgcctctttcaatggaggcgcaatatagctgatggttgagccgtagtcattgattgcaaagggatgtgtttaggaaggagagaaatagctgctcagaaattgccttctttctctctcaaattgcactgttgggggaattacataagtgcagaattgtggggaactgtgcgcatgtgtctgtgcattagaggccaagaggaaaaaaaaagtctgccttctcttctcatttgagaattatgttagtttgttagggctgccataacaaactaccacaacctggtttaaacaacagaaatgcatcctctcatagttctggaggctagaagttcaagatcaaggtgtcatcagggttggtttcctctgaagcctctcgctttgacttgtaggtggctgccttctccctgtgtcttcacatgggcttccctttgtacacgtttgtgtcctaatctcctctttttataagaacaccagtcatactggattacagcccgcccatacaacctcatttaatcttaattatttctttaaagaccttacctccacaaacaacagtctcatattccaaggtactggaattaggacatcaccatatgaatttgatgatggagagagagggtgataattccacccataagagctaaagatatttcattatcacaattgatccttggttatggacaaataaagagttaaccataaggcctttcactaccgccacctcctaatccttatattgaagggctccagtctctccaaggctgaatcccagaggcaacagaaccttgaaggacccatggatgtcgagggaaagcagcgggaacagttgatgcaatgtggttagcgggagaggtggcttggctgatgctgaatgcagagaccgttgatcaccatcttcagaatacatttactgactggtgcagggtatttagttgccctgtggtgctggtttggattcaggcttctttagagtcagtgcttgtttctaagcatcattgttcttctccagaccaaacatatcagaatatttcatggaaagaaatattcatatctctctctctctctctctctctctctctctctctctccctctctcagtgtctctccaattgaaatttgtgtgtttcagggacatactgatgctttaagtcaaaggataagtttatttgtttttaatgagatacaattaatcagacatttaatttccattgctttgtccctgtgatccacaggaaatttgtggctagatttcctactatccaactcactagtggcctacctttcattacgatttttcatatagctttcttgctcagtagcagtttcctgatcttttcccgtggtgttcaaacatgctgaaatctttgccatgactgggcagcaaatgtgaccttcatcagaggttacatctcaaggtaccaaagtgaggggaaaggttctgaaccaaggtaacatgctagaagcacaatagttatcccaaggaggatgccaaatcaaaaatccatttgagagagtagaggtttggtcctggggagtctaggaaagcccaagcccagagcatcagaggaaggctgaaggctctgttcacaggtgtcagacaaaataggactgaactcaaggctgcgttcatcacctaattacagtccatcttatctgccttccatttgccagattgtatgccaagtgcttgagacagaaagcaaagtaagaaatggtccaaaaaatcaaggatggtgtatctaaatggacagtgggtggtcttaaggcaaaaaaaaaaaggcagccctagacacacactcatgtagtagtgttatgatttgcttagatattagtggttgatgattagatgggttcgattaaaatatctcaaacatggcctaaaatttgggttagcttgcaaaccacttgaagaatcagcgtgcacccacatggaccattgccacatttgccaaccaccctcaaccaaccatattaatcttccaacacttctcagtttaagaccatcaacgaattcctaattgctacattcaatggtttcttggtattatccacccctcattcctgcagctctctctagcccagttatgttctcctgctttgtctaggtcctctccactggttctctctcttctactctctcagcccaaatgctcaaaatttcctccatagtcctccttcttctccatcctccccactcttttctttttttctttctttctttttttttttttttttgagacagggtctctctccgtggcttaggctggagttcagtggcataatcatggcttactgcagactctatctccaggattcaattgatcctcccacctcagccttccaaatagctgggactacaggcattcatcaccatgcctggctaaatttttggtttgtttgtttgttttgtacagacagggtttcgccatgttgcccaggctggtctcaaactccttggctcaagcaatttgcccgccttggtctcccaaagcgctgagattacaggcgtgagccaccgcgccgagcatcccggctctttcctctcccacagcacctcgtgtgactgattctttagtgtggacttcaggcccactctctctttcaacttcagacctgcacttccactgtcagcctaacctgagtgtctctaccagagactcaaatgcactgtgtttaaaatacagatcagaccttcctctatttctctattttttctattttctactcatttaatggtattcgtcattcagttgactgcactagaaaagctgaaaacactcttgtgaatgttaaacatctctgaatctgtttagcacatagcacatttatcaatgcacatttaatacattaatagctaattgcagcaaaaagttttaactacatacccaagacttttcataacataccccacttttcccctacccaaaccaaaattattttgttttcattatttcttaggacaaatcctcagagttcactcaggctgtccccacctctcatctttatatccgtctgggaataccatactgacttaaccaggtttttgcatgttttgctctcctcttcttgactgttttccttaccatctgtcaaagtctatgtatctttcaaggcaggttccctcacctgtcctagataataccatccttgaccacatcagactctggtaacaccaacacaccactaccacccccaatcttcaaattcctctggcacctaacatctgtaccacagaatttagcacctggctacatacttgttctctttctttggtataaacaaggcagagagccagtctgttttccagtgatttgcagacatggtaaattcctcccagagtttttcccagaattgtgtctttgagggggaatttatattcttcctttcttcagatggtaaaaacctgggtacctccttgtgatatgatgtgttttcccttttgtcttagttatcaggaaatttagagctgttgcagaaccatattgtaataatcagcttatctcaggatcctggtaatagctatgtattctacctcccttctttagaactctgttgtgtgtttgttcttaattttgcagtatatttaacttgtaagactccataaatccttttagaacaaagtgagaaaacagatccccaaataagcaatattcttctcttattatatcataattttcattctcttacctggattgtttgtgcttgagaacaaaatcagttcctgtatttcttttgattacccaaagaagaaagcatatgttaggtccttaataaatcattgctgaaatatgtgccttgttaaagtaagttggattattttaaattgagacagaaacatctcctaaaatgacatcattctaacaaagggaccttaccgtgttttatttctgctaacggcaggagaaataaacatcttctgatattttgaacattttggtaaatgttcaaaatatcagaaaaaacatgtcataaaaataaaaagttgaagttttagctatcaccggcatctagacataagacttaaaacaggcaagaggattaacaaaatcaatagtttactgccagtaacacttaccagataacagagtgcatttttttcccgcaaccccaaagccctgctggctgcctttctaacaaacacaatgttcaggtggtgtctgacttatttttttttcttcccttatccccattttcattcccctttcctaacataagatggcaaacattaaaattggctttcaatgaaactacctgtgccagtcatcaaattcttttctttctttcctttttttttttttttttatttcttcttaaagctcacccagggagaatactttgactttgaaagaaaccacaagaatgtaatcataaagtcacctccagacttggcctgtgttcatacttcctgtccttttacctccacctctaccctacccacccccaaacattcatacatttatccaccaacacatacctatggctgttaaatatttatgcagacgtgtgaataattcataaaggtacaaacacttttgagacttgaaatttattcagctgactgggcttttccattgtccaacaagtaaggacttggtgaatcctttcttttgctcctttaaccagagtggaaatgttttccttttcattttaatgatatattaaacgagttgccttccccaacctcctcctcctaagtaataatgttgcagagagagcatacacacttagaaagagagagagagaatgagagtaacaaatacgactatctacataattatgagatcaaagatatccccaccccacctttctgctctaacctacattttagtctaatgttggaggataaattaaaactcatctttatccccaaagtagctatttttggaccaaaccaatgtgggtccatcttgaccagcctcctgtgacctcaaccttgcaaattgtccaggacccataattaatactagactattttcccactgccacttccagcatcctgaatcacctcacctcacatttagagcatatttgtttcttgaacagaaattgatttccattcggctttagtgaaacagaataaggtaaacaaatctgctacaaagcaggaagcatattaaatatattttacatttgaacaaaatatgttgaacttctgctatttgtgattctccatgctagttctctccaccattaaaataaatacaagtaatatctgtactcatattaaatataatgtaaaatacataacatttaacaatgggagatgtgggagtgcagagctacataaaaaacctctccttgactctttgaaaatgtgtcttttatatatatggtcaattgttgacgcaagaggtagaattaaacgtttagataattttaccattagattttattagacatgtttgataggataaatctgggcacttgggtatacatttcttgaaaaacataaaatcttctaaatgtcatggttactaaatgtagcgagatcactaatgtgagattagctttggaaactagaaaatgtttacctgagcatgtgagaaataaatatgaagggggaatcaaagtgtaatccatagatctgagtttatatctgatatttttatgcctttctttaagaattgtgtgtatatgtacatatgtatatttaatttatttatatataggtgaaatgggttgttagccagatgttagagtaaaaggttggcagtttaagggcgagggtgaaaatattttgctacttaacttatccactagtaaaatgtggttgcacaatttgacattaaataagtaataaataagcaaaataagtcaagcctgcatattctactttatttgctcattcttctaacttttcaaggcttccaggccctgatacaaccacatatctagctgcctctaggtccagtccatcctcatccctgtacaccctcctaatccttaataccaatgtccaccttttccctccagtctcctaataaagtctctaatcaacctgatcatcgtagatatatagaatgcttctttgtctaaataataccatgttggacatgaaaccactcagccatggtaaaaatagagttggagcaaagcaatcaaaggggggctcttttgaacctgcttgcctcctttactgccacatgatctttcagagagcaagactatcagtccagaatgagaatagcaatcaagagaacagctgcctcaattttgctaatgagccagcttggctgaacctggttttggagacatagtgactctgccctcctcgactcaaataagcaagaagccagaatgtcagtggagccataggcattgaattggctgtaagaggtaattcaaaagagcatccttgcttgcttactgttttcacaatggttctatatagatttgtgctattaaaacgccagttttgaatgagaaccttgggtggagctgatattcatgaaaatcatgccagtgtgggaaacactccttttatgaattaagcaaagcttgtagcttttttccatggctttaaacactcaatactagtcaaaacctgtgaatatgtatacattcttttatatggataattagcttctttattggtggcgcctcttggattaggtggattcttccatgcaaataagcagtagagggaagcagtgcaacaaagaacacctttcatgtggcttcagtacttatttagcaaaacttctacatttatagagaagcaaatgctaaattcctgaacttctataaccttctttcaaattgtttcatattaactaattcaggttaaagtccttgcctaattttggtttatgcacacaaaaaacaaatagaccactatacatagtccattgagaatagttcaccaaaattgtttatgtccaattttgaatttctgaccacgatacacacaggtaaagatatcatttagagatcataagtattgtttgaatattagccacagaagttaagataaatataggatactttgtgcattagaaggatctcaaattaagttgcaaataaagtttcccagtgatagtaccaaattcataacacctcccttgggccaagagagttggttttttggtttggtttggtttggtttgcgagttttggtttacttgtttgtttaagcactttctttttatggtggaagcatccatttttgtgtgagcctgaagttttggggtcctttggtggttttttaaaagcgatattgtggtctcacattttaatgtttcctggaagaactagctagctatttattttaactacttcacaggaacccacatgacaatttttgaaggacattttcttattactcattgtttattattttggtcatcatttttcccaacaggatatagtttttaaggtaagattccatgagttttccttttatttcagaatttataacttagaaattttactgttactttatgccccttttcccaccgacccacatggtaccccctaccacctacccacccaaagatattttcatggtttgggtcatttagagacaaatgcagcctcgagaaccacaacatttttaggtgttaggagacattttaatacaaatcttcctattcaccaaaacactaaatcctattgggatgcctagaggcgtgtgataagagaaaagtaaataatacagaggaaaagaaccattatattctctagatttaactttggcatatatctgacatcagaaatagaaactcacctcttgtgaaatcattttgtttacttgatcaggaaaatctgcaggtctattcattttcagacatatatttataaaactaaagctcaattctagagatcaagtcttattgtaaaacactgatgaatgctgtgagtttcattttttaaacagatttcactacttgcctctcctatgtgaatttaatatttttattccttctctaattgatcaaataagaagtttattattacttccataattttaactttttcattaaaaaccaccctggtgcattttatatgtctgttttcatgaaatatagagtaagaaaaaaatcactgtgatatgaactccacaaaacataaaggaagatggctttaatgataatagttacctttggaaaatatttttacatactttttttccattctatccttaccacagggtaacaaagcacgtaataaagcagttgtagaatcacaaagctaataggagcccttgaggtcagtagctgcagctttccatcgtaagatgcgaaaagtaagatccaaggatgttaagttaaatttcccaaggtctgtagttttccagtttctcccattaccttttctgctccatgctacctttgctattcccatctttcagataatataattatagtccctcacccagagtcatacaaaccttcagtgaactgaaacaggtctttaccttctgacatcatttttttccactctccactgcgtagcctgctgttcatctttactgtctaaaggaccattcctgtactttttctagctttcaggagaaaaagattcctgttcatctcacaaggtgctaaagactcttgcaaatatatagataacatcctcaggatcattaacagactcaggaaatgaaataagcatctgactgcattatttttaaactgtttctacaagttacatagtatgtgcttagtaaatattgatggaattgaatgggagagtaaagaatagaggtaacagatctattgtcttttttaaataaggactgaaggtcattgctatgttttatagaaggaccatatagtcccagcaaatagaggatatgcttaacagctaggaaaacctgagaaccaaatccagctttaccacttaacaacctttgtggccttgggaaagttactaactttcctgaactgtaattttcttttctgtaaataccgtctactttacagagattttatgcggattaaattagacaatgtacatatagagtcaggcacacaacgaacacccaaaaatttaccctcccttgcccttcatgtctgcctgggaggtgaccggtagcccgcttctctgctctgtttgagtcagagtattaaaatcaagctgggctgtgcctggatactttaccattattgtaacagccctggaagcacaaggtgtcacaattttatttcattgacatgtaccacacgtgcagtaggccgtgtaacagtgtagttttcctttttcccttttctttaacagtttgctgatactgaacatgacatagaaaaggaaacacaggtgaaggggtttttttttctagtgaaatttgattgttttgaaaaatgttctttacagtaacttgctgtggaacaatatttcatttactaactggccttgagaattttgtagagtaaatctttaaaatcatgaagcttctgtggctttcatatgtacaaatagtattataagattcattctcacaattattggtcaaatttgcccccatcatctccagccttttcaaaacttgcagtattctaaaatgagtggtaaagcacaagcaagctataacatgtttgtggatccagaaatttatgtctcataaattcaaaatctttagaatctttagaacctcatgcttttaacttctttatgaaaattttaatacttcaaaatatacatgagtttatgatatacatgagtttaccagttctaatactttatgatatacatgagtttaccttaaaatattttatgcatgagacagatttttttaatcaggtcttcagattaccctttgagcctgaataaaatagaataataaaatccctttatcaaaaaacacaactaatattcaaagagcactattgtaagtgacattcgcctgtgcccatatgttatgcttgtgctttgcttggcaattagtggttcacagatgtcaacctacatggtactttgataacaagttcaatcaatcctgatcaagactttcccaacctgtgaatttatcaatgttaaacagagcctttgaaaatataagccttcctcccttctcccaaacacacacgtactgtagcctagaattatttgcacagcaacttttataataaaaggctcagtcttggggtgaagggtgataaggaggttggagaaaggctagagagcaatagcatttcaatcaatactattaaatataagaaactgggttttggtaacatgaacaatagcagttatttccagatacttaaaatgtgaagtctccagaatatactacagttttggttacatttctcagagaagaaactactaaaacaaaaaaggaaataaaacactgaagatttacaggataattaaagaattaatgtatcaaataatatcagttccttagaaaatgactgtttaaagctggatggtcttttaattgatcaaaataaggatttgcaattgtgttacgtgtttagtataggtctgtatgagtctatctgtatgaagacctctataccctcagatatactatcagctgagttgatgaggatcctgacaattgactttttaaagcatatataaacctttaacaccctttgactttgagaaaaatttgttattcgtgttctttaacaaatagtgggctggctagctataaaatcaagaatttgcagtgggaataatcttctactgagagttagaatttaatatttacaagtagtcattgaaggtgcagccactccacattgccttttaaaaaatataaataaggaaaaatgatacaattatgctattttcaggtgtcattggacagttaggttttatcgagaaagtagtttgaatcatgtagtccaaacagggagagaaagaaagatgctacagaaatagccaataagcaaataattttggcttcaaatcacactgcaaacatagtacataatacatactttggcataaaagaattatagaatcataaaatttaaaaaactataaggctaatgtccagttgatcattttgttatctcaatgtcatataattcttttcaaatcacaccctctgtcagatattttttgaattaaaaataagacacatctcactatatccacatagtggcccatctaaaatattctgtgttgctttaatgtattaaaagtttgttcaggccgggcgcggtggctcacgcctgtaatcccagcactttgggaggccaagacgggcggatcacgaggtcaggagatcgagaccatcctggctaacacggtgaaaccccatctctactaaaaatacaaaaaaaagtagtcgggcctggtggcgggcacctgtagtcccagctactcgggaggctgaggtaggagaatggcgtgaacccgggaggcggagcttgcaatgagccgagatcgcgccactgcactccagcctgggcgacagagcgagactccgtctcaaaaaaaaaaaaaaaaaaaaaaaagtttcttcagttctaagcggtgatttttaaatgtcaaagaaatacagtccatagaaagagaactcacagttactacactacatttttgtgtgatatttaggttacagttttattgttttcacactgatttttctcactttcatttcagcagagatattttgtgcattttatattaacagttcacttggagaaatcactctaatatttggagccgattccctacagatacattctttaaacattctgtgcagataggatttgattgttcatattgcatgttatcttttcttgatcttattactctggcctgtacaggcattcagtggaacccatgaagagagtacagacagctgactggatgaagaagacattggggaaaaaaactcccattgtttagatttctgtcagaggatataagaatacttaatttcttttatctctagggctttcattatcatttaaatttcattttacattaattgatcagggattagtaaagccattatgcagaaattagaataagacaagccagatggaatgaataattcatgaagtccaattacgttttatttctggtgtactttcaaacttgcctctgacttctgtgctattttgatgtgacaatattcactggaaatcaagagtgccattttaatttattgtatccctctggagtggaagcatttgtatgcactaggggtatgttaacgcatttccacacacacaccccaacacccaaaagtcaattttgggggttttgaaaacactgggtgatctaggaatactgttcattttgtacagaggttcaggggcacttcaatgagccacaccagttcaactgattggggtgagctgaccctatgcagagagactaaaggcgtaggatcgcgaaatgattacctcctggaagagcagtaatcctctttaaaatatttgcacgcattcctctctgcaaaagaacccttaaaatgtgaatttggcctagagttggactggaggtagcagcagctgttgcagctacagacgaggaccacgaggtggcaggggttgccttcaatgaaagggttcggggcggtcgggaccgccggggcttcagaacatccccgcgggtctgagccgggccgaccacggttgggtttaggctccgagcatctcgcaaagcgttgccgggcgagaattccgaactaatggaaagtccggtccacctgtctggaatgtctcatacaactctgttgtctgaaaccgcctccccacccccggtcccagccaccagccccttgagaggccccctctccccccggtatttatttatgccactggacagttctagtcacattaaagctccggttcaccttctcgaggactttcatctcgggaagttttatgacactttgtgaatgtgcaaagtttttaattaggctctctagacagcccgaggcagcagcagcgccacaaagtcttcacggtctctctgctttacagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggtgagcggcggctcaggcgcccgggccggagggctgggaggggggcgcagtcggccactcgcagtctctccctctttctccaaaacggccttttttggacagaccttccaactgcagcagggctgccggcccccattcttgactaccctgaagggaattggcagatgcattggccaaaaatcacttaatctcccttcatccctaaacggtggctgctctcggacaattaacgacccttttttgcaaagagcaaaacgttatgcgttcacacctttccctatgggacaggacacacaggcatttgtcagagccgtgttgaaataactttataggcaaatacttggaaaagaaagcttttgtggacgtcgatttttagattgggcttttaaaaagggctatttgtcagtgtttgctacttgtaccgtttctattttgaatccacaaaagacgattctgttgactattttatgtttagatctctcatccatttgatttgtaccaaggtaaatattccttgtctaagatatcaaattcagaggcagacttttacaacagtctccaactttaaacatgaatatcaaactcagtatttttttaaaaatagattttaacatgtcacatttacagcaagtgaaaatacccatttattttaaaaatcagccagtaataaatactgtttttaaattatgctataaaaatttatgttttaaaaactatgccacatgcattgttcctttttgccagtctagcaaaattactgagttgctaattcagctacttggatttttttttaacataaatattattgtccttcaactttataaaataaaatggtctctgcatcacttcttggtttctgattcaagaaagctctctataaataagaatggacaggtaagaggaacaagtgctgcgaactatatgtcaagtggagaacaacaaaaaggtcttttgaagtgttttgagcaggaaacagctcagcctttttaattaggaagcccacagctggaggatctgaggaggagcacacttccctagtatttgtgtgtgtgtgtgtgtgtgtgtgtgtgtgtgtgtgtgggagggggcagggaaatattcttcaggtgttattattaagtctttgtatcttcaagggtatatacacctataattgctgccaagtagttatcttttaaaaatctttcaatttgagtctatttttgcttttagctacaagaattctgtgacaagaatgagttaggtaatgaagcatctttgaaaataatcaaaaggcatgagtatgtgaaatgtcccatcatttggatgttgaaatgtttataacattattgtttttaatagaaagatgttattaccctacattgtaagggtttcccagagtcttcatcactgtttattaaaatcatattgcttctatttgctaggagaaattcattcatttaaagcaaccaaaaaaactaacattttcctgattgacttaggagaccgctgtagtagaaatccagcttagttgagatgtttaagtgatacccaactacaatgcatatgaagggagtgagtgttctacaaactccttaacaattcctatgtaactgtttttcttttaaattttttttaggtaaaatgaaactaatgtctcaacattgataaatataattttttcccttctctttctctagatatcaagagacaaccacataagagtttcatagctaaacattttttaaaaatcattattggtcatgcaaactgtttagttttgtggtaaacataattctgctttaacaataatagtagagatacattgagtccagctcaaatccagtaatgaaccgaacactttttaaaaccttcaaatcatttttgtcttctggcaagttgaacaagatttttcttaaaaattagatttcttaaaaaaatctgaattatcagtagagcagtatgtttggttgttgtttttattattacatttttggaccaggttattccagctgttcctatgcaaggatagttcatatttcccacctcagtatttctgatttctactgcttaatgtaataatttatgatatataaatcttgcctttgcaattaaaatgattgagccaggaaaactgtggaaatatttgtgaaacaaagtacagtataagagacagagagaacatatgaattgttttttattattcatcaacttttgaaaggtcattactgatcggattaatgcaaatatattttgtcattttcttcatgcatttatgaattttctagcgcataatataggctgtgatcattattttctatcatttgtaatatatatgaaaagaaactatttttaaatgtttaaaatattgtttcactttgttatagtacttatattccaaataaaaattcttgaaaatgtattaggtattattttaaatgtgtcacaatgtcagtttattttcagtgatttttttgttatattcgtattaagattaaacattttattctatttttaagattgttcatagattacctaattctattcaatatcagattgttcatggaattaggtaatagaattaagcaagaatcctgtatgaaccttctaaattatggtattaaaaattaactttgaagagtctatagttgaatcacagatttgttttctgggcagcacagtcataataaagtgtattgacagcattatgatccatctaaattcacattgtttcagcctctgaaagatttggttaaaaattcagactctagcttgcacagcaggtacttttattatagaaattgtgtatttttaaaaaataaatgagccggggacttttggggtttttttttgtttttttgtttttttgctcacaattgacatacagtgatttaagcgggtgaaagaatttttattgatttcaagattaagtttaaacatagattcttatatatgatggagtttttattgctattttaaagataggtattgggtcaataatttcgtataaacagatggtttcaattccctgaataacaaaatgccggtggtgctaagccacagtacatgttgtgtttccattctaatgcgacatgtttattagacacaggtcttaaacagtggcatgagatgatcctagtggcccccttttcactgtattttttctttatgttttaatatttaccttttcctttcttaatggcatgttgtcatttcctattcaacattcttgtaaaaggctcaagagatctgagctttatgtcaattataaacttctaaccttgaagacaagcttttacacaactgataatgggagagaggtagacacactaaaaagtctttccaaatactgaggctcttggaacaaatactacaggttccattgcagcacctccagttcactttaattattattattgttataattatcaatgcttttagatttgaagtgtttattaaaggagatataaggcattttctatgagtgggtggctgtattctatcacgatgtcaccctggagacagtgccaaagttgtggatcgcttattacacttcggtactgccagagggaggaagacagatttaacaaaagagagagaaagagagagagagagaatttgagttttttgaaaaattttttttatctttatgttttccttttttcttctgatcatctcctccctgatgaggtttgagagatcaatacatatgtttactttttccttgaagactcacattaatatgacttttttattccaccatacacctgctttctgcctttttagtatccttaatcttggtaaatcctgagatctgtctctctccatctgtccataaactatgaccctatggggaaggatcccatttagctcctgtattttttgttggatgtacacttgtcataatccaaagaaatattcatgccacttactgcccggtgactatgtaaaaagactctccctccttttcttttttgttaaagtgtctcttctctctaccccttaattcagtggagcatatgatttaagaacaatgagccctttttccccccggcacaagggatgtgtattacttaatgcacatgaaggcagttggtgactcatccagttaaacgtattattgtaaatttgtatatttaaattcatattcagagattcttttattctgttgtgaaccctttggcaggttccaacagcaagtgtggccattgagggggcatccgccctaaaccgtgttcgttgggcccaagctggcaaagaagttgctgttggggactcggaaggccgtatttgggtctatgacgttggagaggtacgtgtgtatttgtgttgttgttactgttttgacttgtgtatctactttagaaacctagtgaaattattagcaagaacttgtaggccacaaggaccctctctaacgtgcttgtaaatttccattgacttcaatgctagtttggcgagacttccttagggcctaatttgatcttctgtctccatgcacagaacacttaagttaacaatctaagctccttttagagtcctgtagaatgtcccatcatcctgtgatggagtgtggcacttcccactaatttcatgagaatgaaaagtttagaggctgggtgcggtgcctcacgcctgtaatcccaacattttgggaggccgtggcaggtggatcacgaggtcaggagttcgagaccaggctggccaacgtagtgaaatcccatctctactaaaaatacaaaaattagtcgggcatggtggcaggcacctgtaatcccagctactcaggaggctgaggcaggagaaccacttgaatctgggaggcagaggttgcagtgagccgagattgcaccactgcactccaacctgggtggcagagagactccatctcaaaaaaaaaagaaaaagaaaagaaaagaaaagtttgccaaatatatcatgctaaaattgaaaagttgagttttggttggtatgttcaattaacatatatactatttttctttcattaaagtgtagccaattgagaatgtgattaattagaattttgtgccacttggtggtattcaaatttatcatatgagatatatacctttctagtatgtcttattacatgatacacaaagtattcctgaatgtcatggcatgtaaaaaaggaaaaaaaaaaacaactacaccttttatttcagacaaatctccttgaatttgcatacgatcttaatttaatgttacattatctatcaattgtacttaagattgtgtgtttatttttactgtatgagaaagtgttgaccaaaaccttcatttctggtgaggtaaggaactttttccttaaagaaaaagaaaatattgaactttcaagcaaaacaaaataagagcgttatgtaatgctattttggcataatatgaatctaacattgcattccagggggaaaatataccacatttgtatgcatagcatcctagacctagaaagtactctgtgagtgcctggtggatgggtttagctgatcacactgagaagggttctttatggtttcatcaatcagcattctataaatttggcaatcctaaatggtttgttctacaatggaacttttgatgacatattatatactgctatatggtatagttgattatgttggaacaagctagacggtgttttttaaaattcagccaggaacaaaaaccgaatgactttagaaatgggagttttctattctggatgcataattctaagtaaaaaaaaaaaatctcttgcttttactgcatgttatctatttcatttaacatccccttgactactcctgataccacaagctgagttccaacagtgacaaaaactctgttaatattggccccagtggtgaagatgcaaatggtctggtgactattgatatagtctggagtctttgggaaagagaataccctctgagtcggaaataccgccagtagtgttacagcagtatttttcttaaatgagtattctttatgtttaatgtatctttctcatggccctcatcaaagtaaaactaaacaacaataacaaaaacagatattctttattggtcacttcctaaaaaataaaaaagagcaaaggagaatgttaaaaaaaaaaaaagccttttctctctctttcttttcttcctttcttcctttcttccttttcctttcctttgtttataacaagtgtaattgtgggagagaaatacacatgaagacatgctcagagatacaatggcagaaaatagataaaatttaaaaactctttgctctatctcctttgcatacacataacgtcccttaactcacttaagattgtatacaatattattttatccctctttgttgtattctaaaaggactgaaaaacagattagtttaacaatctgttttatattttaaaaggccttttggaaagtctttattttgacttaaatgttatatatatacacactatatatatgcacacacatacattcatacacactgtctctatgcaataaggaaacacaatatgacatatatacagaattttctgcaataaaagtgattttacagcttttggacagaattacttgaatatgacatattttgtgagtaaatatgattttacaaaagttactttggctgatatgtggctgctaaaatttctttctaggatgctatcatcatttctaaattgtaaagtgttgttatactcatatttgtactatcgtactggcaggtcaggctggttttcatttttatgttattgcccttacttttctaagtgatattacagactatagaaatgtctgcaactataggccagtctcgcctattgtctggagtctagacaggctatagaaaaatctctgtgacatataataggccaaacaatttgtagggctgtttatccctacaaattcactaccaagaaaaagaaaggatatactattttattgagagtaggtaatattacaatctctagcccttctctgaatgaccgaaaatcaggataagcttatacacttgaagagttctttaggtattgtttgatcatatacaaagcaatctatagctcagaaaaactcagacttaacaaaataattgccttaactgtggttttataagtatttttataaattatatttatttgggtagaaggggaacttttgtgtttctctttgtcaccacaaagctttattctaaatcgctgaagacctcgtctgtagaggtacaatgtactaaaaggaaaaatgacttccctacatctgaggcttagctgcagcccacttctgaaagaggtagatcccttaagggcaaatgctgccattactgtgattactataggatcgttcaccagcccagaactgacagaacataactgtgcttaaagagaagtgcaccctctagacaagtaccttctcagccttccaaatcacctaaactgcggaaggccagatggaatgcttcatggcagggtggcacatttggaattagaggtctgatctaaggctggtgcatgactgactgcaggaagggtcgtcgagcaaagagctattcaagaagaaacaaataaggtattgaagactaaattgccagtaggctctgccaccactaccaatattcaaaattggttccctggtccctattaaaacgaaactcataaccacagtcatgctggcctttagatagaaaaccttgctttgtagaaccctctagaaagaagacaaaatgctcttagataagctttgtaatacaatctgtattaaaaagtagatggtaggttttttagagcacacaatgttggtccattttcctcagtacgttgaatacatgtctgtgggaagacatctcatattcattctcccagtgttgatttgaggagatttttttttaggctggggagaaaagaggggcctgtaggctagcttttgccaagaccttgttccacaagtgaggctgtcttgaagagtataggacctgtgcaattgcatagggcaccgtgcttaggggagccctgagcttgggtcattgtcttaaaattgttaaaaatttgtcaggaaggaacgccacattttcatttttcactgaaccctgcaaattagccggtcctgtcaactagagtgttactcttaatgccactcatgaggcaaatcagaaaaaaaaaaaaataggccttaacctagatcattaggaagaaagagaaatctgtagaaatgtagttaaatggatggacacactacaatcttctcattacctgtttctctttttttttcttttctttttttttttttttttgagacggagttttgctcttgcccaggctggagtgcaatggcacacttctgcctcccgggttcaagcaattctcctgccttagcctcctaagtatctgggattacaggcgcatgccacaacacccagcaaatttttgtatttttagtagagacaggatttcgccatgttggccaggctggtctcgaactcctgacctcaggtgatccactcgcctcggcctcccaaagtactgagattacagatttgagccactgcaccctgcctcattacctgtttcttaaaactacttaaaaatgtttaatgagaagggccacgactctacattataaacgtcaaggtacatatagagctaaagccgtactggagatcccaattcacctcccacaaccctcttttgatcacatcataattttgcctgaaaatatattaataatataatttggggaaagatctctgagatgcctaccccagttggagtggagcgggacaggctttctctgtccacaccattgttgagaactccctgaagagagactgctgtgagcactgatggaaacatctccattcaagcccaggtagtcttgccttcctgtgagccctggcactccctgattagggcattgcagaaagggactctggtgttaccagtcactgacagtcatctgcctcatctcctgtcccagctgaggctgcagctgctgcagggagccccagctcagtacccccatgaccatgcctttctcttattatgtacaattatcctctatgacttttaagatgatagcagagagcacagtggcttgaatccagatttagtggtgcaatttattatgaacttctgaaggggtaaacacaggattgtgtatgagctcactgaaatcaccagactgagtttgtccatctcccttttttttttctttttgttacatttaaatgacaaagacatgagtaatatcccacagcctatgactcaagaggtaaaatataaaacagcaatgttttcaggtaggtcacatgatgctgtgtttatatagcacacatttttggttgtttgatttcagcattatatctggaaaatacactgtacacatttattttcacagataggggtctattttctttgcagagcaggtgctgaactcccattagcataaatggaagttatgcgaatctgaatctgacaaaagacagagaagacccctttttattatttggctataatttttactctatttgtgccttcaaaagttacttacatagacagtggttgcatgcaccatttaaattttctgagattcaaaattaaaaatgagcctagcttctgaataagttttgagaaatctccaaactatggcttgcaatttgtttgttttggattgtaggaaggattccattcaattaaatgaaacatgggtaggataataagtcaaaaattaactattaatatacctgaaaacagagctattgttggattttttttcaaatgatgtatgaacacacattttaaagaattaaaaataaaaacgactcattgccatgtctccattactgaagagcaagcttttctatgcatatagagctgacttcaacagcacataggccagtatgtatagaattattcacgtgtcctgatgattgatagccagcctatctacctgtctttcttgcagatgtgttttatagaaagcccaccgccattgttaaggcttcagtgctgtcacacagatgcagctgtcataaatatcccctaacaactatgtttgctgcttatctgaattagttagaatgctgtttgcagctccagttttgaaagaagcagtttatcttccacctcctattatttctttttccattaacctcttccagggaagattttgttttcagttgtgataaattcacacaggtttcaaatccctgattatattttacagtagtcaaatgataaaattacagaatcattttcagctcaaagtaggatttgaagaataaaatggaaacttaaaaaccatggtttgagagacggacaaatcttatcctagctttattgatttggtatcctattcactagttacctaagaaaatatgcataaatctttaaatttgaactctgaactttgatagcatttcaaatagcttgtttgatacgactatttgggggccaaaagaatagtattcatttcattacaaatttcaataagtataatacatttgacattggatatatgggctttgaaaaattcttggaaaagaaagatgtgggttaacatgagagatcaaatgtaacactgccaaaaaagtaaaacatgattttaaatgtccatttgaatatattttaaagccaaaacgaaaaatcaagagagaaaagtttatttgtaacgccaacaggaagaatggcctacacaatatattttagaatgatggtcaaggtgttacatgtaagaactgttaacaagtgcctcaaatagtttcatagccagcaagaataagaataaaaaaaagagattcaatgggccatttttttatgctttcaacagtagtttgatgtagtggcatgtgataaactggaagtactgggagctaaaaagggtttgagtaacacaaaataaatacaatacaatgatgatttttaaggggaatcacacttaggcaataatagtgtactttgtggaactccttcatgttttccagtaatacagggcctacatcaattctccataagcagcctgtgccttgaatataaataattctcctccttgaggaagtgggcatacgaaacacaaaattgaaaagttaaacttagatttgggaggttaattcaaacaagagtcccttaataaaaagaactgcatttgcaatcagccagttttaataaccgtgctttatgaaggcctttgtcccctgagcaaggcaaacctgattgcatggctcggtttttgcagcctccagaagagcacagttggtctcagcttagcaagatccaggtatgatcatctgaatcactggtgtttctcattaaatgagtgtggccattaatttcctagattcttgaaggcctttgcaagtactggcttattcttaggtggataaacaatattattttctttagctgataccaaatacttcctttgattttctctccttgaaaaagaaaagacttaggcgtaaattcttccagtgataccaaacatccagataaaatgtgaaaatccaaatacctggttctgtcgataacatctagatagcagttgatggcataagaacaaagcatcaagcttttcaactggatttttcagtttttacttgaatttttagtgttacagccccaatgctgtgctattaagtcaaggggcaccaagatatatttgcatgggcagatttgagatgctaataaatataattatgtaaaataagccactttgaaataatatattaattcatttgtcataacaaattatatgtatttgaaattaaatattttgggtaaaatctatgattgtaattttggtattaactttatttcttctgggaaaagtgcttaatttaaaaaagaaaaggcgcaattaattccaattaatgttgtaagtattcatcttatagtacgtgtaatagctgtggctttcactttgataattatatatgtaaaagaccatgattaaactaattattatataaatagtgtgcttattcaggtagcattagtatatgaaaatggacttataggattaatatcttctcaagcaaatgttttttctgaattgaaaagaaatacttatgacttcatgtattatggagtagttgattcaatgaaaagaaagccctaatatctaatattataaacagcaaattaatgtgtgtatagtaatttcaaaattcaatgaagttcatatattctcattttggtgataaatgatctatgaatataaaccttctgaaagaagaaccagtttgtataactaatcatcttcatgattcttctgtggtttcaaactgtcatcttcaatggcagtttggattatgaagcagttgttaattatagtgttaatttttttatggctgacaaaattgtgtttagttctataatttcaaaattgctaaattttatcttgaaaaattgctgcttagagcagtagcctcaaatcacagctttaaaagctaaatgtgaagtctctccaatcatctgtgaatcgagattaacccgggcctgtacagaatggagttgtttcttacatgtgtatgtgtgctactgttggcatatctaaaatataatacataatcaaatatctgcttattcatgtttcctgtgtaaatatttatacaccacgtaggtcggacttgaaaagcgaggaagtgaatgaatcattatatttcactttcaaggaaagcttacatgaatttttgagaatgtcagctatcagaacatcttttaaattttaaagcatgagttacttatcatttaagaaatatccaaactgctaacattgtaaaagcaatttcatacttttaacctagtagataaatcagtggcccatttctaagctctttctcctaatagtcaaccaatagtttctcaattcagattaaattttttatttgtattggtctcagcattaaggtcccttagatagaaagtgaacataaactaatattttcaaagtgaataaataaataagaaagtgaacaccttctagtatgatttaaaaaaaaaaaaagttacccttgtgacttaaaaaaaaaaattcagattgtcagccctcccttgattatcacattcctcagcttcttttttaacctttggaagaccacatccacagaattgtacaaaaagtggttatttgacaattgtctattaaaacacaataacccagtctagcaaagtgcctggcacaaaataggcacacaataaatatttgatgggtgaatgaatgattcacatgtgaaaatttgaggaaaaattaagggaaagcttaattgtttagagcattcaggatgtagcctccaagttggctacagattgatgcacaggaaaaaaattacttaactgtagttgcacagaaaaggatatttagaaaatatctttagaaaagagtacttacccttccccccaatctctttcccagtttccctcccctcctgtgcttttaaaagtgagcagttggccactagtgtaataaaagcataaccgttgattcaaacagttgtcaaaccactggaaaaatgcttccttttcattgtgctttttttggacactatagatatggtaaatcatgaactgcgttataaaaatacctcttttgtgcccaaacattcagtaggagggaatgacatttcttttattaccttggtaaatgtttttaaggtgtttagcaataagccttctttttgtcaaaactgcttagacgcagtggttgctaagaatttattagaaaacctatagttaataatatcaagaaaagaagggatatgtgtttagtagctaatatgacagttgagcttgtgtagcacatgcttttgctttttcctaccattttcttgatcttttgtgttatggaaaacaagttattcatgtttagaaagtttatttttcattattgcccatcaaccagcgtttttagcattttctccatcttttgggcagagaaatagattgttccaaatagtagggaaaaaaataaggcgaaaagatttctgaggaaagaaggatgataagattttaatacaaatgtgaagaagactattcatctttaggtctttgtgaattaactctttcttcggatatttgttgttgttgttgttgttgttttgttgttgtttttcttccacaggtaaaaccttcagaatgttgtcatgcttcctataatgctaaattttaacatgaaaaatattttacatgttactttcttaagatagtgtttaaggagaaggatatatatttccttctatattcgctggcttattgaaattgatagagacccatatttgttactatttacttgacttttatgtcctacttttatttctttccttaattaggtggtaatggattttttaaaaagtgttactgtaaaaaaaaaacgtggtaaaaatagtaaaaataaaccactcctttaaagatacaagggaagagacctttggcagagaggtctgaagcttcatgggtggatgagggttcccttagatgggatttccagatgaaaagaaattaaaaaacaatcaaataccatctgaccaccataggtaagaatgttgcttaattttacagaaatttgtacctattgactggtaatagcagactgtgctgtacagagactaatgtaactcctactttgtcgacttctttgaaactgctctaaataagttacataccatatatctttttgtggtagaacactgtagtatatttacaccctctgtatattgcattctaacttggaattctggtccgtggtttcatccattgttagctgcgatgctagactctcccgggagttaaatacagtggggctgtatttatgtgaagcgggtatgcttggtcgttcagtggctgtttcattgcatattacctcccactttgctcccatctgtgtgtgtggtaaagggaattgtcctaaaaaatacaggcttcctctgaacacagacatgtatttgtataccagtaagtcaacaatctcctgaatttgggtgccattaataattgtcctttttaaaaggcttttagagcttagagggggttagcagtcgttctgtggaaaccgatgtacatttccacattttctgtaaatgcattaaaaaataatgtgtattaaagtgaaaggaaatctgtaagatatctttttaacagaaaactttaatttttagattaatacagagatgaattgtcgtgtatctcttggaaatcaatggttaacatgatagtctcacacactttttaaaattacttcatctaattgaaaaattacaaagaggctgatgagccacacatccatggaatatttatcttgaaacctagagtcctactcacttaatgtcttggccatacttcatgtatctgagaaaccaactgaaatcagagcgcttttctaacgtcttaattatgcaagattttaaaaaaagaaaactaaagtaagcaatacctgagacagatatttttactatgaaaaatattgcactgggatggtgaaagttactgcagataatgcagctatttaaaattattatagctgcaattactaaaaaatgaggaaggtttgactgagaactattcaaaatagttattagccatgtgattataaaaaggaacacatgaatgatatttgcatgtttaaccctggttataaaaagtcatttgatttttttaacagcatgtacagcagttacaaatccttacaactttaggtaaaaatgaagaatcccactgtggaaagtgccacaaggaaagagctggattaggatgtattagtcacatgtgaaaaataaaaaatatgtatgtgcatgtctacatatgtgtgtggatgtgtatagttacaataaatacttatattttaaacttgatttttaaaccaacaatggaaagtagcaactctgaaagaatttttcttgtgatttgaaagaactctttccctgtcccccgttcatgaaagttagctattattaaaagcctgactacttaggaaattatttgtgtgggtatttcagacataaaatgtgataaaatataaggtatacttctaaaaaaaaaagtacagctctaaataggtgaaaagaagaaagagaatatgcaaggaagaaagaaaataaaaaaattggaagaaaggaataaacattaagaaggaaaaacaacatcatgtattcagggtttatagtgtacaagcactgtgttaagcttattacatttttttgttttatttaatatacagtcctagaagatggatcttacaatttgtttcacacaaatgaggaagtaaagatcagaagtgttaaaaccatgcattccctaaagacacacagcaagttaatggcaaatctgggaaagaaaccaggatctggctggtgaagcagaaaaaaagtcaaccctggctccattctcaaatgttattactccacagtctgtgcctccctttaggtatacaggacacccaggcaaggcgagcaagggttagactgataagtttttcaggggtgaggtgggaccgggttcagaggcagcctccagtccactcaggcagagaggaggggactgatccctgacatggtccgagaagtagtggggtagcctgggtggtggggctctgggaggctaaaatgatacattttcatgaatttttccacaacttttgcacttttgcttttgcttgtagactttttgtcttccaagaatcttagaagatttaaaacaatctttacaatctttgagcaggtgattcaaaacacattacctgcctgcccttctgtcatggaatgctggcatttctcaaaggggtgagtcttgattgccccacactaacaggtgaaggttatgtggtctttagcaaatcatttagctccctatactgtcctctcctacctgttaaagaaaggtctacgccctgcttcttaacatcctcacataacaatcagaattaattcccaaggaaatttttttaaaaaacagaaaaatactgtaaaattggtatgcatgccacaaaacgtatcattttggggagctgttcaatttgactgacaatttaaagaaaaagaatgcatgacaatccatgatgaactcatagtactttctttactttgattacctttctcatgctctccacatctctgttgatgaatgggtcagatatcatcatccttattttacaattgaggcagtgagagggtaagtgcctgaccgttgccagcaaccaagataagaacaggacttgagtctcctgtccaaatctgaggttcattttacctctttcttatgtccaaattgctacctcagtaactacctttgcccttagtttcattggctgtaaaaatgggattgtatcatatctataaaaggtgatctcttttagagttaagattttattatctcaggaatctgagcctcaagtacttttggcatgaaaatgctttatatgtttagcaaaaaattagaaaacagtcattgaatcaggagatggactggctgttggtgaactcagtcgatgaagcagttggaatatctgagtcatccctaacctatgatgcagacttcatcagagatgaatctggaggcagaaaatgtttccagatccacattgacttagaacaatgctgggaaatttttgaagtttttttttttaatggtgttcccttaattgaactatacatttttaattggtcaaaataacttatgatcttttttcctatcacaaacataaattgtttggaaattattctaagctattattctcagagaaaaaatccatagtgatactctagatttagcctttatgccttaatagaaacttgaagagatgctgaagcaatgttattaacatgccatttgcctccctgttacttgcttgacacacaacagatatcaggaaatgttacagttgtcactgaaggaaggtaaattttaggctattcactttttaatgtcagtgaagtttttttaatgccagtattcacacagtttgacctacaaaaaacataattaatttttgtctgtatttcatagtcttcatattccaaaatgattcactactgtatctttaattcaaacacagtgcctgacatataaatggcactcaatcaatgctgattgaatgagtattgaatacatttatatgcaaggtaggacatgagagcagtctgttctgtaagaaacatgaacaaagatttttcctatttaatgattaagatagtgttggattaaaaaatctcctagagaaaatcataaatgcatttatgttcttgagcctactttctagccatttctaatcagagactaccacgtgagaagagccaggaactgccaagggtaagaagggcagttctgtccaaacagatgccatttacagtcatggaaacagcaaagtgaaaagagtggccctggccctcttgtttgttaggacacctgtttggtcttacctacaagtaattctaatgccaaaaattattactttgggtgtagaaacagcctgtgaatacacattcacactttcaagctaagatgatacttaaagtacttcctgatggtgatatttaattctaaaaatggggcagtctgcagttcaccttctaaatctaacattacaatcaccttgggttatttttacagtcaacaagatgaaaaggatagtaggatgaggtagataaattgatttcaagtttctaggaggaattgtgttttcatcatgttctactctagaatttttgtgaagcaagaaaataaatatttctgtgaaaattaagataccatgaaaaggaaaagacttggcaaaacaaatatccctaaaaaacaaacttcaaacattttgccagtctaaatgaaacttcagcagatcaaaaagaggacaagatgtgttagattactgtgacacttttatgagggtgaatctatatttctaagggcatgtgttagtattacagcactattactcccacctccatgaagaaagtcacatgtagttcactcgctggcttatgttttgtgtgtttaacagaaacatttaaatttgataaaactcatttttatgaagttatgtaatttttgagatgtgtaattttatatagtgtaaatgagactcacttctgttctaaactgtgtgtagacatttattcaaaccttaatgttccataatctttactagggccgtttctgaacagtcttgccatgactactacatgaaactatgtaaatacatttacctattttattgttaatagtctatagtttctacacatggctatcaataacatattgcataggtcatcatgtattaacttaaatttgtacgattttaactaataatatagctttatgtttgggaaccaaactcagctctttatgagcaaggtactgtgtattattgagacctatttttttctccaatatttaaagttatatgaagttatggggcattttagctttagcttgattcttactttatatgggaaaaagttataaatgtgttaccatgattaggcttttgtctcttcttgggcttttgtttcatggttatttttggaaaggcttgctcagcggttggaagaaggaaaagaaatagtggtcctattcttttacataaatgtgataccaacccttagttggttatggttttcgtgagcttgtttgtattgtacattttgggggcctcattttccaggtggagtattttctaaaattgaagaaaaaaaatgaagaatcgtggaatataggaaaagagtccaaagtagggaaaacagactgagcaaaagggtatcagaatcattcaagactattgtgaacttgtgttattgcctacaaagaaatttggattcatttcaataattatagtagcatttaaccattcagaaactcattcatgtgactaagtaagaattcttattggtactgcacttcgcaaaataagtcagagaacttactttccttgcctctatatcatttccagaattatattcttgaaacatttagccttaataccagaacactaatttaaggatatactttgcacaatgaagttgccactttccaataagttttcttggacagatagtatttgagaatattatccttgtaataaaaattttaagttctaatcatttggctctgtgtggtgggaaattttccagctgtagaagcaatctcaaagcttaggtttatttgcttcctcttttttcattaaaaaatatattaattgagatggctgtatgttcttaatgtttatggaatatgtggatagtgtagtgtagcactagtacctataggtaaattacactatattatagcgtaaaactccaagaaaatgcgtgtaaaatctaaatgaattttattctgtgtgaaaagcattcagacttctactaaatcctgtttctcatcctcaaatttttttttctatcccagatacttgcattatatttttaagcaatttatttttggatgctatgtggagaaatcattatcctttaaaacgactaacaaaaattcatacattcagtttgcattggaggaggcgttaatttcctcctcactgaattgtacacagaagatgttttggaaattttataaatccccctttttgatgaatcagtatagcatactggctaaggatgctcatactggaaccagattccattgacacttatatttgcttgctatgcaaccttggtaagattatttaatctttctgtgcctctaatataggaatgtgaggcacaataggattattatgacgaatgagttaatgcatgtaatgtacttagaacagaactcttggtaaataatagctactattactactattcatagttatcatcatataaatcttactggaaaggcccaagtactatttcataggaggaatatttctttgtatatataagctattcttttgcccttcatactgccccatcagcaacactttagaaaaaggattaataccattgactaggaataaaatatacagttatttgaaaatcttggtcattatatgcagtttttatttgcgtgttcactgtaagtctggtcttcttatgaaaaaaatttcattactaaaagcactttgatgtggctactgtaattgtatagtttgcataggtttttaaagttttataaattatgtgagtgcttttgcttccaagagtgacatggttctcttgttagtttaagagcaacacctcaggccctgcttgatccaaagaagaatgtttgatttcctttacattccaagggaaacatctgctttggagggtgtgggggcaaagggacagtcattcaggcttcaaggctttcagacatgaaagatatcttgttcatcatttctccattgatttgctttgcagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgatattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaacc

SEQ ID NO: 36744 - DNA, 9521 bp, Homo sapiens
tgggcggcggctgaggcgcgtgctctcgcgtggtcgctgggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggtacaccgggcggcgggcgtgcagcgagcggcacggcgcggaggcctgtgccggcctcctgggtgggacccagcggagacagggccaggggcggtggggaggttcagcctgcgtgtgtcgaggcccccccaggccagaggtcccggggtccatgtcccatgcctgggggccaccccgagcaccgggaacccggcctgtggcgtggccaggcaggttcggcctgcggcagaaattcattcacttttcccgggcttcagacccaagagggacctaggttcggaaacaggccggatccccctctccccccacaggccagggcgctggagagggacgtcgccgggacagagtaggctgtggctgcccggacgcccccagagcttcccctagggcctcagcattttaggcctggttttggagggctgaagcctcacccgagagcctgtgacgcattatgtaactggcgatgagcgcgccggccgatttctcctttgttaaatgggtcgagagcgtccagccggtacgctggagggcaacggtttagttttggtctttgacctcccacgcccacggctggggctgccgaaagtgaagaaactagatttgcagacgccactgctagttggttatgaagctccgggcaacagcgtaaaataaactgccccgaccttacattgttttggatgttcacagaatttaatttttttggatgtttaaatatgtagtgcccatctaacacagcctcccttttcctgctccctgcccgcctctcatcaccttggctttctccttttctttgcactttgaaacgtacagttaatgcagatttcacttcagcaggctccaggtaacctcctgatcaccaaatccagaaacgctgtgattccggacagacaatgtaagggtgtcgttgagaggggactcagtgccagggttggaatcccagccttatctgtttctcttaatagtgtgctgggatactagccccatggtgttgttgggactgaaataatatacagcctgggcaacatagcaagaccccaactctacaaaaaaaaattggccaggtgtgatggtgtgagcatgtagttcccagctgctcaggaggctgaggtgggaggatcgatcgattgagcgctggaggttgaggctacagtgagccttgatagcgtcactacactccggcctgagtgacagaaggagacctggtctcaaataaaatacataacgtatataaaactccagctcctggctcttacagtcaatacagggtcattgattttattaaaaatctattctgttttgtctttggagagtctgagatcaaagaaagagtattggtttcttcagcatttcttgtttttgagacagagtctcactctgtcgcccaggctggagtgcagtggggtgatcttggccgcctgcagcctctgcctccccagctcaagtgatcctcccacctcagcctcccgagtagctgggattacagattcccgccaccatgcccagctaatttttgtagttttagtagaggcaggtttcaccgtgttggccaggctggtctcaaacccctgacctcaagtgatcctctctcctaggcctcccaaagtgctgggattacaggcgtgagccaccacacccagccagtttcttcagcatttctgacttttttactgcaaactggttccttcatacaggttaagaatagacccaccagcatttcgtgggatggtcttgattcagggaagctctacaccttggtcctgacagacccggatgctcccagcaggaaggatcccaaatacaggtgagaggtgagaaagacgagaagagcaggtcatgcagagatgagttatcgggtgtaagtcccttgctggacacagagaagtagacctggtttgggatgcccccacccatgcttaagccagagagtgcctttcctgcccttttgcccccctacagcaggtgtctgtaactcacagccgagagccatatccacctgtggcctgtttttatacagccccatgagctaagaatggtttttacatttttatttagttatttattttttatttttttgagacagagtctcagtcacccaggctggagtgcagtggcatgatcttggctcactgcaacctccacctcccaggttcaagtgattctcatgcctcagctaaccgagtagctggaattacaagcgcccaccaccatgcctggctaatttttgtatttttagtagagacggggtttcaccttgtccaggctgctctcgaactcctgacctcaggtgatctgcccgcctcagtctcccaaagtgctgggattacaggtgtgagccactatgcccggcctggttttcacatttttaaatgattggtgaaaaattgaaagaagaatagtactttatgatgtggaaattacacaaaatttacctgtcagtgtccatcagttaacgttttattggagcaaagctatgtgtcatctgtggctgctttcatgctgccaaggccaagttgaatagttgcaacagagactgtggcccccaaagcttaacaaatttattctctggccttttagtggaaagtttgctgacctttgctctagaaaatgtcagagggtgggaggggctgggtctgctcttctgcaaacacatgaggttcgtgctggcctctaagaaagtgaggactgggccgggcgcggtggctcatgcctgtaattccagcactttgggaggccgagtcggggggatcacgaggtcaggagttcaagaccagtctggccaacatggtgaaaccccgtctctactaaaaatacgaaaattagccaggcatgatggcaggcgcctgtaatcccagctacttgggagcctgaggcagagaattgcttgagcccaggaggaggagcttgcagtgagccgagatcgtgccactgcattccagcctgggtgacagagtgagactctgtctcaaaaaaaaaaaaaaaagaaaggactgttgttcgtggctgtgttgtggcagccagcatgttcttgatgcccagttgctgactgtgcagtgaatgttccctgatctcctgtggtgctgacatcccgtgtttcttcatgcagagaatggcatcatttcctggtggtcaacatgaagggcaatgacatcagcagtggcacagtcctctccgattatgtgggctcggggcctcccaagggcacaggttagtaaaggttgtttttggtgggaggttggggagggagctcgggggcacattaggattgacccaatgcttttcttttgagagcccttaaccctgctggaaatagcatctcagcttacctctagggcagctgccttcagggcacacattcagacctgcagcagtgtcaggtggctagagccttgggttctggacagacggaccctttgtgtagagctgtctctgcacccctagccctttagcaagcagggaagttggtgagagggaagcactgttgcagaaagcttagcatggccttttggggctgcagtgagtggaatacacagttaaactatctcaagcctttgcccggggtgatctttgagtttctttaaaacatttcagaaatgatcatagtttccaaattaactatataaggttgctttctgtatttgtttctgaaaaagtctagctgggtatattgaaaacagatttggaagacttcagtagaactatattgaaggcgcacacacacacacacacattgtattgtgtagtatcgtgttatagctattatatataaaatacatgtagatatttagagatagaaagagaaagcccaccgtattgaaactttccaggttgggtaagtgccacctaagctgatggtgagatatgcattcttattgcctggtgttcagttcaggatgtttccatttggtggaactgtcataatcctagctttttgtacagcttatccagccaggagttaacatgaagaggtacaagaacatctctgacatggacagttggtcatgggctcatggtttctctgtagacccggaagcttcagatgcctttaaaccctctcacgcatgcatagtagatggtaaagggacagatttcccagggacctagtaagttctctagggcagttataaaattaggcaggttaattatgggaagcttacccatgagaataaggcaattctctcaagtaagagctgtgttctcattttttttttttgagatggagtcttgctctgtctcccaggctggagtgcagtggcacgatctcgctcactgcaagctccacctccccggttcatgccattctcctgcctcagcctcccgagtagctgggactacaggtgtccgccaccatgcctggctaattttatgcatttttagtagagacggggtttcaccgtgttagccaggatggtctcaatctcctgaccttgtgatctacctgcctcggtctcccaaagtgttgggattacaggcgtgagccactgcgcccggcagagctgtgttctcatttttaaaaaagcctcagtaactcattttcttgttgttttttccatattcttgtaatatggtataatttacatggtaacaaaatccacagatcggaagggttcagtcagcaaatgtgatcaatgcatacacccatggaaggtagcagccattggaaagacagatgacatttccatcgcccaacgacattctcatgtgacctttttacttaaattcccccagagctaaccatattctgactcctgtctccataaatcactttcactattcttttttttttttctgagatggagtctcgctctgtctcccaggctggagtgcaatggcgtgatctcggctcactacaacctctacctcctgtgttcaaatgattcttctgcctcagcctcctgagtagctgggatgacaggcgcccaccaccacgcccagctaatttttgtatttttagtagagtcaaggtttcaccatgttggccaggctggtctcgaacttctgaccttgtgatccgcccgccttggcctcccaaagtgctgggattacaggcgtgagccactgtgtccagccactttcgctattcttgtgttcatataatggtatcatggaccaggcacggtggctcacgcctataatcccagcatgttgggaggtggaggcagttggatcacttgaagccaggaattcaagaccggcctggccaacatggtacaactctgtctctaccaaaaatacaaaaattatccaggcatggtggcatacgtctgtagtcccagccacctgtggggctgaggtgggaggatggcttgaacccgggaggtggaggttgcagtgagctgagattgtgccattgcgctctagcctgggcgatagagcaagcctctgcctccaaaaaaaaagtatcatgcaatgtgtattttaaaaaatttgggtgactggtctgcttcattccagataatatctgtgagattggtccatagattgtatcaatagttacccctttttattgctcagtaatattcccgttggtgaacaggccagtttgtttagccattctctattgatgggcatttgggatgtttccagtatttggatattatgaagaaatatccaaatattatccagtctttttgtttaaacttctgtgtattattctaggactatttagctttgaaaagaaatttgggcacatgctacaccaggatgaaccctgaggaacattatgttagtgaaatgagccagtcacacaaagacaaataccgtacaattctatgagatacctaaagtagccaagctcactgaaacaaagtggagtggctgccatgcattctttttttttttttttttttaaatttttttttttcttgagacagagtcttgctctgtcacccaggctggagtgcaatggtgtgatcgcggctcactgcaacctccacctcccaggtttaagcgattctcctgcctcagcctcccgagtagctggaatacaggtgtccaccatcacacccggctaattttttttacttttagtagagacagggtttctccatgttgggcaggctggtcttgaactcctgagctcagatgatctgcccacctcagcctcccaaagtgctgggattacaggcaagagccaccatgcctggcaaaatttaccatcttaactctttttttgaggctggagtgcagtggtgtgatctcagctcacttcagcctccacctcccaggttcaagtgatcctcccacctcagcctcctgggtagctaggattacagacacgtgccaccatgtctggctaatttttatatttttagtagagacggggtttcaccatcttggccaagctggtctcaaattcctgacctcaagtgatccacctgccttagcctctcaaagtgctgggattacaggtgtgagccactgcgccccctccatcttaaccatttttaagtgtacactacagtagcgttaactacattcactttttttttttttttttttttttttttttttgagatagggtcttactctgtcccctaggctggagcacagtggcacgttttcagctcactgcagggctcagctcacctcctgggctcaagcaaccctcctacctcaggctcccgagaagctgggactacaggcacaggctacctaccacatccagcaaatttttgtatttctagtagagacggggtttcgccatattgcccaagctggtctcaaattcctcctgggctcaggtgaccctcccaccttggcctcccaaagtcctgggattataaatgtgagctaccatgcccgaccactacattcacattgttgtgaaacagatctctagatttttcatcttccccaacagaaaccctgtccccattgaccaacagctccccatttcccttcccctagccctggcagccaccattccactttctgttgcagtgtttgtctactttagatacctcgtggaattgtacagtatttgtcttgcgactggctaatttcactaatgtaatgttctcaaggttctctggtgtagcatgtgtctgaatttctttttaaggctgaatagtcctagagtaacacaggggagtaaagaaaaaataaaaggctggataatattctgttgtgtgtataaaccacattctgatcatcttttcatccatcagtggacagtcgggttgcttctgcttcttggctattgtgaatactgctgcattgaacatgggtgtgcaaatatttaaacaactttttaaaaaataactttgtttctggccgggtgcagtggctcacagctgtaatcccagcactttgggagggcgagatgggtggatcacttgaggtcaggagttttgccaacatggtgaaacctggtctctactaaaaatacaaaaacaaaacaaaacaaaacataactgggcgtggtggcacgtacctgtaatcctagctactcaggaggctgaggcaggagaattgcttgaacccaggaggctgaggttgtagtgagccgagatcatgccactgcactccacgcctaggcaacagagtgagactccgtctcaaaaaaaaaaaaaaaacccactttttaaaaaaataagagctcatggtacctatttgcatccagtacatcattgaagcttgtagaaagctgcttagttaaagtgaggttgggtcacttcgaagtagtcctccagttttctaagcaagtaaattttggaggtagaaagaaaatgttctcctttatcctagaggctcgactgtggtatggtgggcccgggtcattgatttgctttgtccttaattggttgctcctacctgacagaagtgaaatgggtgttctgatggggggtggtgggtggtgacttgagaaggtccgggagcctgaagtgggatgaatgaagagcacagaggctcgttgggaggcgaggataagggggtgcagaggccagatcccacaggccaggagaggctggaactaagggcttgggcttgacaccagttacagcaggggcctaacacattctattaggttgatgcaaaagtaattgcggtttttgccattaatgtgttaattgccattaaatgttaatttgcaccaaatacctgtctggaccctcggtgtcctccttgtaaatggtgtggtctgggtgcctccatgttgaaacattcgataaaaatggatgatgtccccatctcaagtgctgggctgtgtgtacatcttccctctgcctctccccacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaag

SEQ ID NO: 36745 - DNA, 45124 bp, Homo sapiens
attcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgagtccgcgcggaccgccaggcatgcttgggggacttcaagggcggggtgctaagtttcatgtcacggtgtcctaactgctggctctatactgggaagctctcggggaccaaggaaagagcgaccgtagttctggtcagcgcctgcccctggagctggccacactttcccaaatcaggtgaggggcttctggaatgggagggaacaaggtaggtttgtttgccacgtgcctcgaaattctcaatccattttaaccaaactcttccgagtgcaaggaagaaatctacagaaataagatgcaattcaataaactttcttcctgaggcttttagttaactcttgtattttagccatcatctgagcgggaagccggtatgactctgcaaggcgttcgtttaaaagttgtgctacttttgaggtgaagttaagagtgtctccatccacgccctctgcttcccagtcaatgtccctgcactgctcacgtccctttagctctctccctgcaaaccatagcggtgggtcctagacacgggacatcgctccaaccttggccaaactctcccaccctcagggttcccagatgtcctttgaataatcaaactgaggaaggagaagcaagatgtctccacaccccaatccctacagccttagccaatgcatgtgtgtaactgagacagaattttagcaaaaggtctcctgcttccaggactaaacagagcctctggcaggccactgcccgacacccaactccatcctccaattttcttaaatgtccaggtaaacatctccatagtgccagcctgctatagtctcccgaagacctcagcaattcttccccaaagcgtctccttctgcaccgtttttttctttgggcaaccatttgtgacctggctattgagcccacctgggcctcttctctttgtttgctgatagcctcgttaagtattaaaaacctactcccccccttcaggagccctcttttaatgaaagtttgggtactgggatcagatttgggacttggctacatttatttcctgtgtcattctgagaagagaaagtaatagaggcaagaaatttggcaccctattgatctattttattactttgttgagcaacttgtgcttcccgctgaagatgctgcatcccaacatgattctcttattattagttaccacctgagggttttggatctccaggtgtttatttcacatagcatatgctttaacccccttataagtcttctctaaggaagaaactgccatacttcccttgtcttctccggtgtttccctagctataaaggccccacctgcataacctgtcctcaggctgtgatgtattcccgggtgccctggtaccttctccttcctctccaccacccttcctgacagtgcaggggcaggaaagcatggggagaagggaaatggagactcccacttaacttgctgtgtgatagtaagagcattatttcacaactctgaacctcaagtctctgcccataaggttccctccagtgatataattccttaatttcttttgttttggttattgctttaaaataaaagtctaagcttaaggctaggttatagaaactgcccatcataattgctaggtctcaacatttgcttaagttttgtgattcttagtttcaagtctgttacccactctctctccccgccaccttttttccccctgacttcattgttctttgttcccatcctgaggccttgatttctggttctgctcttctttgaccttaaactgaatcaactcttccatcatccaactcagaataaaattggttttcttccaccggttccactgatgccaatggaagacttgtcttccttgcgatttgcaaaatgtctttcagtcacaggtgctgcggcaatgctgctgtcccacagcattctaagcttcagtctttctctctcttatcgtgggtcagtattcagaaaagggcagatttgtgggttgttcaggtttctcacttttctttttcttctttctagtttgggatcagagttgtgtgagtatttgtgtatataattttgttttggttttttgttcctgctgctacttacgactgctgttattatttcaattatgactaattaatactaatgactaattttcccctatgctagagggaaaataaggaagaaaagtttactctgctacttacccaaagcccaggtaaaatgcttagctgagaaggaatttaaaactcatagtttaaatgcatgatgcatgtctgctgtcattttatctgtgctgccacagtgtcctttcaagcagataactgagagttgctgtattttgctttcgaatttgttacagggacaaaaatagtgacccctcacatttaggtgttttggctgcttaatgcgagctcctgccctctagccgcatgcttattagtttacctagccctttttctggtcagtcatgactggagaatgccaaagagtctcccaagtaggctaccaaattaagaattgtgtttagaagtttgaagtcagtccaagtgttgtaaagattaaaacgttgttttgaagatatgctgtgtcaataaacaaatatggagccagagcaacacaatgtgaccaagtgtccaagcccagcttaggaacacttttctcccatgttatctagcaaactgacaaatcagctttccaacacgtgatgattggaaaatgctattagtttccttcaaaattctcctaatgtttctttttcaaaattgcctaagatcattggattatgtggtttgtgtttcttttcactgtagctgcttgttaaagcagtatactcaatctctgataagcaacagtaaatttgatcgatttgtatcctaaatttagctatcactttacattttgttttattcataatatgaactttagcttctaaaaatcaactttttaatagcttaatatataaagccatcttaaatcaaggaatatctatagggacttaaggtaatattcaactaaattggcaagtgactaccattatcctattaaagctctaaaatgcaatatttcaatcacagaaaaaaaatcttataatttaaagaactataaattgccagatgtttccctagttattacgttagtgacaaattagacaactggaaatagaaaacagagtatatgtttggaacagtcataaaaggactagtgactattgctgctagctgtggttgtattaacattaaaatatttgctatgggatttttcttcttatcaaagcagatgctcagatgaggaaaaactttcttgcatatgaaaatcaaaattgtcttccaaaatatttaagtaacaaaaaattcattatgtagtataaatgctgtatgattacattattcttatagttaatttagaagggtttgaatttgtttttgttttgtttgtgtttgtttcttcgataggtgcattctctaactgtcttaagtagaaacaaatgtctagaatctctcagtgattatcagtctccttcctattaccaagaatgtttttattgtgttgttaatctcacatgtaatttttttaacatttaaaagtttggaaaatgggtaaaaaatgagtgtgccttgtttcctattattacaatgtgccttcctatttcaagtcccaattctagatttccttaaaacttaaaatcatagaattaataatctttcagtttaagtcaacttttgtgtgatttcttgtccacttatacacacatagatgccttcatcttcaccaaataatgtagaaattttatttagttcaatggatttaagtactctgtatgcttaagtacaaaataagaatattgagaaatacacatatgattgtgtaccttttttttttttttttttgagacagagtcttgctctgttgcccaggctggcgtgcagtggcatgatctcggctcactgcaacctctgcctcccaggttcaaatgattttcctgcctcagcctccttagtagctgggattacaggtgcatgccgccacgcccagctaatttttgtatttttagtagagaagaggttcgccatgttggccaggctggtctcaaacttctgacctcaagtgatctccctgcctcggcctcccaaagtgctgggattacagacatgagccacctcacctggcctgattttgtacttttaaagagaatttgttgttgctaatttgctaagtttatttagatattttctgattctatattagtcaaagctcctcttatctactttggaaaatgaagaattatgtctataaaatatatcaacaacagctgcaggtacttacagaggaaatactgtggatctgagtgatattaggccctgaggatacaagccaaagtataaaaatggtctttgccgtagagagatagtagtcaagctaagcacatattttggcatgggtctctaatagcctaatgctagtagggtgggaagccatttaaaaatggcccctccttctgtcctgcctttcagaccagatggtgtgtctaaagtggtcacactgtttggttctggccacttctgtaataaccactgctcctttcccctcctcgtgagattataactcctttgacagtatggatggcacctaacgcatccttgttttcttttactaaatgttccacggagtcacttgcttgcctgtttgttgcttatttgtttgtttttggctaaaactacagaaaatgttaaatacattttcagacctttatattttaaaaaagaaatgttaagaaataaataatttttctaatctcatttagatacactgtcctattacacacaatgacaaatttgatgcttttgtcttgctaattgaagagctaagcatgaatacagtttttcagtctacagcagcaatgacaagggtaaagtggagaaaagagtaaggaaagaaaaaattaaaaagaataaaaggttgaaatatcaaatcggtggttcttaagatgacagaggcaggtgagacaagaatactggaatcacccagggggcatatgaaatctgtacatttcatccacaccttcttttctccccctgtcctcattccccctgttgagacacattgtattacaaattaggaggaaaccatctaaaattatctcacgtatcccagttcccatattagcatcatgagtatcacctgagagtttgttggaactgcagaatctcagaccctgtccagacccattgattgcataagaatctgcattttagcaaaatcctcaggtgattcaaatgcacattaagggaaaagaaacacagtgtaccgtacctgtggcttgtttagaataattatgaagaggtgttttcttggctcttaactaacgtttttaataaagctaatatttattgagtacataaatgtgccaaacacaacgttcagtctttctttaaattttttttatttaatcctcacaacaaccctgtgagatagtttctgttttatccttattttatagattgggataccaagtaataatgagataagtagtttacccaaaagctgtaactgatacagtcgagatgtaaacataagaattctaatttcattgcctgttctcttagctgttacctacagtgtctgctctatactgggctacctactttttaaggccaactaattatttgaaaatttatttaaagttttaatttgagatcaaaatctgtttccctcataaattttttttaaaaaaagcaaacaagatctattccattttgatctaatgttttcctgtcaccttacctttaagtgcaataatgggaaattctagaaattccttctttaactgtttgaaaaaataccaaaactatgacagcctgtccaaatccactaaaatatatttttatatgcatgctttttgtatatcaattatacttcaataaagctttttaaaaaaatagtagatgacatacttttaaaaattaactttggagcccaggtatggtggctcagacctgtaatcccagcactttgggaggatcacttgaggccaggagtttgagaccagctgaggcaacaaactgagacccccatctctacaaaaaataaaaaattgccagagcatggtggcgcacaccatgtagtagttgggacctgtagtcccaactactcaggagactgagttgggaggattgcttgagtctgggaggtgaaggctgcagtgagccatgatcacaccactgcactccagcctgagcaacagagaaagaccctgtctcgaataataataataataataacaacttttgatatctctattttttcccataaaaatccaaaattttctgtttactttttggtgctctcatgctataaagtaaattctcccttggattggacaagttattttctgttttctacatacacatagactgttcagcattccaactcaaattacatattactttttcagcttttaatataaatgcttatttactacaagcatggtttacaaaaatgtagtaaaatatagttactaaccagtcaatgctcaagccagtgactccccaaatgattcagtccctgagctgtttcacccagtgcaggtagattctctgacagccatcagttggatctgtccgaatatctcctgttttgacaggggcttattgatgttggtcaaaagacaggtgtgtatgggttccctgggatcatgtttgaggggaaacctgtgccaacaggactgagcagccactttttcaatggtattgagaaaatttgtaggagataaaatttcaccagctccttgaatctagaactgtagatattcaggtagcactgacattacaacatctaatttgtaagttatgggttagggcaaaatcaatccagggctgccatcatgacaagtagtggaagtttgaaagaaggagaaatacccaaaagatatcttacacatagcaggcagagtttcttagtactaataaaaaataaagtaccagtgatcaccctctatagcccctaagagtcccctggtttcactaagccccaatatttgtggctgtggctgaatgcaatctgcacaaggttttctttttaacagttggaaaaaatctcatagcatagcatttttttctttttaacagttggaaaaattctcgtagcatagcatttttttctagtaaatttcatatacttaacaactttatcagcacatatattttccttcacacttacaatttcatcaacacatatactttactttttgactcaaattcttcttgccatcaattcaaatgctcctgcccttagaatgagaattttccattaacccagctttaataatctaactctcccattcaaatgatgtcacttcatataaaacacattttatcatgatgtctcccagccctcagttacacagttaattgctgccactttatcatgaatgaaaaagatgtgattcttgggtaatgatttcttgagtatgtcctggtctattatctactgagttaccagagtggatttttgagagaacacacagttattcctattccttttaatttccattaacttaagccatatgatagaacattacagttgttatatattttgtataaatataaaatgtaatatataatttatatattttaaaatatttagtggcaagtaaagatagtagtaagtgaaaaaatcactgtataacatatgaatcgtaagtgtgatcccatgtatgtgtatacctggtagatgcttgtcaaggtgccattaaggtcttgggttattggcatcttaatgaaattcatttaattatgttaggattgatttgttagtaaaatcacttacatgttttttaaatgcatgcatatctgtggagccaataagaaaaattaggaacaatatacaacaaatcttaagagcttttgaggatgattttttttctttctttcttttgtatgtacctacaaaattttctataatggatctctattgattttatattttttactttctatttgtcttggaatttctattactttatttataattcactctagattttaggtactagacaactactattaactctctggagaatggtactataaatctgaccctttctgtcatttttttttcctgtggtacactagtgtctcacaaagagtccacagaattcacacggtcatgatattttatagaagaaatcattttatgggaactttcttttgttaatagatccttccaatgctaacattattctgtataacagtgctaaagttggtatgcctaaatgctaaacttggtatgctaaagttggtttaaaaattaacctatatacaatcttcttgaataactcttcaactttaaataaatttcttatttaaaaaatcctcctatatataattaaaaatactgatgaatttgactacataaaaataaatgcttatacagtaaaaagtaccataaacaaagttatcatctaaacaagaaacctgggaaagctatttgccagccattacatgtaaaatttaagtttccttaacataacatgagctctttaatgtgagaaacaataaacaacctaattgaaacatgagcaaaagccatggctgagaaaactcgtagaagaattactatggaaacaataagaaaatgaaaagaagttcaacctcattcataattaacgaaatgcaagtcaaaacaaagatataccttttacttatcagataaagaaaaaatgatttgataaaacccagattcttggtattataaattggtataaccttaacggaggacattttatgaatatctatcaaaaacttagcatatacaaacaatttggttcaacagtctgttagaatttattatatagatacattcatataagtacaaaagtgcatatatgtaaatattattattgggacatttttgtagcagccaaaaggaaaactgaaaaaaaagattaaggctcattaatagcagactggttaaataaactatgtgtgagtacaatgaatgaaatattgtacagccatcaaaatgaatgaggtagatttatatatgctgatgtaggaaatctgctagccatcataagtaaaataaatgaaacaaagaagaaaatactatgatgtacaaaaagaaaaaactatagatatacatatttatatgcatgtgtatgcattttttatgaatatacatatttatatgcatgtgtatacaagtcctagaaggagacataggtaactattagtagtacctctgggaagtaaatgcagagaaaagtaatagagggtaaggatatgtttacttttattttacatccttctgtaacttgacatttatacgacgcgttagcattacttctgggaaaaagaaaaacagaaaaggtaatcttttaaaaaggtattttttaaattatggtacaataaaatgtgcataagctttatactaagtaatagaatcatttaagtttagctgtagattcacaagtaaaaatccaatctattttcatattcttacatttatagacatttcttacatgtctatagaaagaaatggctaggaatgagactgcactattttaccctaaaacgttctttttctctttgcctaatgtatatctacaagggcattggggaagatgttgaccacaggcaggaagatgatgagatcctgtgcccaccacttaatgcagtctagctctatataaggaaaaatatgttcttgatgtgaaccagatggtttcactcccttcaaaaacactcttaagatgcagtgtggaagcttactctgtaaattaaaaaataaaaacctgactatattcagtggaatgcgttaatcatttttttctttttaggtttgatatttgacaaattgatctaaaatggctgggtttttatctgaataactcactgatgccatcccagaaagtcggcaccaggtaaatgccttacatctacagcagtgggtctgtcagcagttttctttaatgtgtcagcagtggggagagcgcaaaaacccacacacaccattatcttgtgaaagaagtagaggaagcagaaaataatgaaatcccagtgttaccacatcccctccaatatacagattaagagcgtttgtatttatatggttttaaacataaataacatcagaattactaagctatttccattcatgtactgataatgaatcatgtgagaaagtcctttggcaaggactccacatggccacaggtgattcctttgagcagtgttcttcctgtatagggcttaagaggaccagaagggaaatgattgtactctcttgtcagctacttcctgggcgatttgggttctttgataccccagtgctcactttcggaagtgttaagaccataaaccttaacagttgaccttctcaccttcagaaaacccaaatgtctcggagtttcattctcacaaacttccaccttcctccaatgatgagatataggaaaaaagacaatgtgaaattggagatggaggtgccctcttagcctctttacaggcatgagtcacatggcagggcattaaactctctcacaacctgttgtggagctcagcagggttagccaggactgttttgtctatctaactcttcttacatgggcctatgtgatatttttcataacaagagtccgggatttacctaactaataagatttccccacgcccctccttacaaaaactcagttcaaagaacaagccctcagcttctcctagtcccctccagggaaaatgaagagtagcttgtcctattctgaatatgttgtgctcccattttatcaaagtagaggatagatacgtaggtgctgggtgggtagataaatattagagggatgcttcttctttgctgtaacagattggcaagtaggaatcattttctggaaggtactccacagtggtggtgttagaaaactatttagaatgcctttaatcttggagataaaaatagtaacactttacagagttctgtcaatggatatctttagggatgttttgttttgggaggttttttttctgattttgtttttttcaggtatagcgaagcttgggaatctggactgtgcagattttctgcaaaaatccagctctggaaagagtgtattaagatgcatatcctaggatgacacaaagacagtatgctttattttacatcttaaaagtattgaacagaaggagttttgtccatgatatcccatcagcccactagcaggaaaagcaggacacttacccagggggttcctgctggaaatgattcttggaatcagccttccttctactctatttgggaagtctttggtttctaacattcacacatttgtagcaaagcttccaaaataactatgatgttttgcttaggaataacaaaacatggaagaaaacattctgtgaaattttaaactttttcaaacctttaagtttcagatgaataagcaaaacatacttaagtctaagaagctattttttgtttgtcaaagaactgatgttataccagttctaatattaattagcaactttgccctggttttcctgtaaaataatctccaaggccctatctcaatctgtgggcagtatactgaaatacaaaaagtgttcacaaaaggaccttctgaactttgcaatctccctttaaaacttttaccaacttaaaactacagaactctgatctcttattgatttaaactagtgatatgtaaacagcacttcagagcttgtttcacaggaccaaaaaatttatgctgaaatctactcatgacaaatgggaaaaccctgattagcacatttaaatgaataaataaagaaccgtattcaatggcttaaaatttatagacctgcatcatccattatggtagccatttactatatgtggctatttacatttaaatataaacgtattaaaattaaactaaaaattcagcccctctgttgcattacccccatctcaagtgctcagtagacacatgtggttagtggacaacacagatttagaacatttctatcataggaagtactactggacagtactgctgtaaacacacttattaataatgcagcagactttcttggccacttggtaagaaagttttctgctcttttaaacttatttgggaagtttttaatacttttgaaattatgatttcctcagtgttagattatctgatatacagctctcacagaccattttttgtttttcctgtttgtttgcatattaaaatatataggattcaatgtttcacgtgcttttctaaagttgcagttcttgatttcttaaaattgtgaaaagaagtacccacagttatattaagaactaaaatatatggctgttggcttggttaccaacattgctgacagctccaagtaagcaaaagtaaaaaagatgtaggatcatttttaaaggccaatattttcttccttactcattaccttctgtaaaattctgtaagattttctttagttttccagtaatgataaacatttcaccattgcatagacataattaattgattttttaagcagttggagagccaaacaaaataaggggtagaatacttcttattttattttttaataaaaatgtacatattagaagcctttatttttatttaaattgtatgtcactgataaggtttggatatttgcccctccaaatctcatgttgaaatgtgatcccctgtgttggaggtggggcctggtgggaggtgtttggatcctgcaggcggatctctcatgaatggcttggtgccctccccatgttaatgaaagagttcttgctctgaaactgtgacacctcccccctctctctcttgctcctgctctcgccatgtgacatgctggttccctatcaccttctgccatgattgtaagcatcctgtggcctcaccagaagcagaagctaacaccatgcttccttgtaagcctgcagaaccaggagtcagttaaagctcttttctttataaattacccagtttcaggtattcctttatagcaacacaagaatagaccaacacagtcacggataacagtagtttttcatttttcatcaatataatgatcctgctgtattcttaaagttcttaatcactatttgtcactaatacgataacattaataaaatttgagtctcagttactttccagtcacttatacctagcagttcaataacatttagttcctggactaatgatcatgtgttatataaggcaaaaaattaaaaacaaatttgtctttgagtcatcaaagcatcaagggtttgaaatagctatataactagctgtgaaaaagggatataaatatccagctgatatttcctttacacatttaatagtatcatttttcaatgaaagcataaataaaataagtttggaaccagtttggaatttttaaatattaatcgcagaatcttactaacagaaaacaaaagcaagataaatgctagtcatttgtgcctgagtttttttttcaataaacagaaatgaagcttgctttaggaaacatgtgtactccaaataacctactattcacacaattctcagtaacattctttctttgcttaaataatacagccagatgtgcttagcacataactctatagaaaataataatttaaattagatttaaatagagatagatagacagacagacagatagacagatatttttgagacaaagtctcactttgtcctctaggctagagtgtagtggcatgatcatagctcactgcagccttaaactcctgggctcaagccatcctcctatctcatcctcccaagtatctaggactacaggcacatgcactatgcccagctaattatttttttaattttttgtagagatgtcgtcttgctacattgcctaggttgctcatgaacccccagcctcaagtgatcctcctgcctcagcctcccaaaatgctaagattacaggcatgaaccactgcacccaaccaatattaatatttttaacaattgaaagagctcaaagaaataggttttaaatttagaggccctgttttgctgacaggaaaggcttttagctggaatcaagagtgctgttgtcttttcccttcaattagtcattccttttaagacttttaagatttaaatgtatgagtcattttttaaatcccagaaagatctagtatatctcataaatgtaataatacagtgcagacctggtggaaaataattatttatctgaaactgggcctcagtgcctttcctgaatctaaacaaatgttcatctcacccagagaactgggacaacaggaacaaggtattgcaagtccaaaatccaatccaaagcagcgttcttcctccccacctctaggcaaggccaaaatacttctgcacacagtatagacaccagaaaaaaacagagccactgtagatgaaaccagtcagggggtaagagctgtcttttgatctagagcttgcacctttgctcctcagtaatactcccaggtcaaaaaggaaaaataagatgggcagttggctgcctcctggtccctccagcctggtcagtgaacagagtgggaagataaaacagctaagtatcttccttaacaatgcaaagcaagaaatccagtctgctttgggaaagtgaaagcaatgcaaattcagattattaatcataagagcatctcatgtgatatacaaaattattgtatagcagtaatgggtcagccgtattttattcaacactgaaccattaatgaatgctagctagtcttcctttcacttacagaatgtttatctatacatgactaaacaaagaaggagcgctggaaatgatcctgtgaaaaatactggctcacaatgtatcagctgagtttggggcaactgaggtagtaggaggcgccccctggacttctgctggaatttagatttaaatagatggatgaattagacaaaacatactctctgaaagagtgagaaatacaatattcaccaattaagtgaaggaaaaatctacactatgaataaaacaataaatgtggatacatttgaaaatttgaatttcaaaccccttaagataatgtgacaaatacaacaggcctaatttaacatcttaaagagatctgtgtgacctattttgcagttttattttcttaggacaatgcttcagtatctttaactttcatatttaatcattttttttcttttttggtttctatggtatcaccatccatcaatccatattggttggagggggggaatatatatatatatatatgtatgtctcccaagagaaagtaattctgcaatcttcctcagcaattcagtctaacaattaagaacccttaagctaaatagaaaaattcatttcacaggcaagttttactcaatatgtataattagttttagttaactttattaatgaaatgtcgcaaatcaattaggtttgcaataatcagatgccgaggacccaagaggaaccattcctctcacaagaggggaaggtgatacacaatttagttgggaagcaaatgtaattagatttgatcaattgagtattcctgtcctgatgtggagtcagtcacatacccaagcctgagaatatatttgaaaagaggtagaaaaaaacccagtatgacttagaaaatgtccttgtggtcctattggccacaactggcagccaaaaagggctttgaagccacaggtagacaggttttgttcagacagggctatgttttagatttctctttcaaatctgaatggttttacgtagggcaatatataaactttcctatttgtcacagattctagcactctttaatgccttatactgggtgtttcacacagttatttaactgcccaaatcccaatggcacttcagtttgcaactatcatgacctagaagttagttattgaacagttatgaggtaacttaaagtttcttccctttgcctctagaataagaatatcaaagaaatgtcatgatgataggaatactactgaaagaggatattaaacactaggtattcctacttagggctacagtttgcagcagattctattgtgtttcagtcaataagtgtttttggacacctacatgccagacactattctcagcattgagcacaaagtcgtgagcaaggtagacaaaaatgcttggcctcataaaacttacattccagtgcataaagatgagaacaatcacgtaaaatttataatatgttggatggcatggaaaatggaaataaagtggaagggaggcttcaggttaaaaagagtgtttagggaaggtcttcttaggaagaaggaggaagctatgtggacatctgggagaagatcgctccaggcagagggtagagcaaatgcaaattccttgaggcagcaatgtgctggcatggtcaaggcacagcgagtatgccagggtcttcagaaaccacagagaagagtggataacaaaagtgaaatcaagtattgaagagtatgaactgacaggaactagagacatatttagaatggatgccagaacaggagaaatgggtgggattttaaaagctaaatgatttaaagacttaaaatgctctgaagtgtagtgaaatgttccccaaactgcagattttcccaggaaaccaggtgcataatttagtcatcgatgactggttctgtggcaatgactctagtaattagacccctgcattttatgtcagttccttctggatactcagctacattatttggtgcttttggtatacttcaaatatgcattgcctatcactgacctgtaatcctgtgtctctgggcctgaaaatataacttttcatgtagtagagaattagggctgtgcaacattgccactagattatttttaatgaaagctttgcccttttagataaatacagcaatgtattcaaacaagtcctagggataccactgagtgcaaaatgtcatgtactagttattccatttaaattattttatcttcaagtctaataagaaaattctaaataaaattatatatttgggattgtgtgtgtatcatccatccacatgtaagtaggaataaaattatttaatggaaaatttcaaataggctaactctaaaaatgtacagataatctggatgagagaaaactatcctcactttgtgttatttttcaatggtagcattttctcataatccccatgcttttttcatgtcctgctattctttaagatttcctaatgaggattagggaataggcatatttaacaatctgtgttcgcaggttgaaaacaagaaaatgaagactaatagtttctctcctgttaatttgattttctacagctcctctcctaccagcttaggcagaggacttagttactatttccaatagatgggagccaaggaaaagacaagcatctgtgatgtcatgtctcccccaaacgggtagctgcctcaccagcctccattagagacatcccccagagtaagaaataagaaataatcatgagtagaatgagaaaaaaatgcagcttcctttatctgagaaaaacaatagtagctcaatgctgtggcctaaagggctttgaaaataatgcaatttctgataaaaataaatgccattattcttgcttattgtcactgttttagtcaaataagattttagcaagcatatttcaaattgttctaaatctaagtaaattggtaattaaatgctatcattagaaagtattttaatatcagaaaaattggaccataagaaagttagtttacccttgtattcatatatacatgtgctttgtgctaaaaattgttatcatttagtgagaacctgtgactatattaattaatttaatttaatcttcatatttctctgaccgttagagagtttgtgacttggataactttcaaacaactagtaccctgatggaaatccagaattttgttaacccagatcacagctgcatacttaaatgctatgcaacagtggcacttacccccaaaccgtatcctatggaaatgcctttttagcaaattaaactgaattgtgttcagagatccacaggtctaagcaacattagggaaggggtaaagtagtcctcagcaaggcccttttcagagcactccaccagtgcccttgtcctcctgggcagagctcctcagctatactccctttcctagtctaccctatcccacaacggaaccatacttctctcatggaagccctggtctcacagaactaaaaaggaggctcctagaaatggggttgtgttgagttgacagagatgtgtggctctttaaactgaaatataatccaaagagaacaagatctagtagaatttcaggtcctaagcctggttaaatttcaggtcctaaggctggttaatagtacaaatacagttatttatttataactagtgcaaatacagttatttatttataactatacaggaatttatttcccagtaccttctatattactaacatcccataaaaccagccatgtaaggaactagaacattttgagaatatgcaatacataaccttaaacaagaagttttcattcctaattaaaaaaaataagctagttcatcacaacttccttcaaatccttctgccactgatttctctcctgaaaagagatattatacggcattttagagaaaacaaacatctctaagtcacaaggagtggaataatcaaagttgcattttaagcaagattatggttttttctttgagttctctgaatttgaatagtttcttaaccttagttttttaactgctctgaaaatggtttctgtccctggtggactcttgtttcaatgcagttattttgtctggtagagtcacagagttaagctgtcattcagatcagaaaaaataaaagagagagatgaattaatctcaatggcacagtctccttattcaaaaaataaaaataaaaataaatctcaagtccaacaatgaatcatctttgagactctcccaagtgatctagttttaagggcaaaaactttggggaaactgttgggggagcaactggtgcccagtactgtttcacacacgtggtttttcttatctattgctcacacacttagacataactggaattattgcctttgtattgttgttgccattttataaaggaagacaaaaaagatcagacaaaataatagtgaacatctattaattggacacttactggtgtcaggcactgtgtcatgcactgtgtcaggcactgtattttcttatttaatccaacaaaaaaaaataggctaaattatcttattggctcaattttctttacagaaactgagcctaaatttcccaaatggctaaccaatgccagggccagcaactcaaatttgggagtaattccgacacctaggttccaaccatttttctcccagaaataacccaccaaattcaccagagtctaagatcttactgttactgtttaattaactgctacaattgcagcattttaaaaaaatataaatgagcactgtgctagtatttaattatagctttatactgatactgggtacaagtataagctaacaccattttgaattatagtagaagagtcaggagctctgagaggaatgttcaggatagaataaagcagatattttaatgtctcatttcagtgaggaaaattgttaattcatatgccaccagccatcggcagaaatgtaacaggaaatgaagaaaaacttaattactttaaatacagtggtctgtagtacaaattattgtgccgtgaattagtttccttctgctgtagaattgatcattttgattatgtagccaagcagtgtaagacattactaaaattattcttgaatcctacctttgagatctatataaaacactaggcaatttgcctgcaaatacatagaaaacaatttttaaaaggattgggatgagttattttcccctctgttaaatattagcctttgaaatgaacccagctgatctgccaaataacacttggaaattgttgtgttttaataaagtgacagactgagagggaagccacactagacgtccttatgcttttagaggccttacagggcaggaacattatgcaataatgccttttaaaagaagtgagcttcctagtattacaccttgcctggcaacaaatgtagccacttactgaaatgcaggcgtaattagaatctatgaaaatctagcatcagaatcccaaacctctatgcaatactcagtaaattacagcttttatgtctgtaatattttcaaccattctacttaaatatgtgaatacatgagtgtggagttctttaggaggcctgctgcatatgctagggaaaggtttcatcatttctaatcaggatggctctgtaaatgggatgcctcatgttcaggtttctggaaggctcagagcctgggcttctactggcagagggtagacccaaatggactactctagtgaaaatctccaggtgaacatggaacgcagtgaaaacctggggtatccaacttgcagtataggccaccagcaagtgtcacctctattataactttaaccaggcaagctcagtctcatgcattagtttataaaattgcaacagagccttctaagactgaaaggacattagtttttaaacctatatattatgacctaattaaatgaaattttattttaaagccctcataaaagtagtaaaattggtgttttaaataaaccaaatgggaattcaaccactttaatttttcttttgttccaataggaaaataaatgctttaaaatttgaagttgaaacatgggttttaaatatattgagataaaaactattttgcataggcattttgaagaaaataaattttgttctcgtgatttgtgattggccattgatttccgtgtttaagattatgaaggtgtgctcagctgtctactagaaataacaggggagactcagtcttgtttcaaatggaagggctcctattcggttttctccttcatttcttaaagtgttgtgatttttttattccctggtgttatgtcttgagattttaaatcttaaaacatgcaattaggtattgaagttgaaagctggaagtctcagccagctagtaatggttttttaaaataggtaatacagacctctagtggttgaacagtttgaaagcctctgcaagaaaaggaaattgcgcagaaagtgcctgcattttaaggggaaaagttagttaaaattattcagatgataaaattcacatatttcataggaaaaaaaaagccagaatgggcttcaagggaaggtggcacacttcccatccttttagatgttcctcaattcctctaaataagcaaaaactctctggccaaagtcacagtaagaagtctggatctgtattatttttctctaaaagatcttgtgaacagagctgctagatctctgtattatatgaaacatatatttttgtacacagttttgcctcactggggctttgcttcctttgtactccagaggctccccatgaaaacaatctgcagccacctcaacttgcctgtgctgttctcaggttctgtccatggggagccacacttcagtgagctcagcgattggatggctttttagtctacatgagagggaaactccatgtgcctctagactagtgcttctcaaactctaatgaacacccaagtcatctggggaatctgcttgaaatgcagattctatctcggtctggggtggggcctgaggctgtcttgttcgtaaactcccagttgatgctaacgctgcccatccagggccacccagagcagcaagccggttctatgacagctctctttattttttagttacatattttgtttttactcatttcttctttgtttgctcttttactttaataacttctgttaaatttttaatatttggatctgtaaaacatttaaagttctctttcacttcactatgtacaagtatctctgggaatctgttattgaagttttgagaagttgatctcacattttaaaaatagattcagtgtcatctctttatcttgaaaagttcatggtagttgtgagcatctctctaaccacttgaagctattgggttagaggtagctacaattaaatatctgattagccatattgggagagtgggtgaaaacaggttttgtgcatgtggtagatgtgtaggaagctaaggacccaaaaaacaaccacatcataaaatcaagcagaaacacacacacaccacacacacacacagaggctcaaagcataagtgtcaacagatcagaagaaaacatgggagaatgtattttttcataccaaattattaaaattccatcatctaaataacttcctatcatagcatgttgtcgacctcatttttcaaatccataattttagaacttatgtcgtggggtagtctaaaagcctcttgcaaacttttaacatctagtttcaaatcaaaaataatatattaacaagctgtagcatagagggagtacataaattatcatcattgccctgcatgaatagtaattcacaggtttggctcacacacaacttagatgaaataattaactatgtacagtacttaacagtataaaagtaattaatctagctgcctcgtaccggtttggcctaaataaacatgcaataaaaaagccataggattttattatttttttactcacgttactactttagtgtgttggaattttaatatgtcagaagaaagatatctttgcattaaaaaatcattttcttttcaaatgttaatgtactgattataactaagtgaattccatatatttataattgtgggcagatgttctcaattaatagttttattcattctacttcacagtttagtgaaaaggattattttaaattaaggtgtaaataagaacaaatgagatttttattactacaaatcacacagaatttgttggtggtgctataatcctgtgtaggtatagctttggcaaaacatttcagataagcttgttttttgccccatgggttctgggacgaggtgagttgtctgtttgtcctataaggttcagaaaggtaaaagggcaaggtcattaattggctagagggcaacaaagaaggtagttatccctgtgtggtcaagaaaaagtggctcaggttatcttgctcgggagagaaaatgttcattcagctccagtccttttggtaaaagcccactctcagtgtatgagtgttcctttgcctaatcatgtagactataacatgttttcccctatatgactccatcgattaatcattgcagtattatccccacttcataaatgggcaaagaggaggatgaagccgagtagttcttccaaaatcaagtagcatgtaagatgtaggagcaaaactcaaatccagagacttctgcttccagccaagatggaataacagggactagatttacctccccacctaaaacaattttaaaaactggacatacatatgaaacaatggttttcaagagagtggacatcagataacaaagggcagtgatccctggaggataggaaacaaatgacctgggattgtcccagcccactgcctggagggagtttgcaggcatgatacagggatggtacacccaggcagaactcgaggtcctctctgagttaaggacacagagctgggagtccagagaggccaaggaggctagagttcagagtaccagagagttgagagctgcacagagaacccagagatctgcaaatggtaccccttgtgcttcagtgcatgtgggcaaataatcacccaaacgtattagagagaacaagccccagaggtcatcaagagctagaaaatagttgctatttccaccagccacagtggaaagtctcataattcatggagcatcaggtagcatactcagtaggttcttgcctcaggaatgggaaaaatttagccctagactaattgctgctctggtaccacctaagaaaccgtaaaagtcagactcaaaagaattaaattatttgcaagtaactcaactgcttttcagaaaacaactggagaaattttgtaggaatacaaaagcatccaatatccaacaaagtaaaattcacaatgtttagcatccattataaaatcaccaggcatgcgaagaagctggaaagtacaacccataaaaagaaaaaaatgaatagaaacagacccagtcagtaatgacacagatgataggattattacactattacattaaatggttattatgactatttcatatgttcaaaatgcttgatggaagtttgaacatattaaatgaagacatgggagatataaaaaagactgaaattgaacttctagagatgaaaactacaatgtctgagatgaaaacttaaactgagacttcagatgctaagactacatttgtttcacatccccacaacattcttccctggacgctgagtttcctcccagcagctgaatacttcatgcttcatcctttcttaatgctgaactctcagaaaaagtccttcattctaagaagaggcgggagggtgccactctgtagcccctttctcatctcactctggtccctgctggcctggaacagattccactcccttcatgcactgatactccactctagactgagcctcttcatgaggtagccatcaagccatccgcagtcatcaacatggcaccttctgagtcagttacaagagtttgcatcatcagaccaccattttccgtctctgttttctgacttaccccaaaactctagttaaaactcatgaaatattatctcttcacatgaaatacaattaatatggaagtcagcatttttgcatctcccaacgcttcacatccaaggagctgtgtatgaaatcatgaactatgttcttccagccaaccaagcaattaaccaaagtatacatgtccatgttgtccttgtacagagtttgaaatatgctcatgagaattaaactatttttcagtaaatctgaaaaatcaacttgcttgtccaggaagttttattagggatagaatcccaaacaatgaatgtgctagccaagtgttactattaatcagaaatactccatattcatccaggattaatcctgtgtaactccctcagtcagtgtagcaatgtgttctcttcctgcactttttttatgtgtgtgtattcccaaatctgcagtgaatgtatttaggaaatacattagtatcaaaaggacaaatgtagccttaaaacataaatgtacagataatttcctatttgtagcaaagttcacttcagaaacacttgataagaactattcaaaaataaatattttcagtatttatttaaaatattttaaaatgtaaactcctcaccagtcatctagccagggccactgagtgtggctctatgaaatagcttcagtccctttcactactgatgaccttttgaacacaagataatatttgtcgagtaaatgtcaaaatagtataagaatacccaaatcatggattctatgctgtattcactcacatagagacttcactttggagcacttcagagcagcaacagctctaagagatgtaacagtatgctttccaggatagaagaacgaaaagggaaaaataagttgctagcaagaacaatgaggggtaggggtgaagttcaggctgccattctgaaagcttcctcagactgagtcaggcacatctcacgaagtgcagactatgcaagctggctgtgtgagatcaagggtagacagttgactcatcctgtcacatctctgtgttttaccgtaacctccaactattcagccatgaatcgctgcatgtggaatggaagggggaatgtctaacaaacagagacatacttcaagtcttcagtctagttaaaacattggaatgagggtctgcaacatctttctggggcttggagtctcgtctcagttctaaaatgagatggttggcctggatcctaagtttcaaattggcagcctttttaactaaatctaatctagaagagttctgttaggttccacagtgttgggttttaaaatatatatatatattagttgaaaacattttaaaataggatctttcacatgaaatttgaaattttaagtttatattttaaagttagctgttttcccccacctcattacaattggcacagttgactatagctgagaagtgaccccgtggcccccctccaagaaagggggagggccctccattcaccaccatgtccacttcacctatttctcccagcctatatatgtatttgaatatgtgaaccctggaatgcataatgtctagggaccataacaacaatagaatgctatgaatctctgacttacaaggactctcttatgaatctctgacttacaaggactctcttatgaatctctgacttacaaggaaaacaaaagactgtagagaatagtagttcaaccacattttaggttaaaatagactttacttggataacctgacaaccaaaacatctttgataatatagtaattgtgtatgtttaccagacaaagggtatacatgtatattcttgtatttctcttaagaagaaaatcaataaatttgacccatgaatttctttctatagcagacatttttgtgacttcctgactcacaggagatacagctaccctccaaacctaaatcaaaagtccgtaagttgcagaatgactttttatgtaaagagaacatactagtttctgataagatataaagaaaccatgtaatttatctagggaatgactctaagctgatcattgacttatttacacaactatagctactggaatagactgattccaaaaatatattttctctgaattagaatctttttcatatcaaaatatccaaaattattagcatattatgttattctcacaaagtcctaatgaacttcacaaatctgcctgctctattctgagtacaaaaaatatttagcctaatttgtttttccattattttatatagtaataaagtaataccaaaaatgttattgccagaaacaatacagtgttgtataattattagaaagtgaactcatgaaattctattaaaaaacaacaattaccacatgttaagtcagataattcacagaagagacttatatgaatactaggggagctgtaggcaacaaaatttttctctgaatcctgcattttgaaggaagtttctgtcatttaattagttgaggtttgattcaccaaccaaaggtctatagtgtgatatattttcttcctccaacataaagttaacttaaagtcatttgtactttatgtgtttattctttcacttcttccccaaaagtaattctttaaattgctttatgggattaataacaaattatatcattatatatttttgtattattagggcttctaacttcattataatcaatttattggccatatataataatgcaacaaattacatctgtaaagtaaaattttatgacgcaatttacttagtatatgtataagtctcattctgctgcccaggctggagtgcagtggcgcgatcttggctcactgcaaccttcgcctcctcctgggttcaagcgattctcctgcctcagactcccaagtagctgggattacaggcatccgccaccatgcccagctaatttttgtatttttattagagacggggtttcaccatgttggccaggctggtctcaaactcttgacctcaaatgatccacccgcctcagcctcccaaagtgctgggattacatgcatgagccaccacacccggccggagacaggttctccctgacctgtgagactgcaaaggtggtgtttcctatgagtccagccagataatagactctgctaacattaattaaattaatattcctttttaagattctaggtgctgaatatatatctcttggtctataaattagcttcgcacttcagctatttagcaaacttgttttttattgtatctagtgtattcatactgaatgggtataatatactgtcttttgaaaaagttattttgtacacataatcttaaaacactcttccaagggcaaggtagaggcttcataatattatttccatttgtcagatcaatgaaggtttaatgatttgtccaagatctcaatttctagagaagcgaagaagaatcccccaattctagttctaagtttcttttttcccttgctaaatcctgcagtctactgatttttttttttttagacggagtctcgctctgttgcccaggctggagtgcaatggcatgatctcagctcactgcaacttccacctcctgggttcaagtgattctcctacatcagcctcccgagtagatgggattacaggtgcatgccaccatgcctggctaatttttgtatttttagtagagacggggtttcaccatgctggccaggctggtctcgagctcctgaccttgtgatccgcccaccttggcctcccaaagtgctgggattacaggcgtgagccaacatgcctggcctgcagtcaactgatttatgttcatcaccttcttaagttaaattgctcttttactcattgcctttggttttgtgtgttaagattcagcatcagcattcatgatatcttttcactcttaattctgagtgtttccgtccgtttttttaatttttgtactttatgggctttttcttcatttacccccaattatgcgggaaaggctgtgtgcctcttttgaaagctctgatgttctcaatgaagagaccttttaaatgaccttgtttgtcccccaccgagttgcatatcacaacttcaaatgtctcactaaaatgttacccatttggcatcagtatacagaaaaggctgcactctgagataagaaagaacagtggtgttttcatagtaagagaatagagttcttaatgggaaaggggagagtataatttccactgatttagctggtctttcaaactttatgatgcttttctccttgaactagcctataagaaatttgtagggaaaataccacaggaatcaaattttgggcatagatgtctattaatattgctccttacaaagctttttcccagaattgtttctccttgcctacaaaaactactccatgcctttattagtcagaaaagcagttttgtagagaaggcaagtaacagagaatcaagctaagtaagtgaaactctgtaattgtcaaacttccagaaagtaacatttgtaactaagtatggtatctttgtcctctctctttctctcttctctccacttggtttctaatgaaagccttgattacatgttatatttaatgtactgttccacaaagaagaaaaggcctaatgtgaatgcaagctgaatttacacttaaatattgcagtcagttcagaccggaaggatacagatcgatgccctctgatcctgtcagattccccgaagtgtctatggcagtgataccacaagagggcagggtttgacttccggactaggtggcttcctcccttcagtgcagaccttggggccacgacaacagccatcaatctcttgaaaccctaatgatgaatctgagctcaaattccctcttcagccttatctgtgcagaatcctgaagttatgaaaaatgcttacagaaggtaatttctagaatgatctaacacagcagatatttagtaaactccctgtttgagagctcctactaagcacccaacacagctttagactttggtcacccaataggattttatcttttgtgagggatctgtagttttccccggaagatataatgcatgaaataaaagcctccaataaaattcagtatacagttaatttatttcataaaaggtgagagatataaattatcaaaggttaaaacaaaaagtaggaaccagagcagggtttttcagtagcaactctattgacattttggattagataattttttggtgtgggagactgtcccacgcattgtaaaatggttagcagtatcacttgtctgcctgctagatgctagtaataccccccacacctccctctcccacattgggaaaatcaaaaatgtctcgagacattgccaaatatccctggagtacaaaatcagtctaattgagaggcactagactggagtataaagagatgaccatgccaaaaagtaaaaataataataatagagccttgaaacattacttacagaatgtcaaaaacgtaaggacctgctctctattcctgtttcttaacctgagcaatgggaataatgatgccttccctcataggtctcttgtagaaatgaaagcaattaatgcaacacttggcacatagtaagcatccaatgaataataagtgatcagtgttactattgctaatattaagccactattataagtcctttctgttaatcagcagaaacaaaaagaagtataaaataatggtacattaaatgaacttaaacacttgtatgtcattttgtgctaaagttatgaagctgaaaagattgaattgacattttccccattgatagaaatcatctcaaaaatgctccatcttccttgtgaaagccaaaggccagcagtttccacatacccagcatctgataagtagttaatgatccagaaataaactgttaggtgcttcagggaatttctgtgtatagagaagttccatgtaaatatttctccgagaggtggatggagaatgataattcacttttaccctctgaatttgatttataagcttcacctatctggcaggagataagaaccaaagttaactgaggagaaaaaaaataaatgatttcaagtgaccatgatcttcagctggaaccagttgaaactgcaaagcaactgggctgaagaagttcagccaaaattatttgtttataaaaactagagagtgttagatatttctatcacattggcttatttgaaatttctgctggctcaaatgaaattgtattcttctatttcctactgcggggttccttccctaaccacaattgcttttggattggagacttgtaactttgagaacaagagcctcagcttagctagctggaagaaccagaggagagttttaatatctcctgaagaaagaaaagcactaacacggttattatagttcaggacaagtggagtcaaagttgacagtttctgacttgaacagttttgttgctggtaataaaagcagaagtcacgtgctgaacgtgaaggtgagcagaggagaacttgcgatggcaaagttaaaaacaagaggagatgatggtcttggtgtggcacaggatgttaaaaaaattctcctgtccttaaggagttactgctatttgagtaatgtgccacttccctacatagccttctatgcagaaatgctatatttccacttcacaacccagaacgtgcattttattttacatttagaggaggaacaaacaaccagaaggcaaaaactggtgcattattttttgcaattctcttggaaagagttcgtttttaacttctgctcagacagcacacaactactgggaatatattttaatttcaaatctgatgtgtgacatctggtaactcatttattgctaatgaagttttcacaggaagcagcagtcaccagtagctcatcttatttttcagttggcaaagtgttgtttaccttttattggcctggcatcggtgtctcttatcacaggatatttaattagaaaacgcaagtagcctaacatagaaaagaaatggagtggtagataatagtagatagaatggtctaaatatttttattacagtgatgtaatatcactgtaatttatgtttaaaaattatgtaatactcaaaaggaattctcagagctggcgaaacagtctggtccaagcagcctctcagcagtgcctttcagcctcccctctctgagtctttccaccccttgctggtactttagtttcttccacttctagcaccacgtgtagtttcccaatttctcttacccaaatttgctcgcagggaaaaaaataaattaaattagccatttacaccacagtgtgaacttaataacaccaacaaaagttccaaagctctagggtctcatagcacctccagatccatgatctcattcggtgtttccaacaatgttttgcaccaaactggacacatgcttgctacttcatcatcctcatcgtgaacattattattattatcatcattttccagatgaagaaaatgaatcacaagtcaactgacagtccaaaggctccacagctcagaggaggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtaagtttctcatattcagtttttgatgcttcataaatgttaaatgaaaacattttagctgagggtacttttgttgtttgttggattggttttgcctgttcatcaggattatcagcatttaagccagagttgcaaattaagttgcctacagggcagtgcttttcaaatattagtgtgtatcagaattacctggagggctcattaaaaacagcttgccgaaccccacccacagagtttctgattcagtaggtctgtggtggggccagagatttacatctctaacaaatttctgggtgatgctgatgctgttgtttcagggaccacactttcagaaccattgctagaggggccaactaggggacgtctgtgagtaaaagcacctacactgtgcttccagtacagcagccagccccagtgtgatgagcacttgaaatgtcgctagtgtaactgaggtgtcctggaagcatacattataccctgggttttgaagacatggtacaaaaaatgtaaaatatcttaataattttatatggattacatgttgaaatgacaatagtttggatatattggattaaatattttatcaaaattaattttacctgttcctttttacatgtcaaatgtttttaatagaaaaattacaattatatatgtgtctcactttctatttcttttggacagcactgaactaaagaaccagaaaatagaggggtgtattagtgaactacagaaaattcaagtcccaaaagctgtaaatactctgaggaccaaagaaaatatatacgttgttcagatttgccctgaggggtcagtttgtacccaaacatttgctgccacaagtagtaaatgtagaagcaatccaatatctactattttacttttctttcagggttaatcaagtgccttgttataattcttcaaactaaaaacattattataataatgaaaaatatttctgctgaacttccgaataaaaaaatttagtaatattttgaaagtctgagctttatttaattcattttacttacccttgtattatagaacaattatatttttaaaaatgcttttatgtcttccaaagaactttttatttttagcagtccatgaaatagaggtgagaacaggtgttggtattctcattctaaatatcttgtaatatttaaaggaaaccaaagtgaaagattaaattgccatgtaagattgtgttgccggttactggcagagcagactctttgccaggacagcagtccagtgctttctcttccaggctgttctgctcttcctcaatttttacagcatttttatgttaatcaatcaataaataaaaagtaaagaactataatgcatacaaaactgtgatggaagaaaaggaaactatgtgataaaatcaaataaatatgacccttatagctttagttttcttagaacagaggccctttaacttcagaatgttgaaaccttctcttgaagttctcttataatactctgccctcacctctgtgtttttatctgggcaattagaccacattaactaattgctaaactttaaaaagttgtattttcttacaaagaatctgagaatagggttgattttctatgttattttaacagtatcacattgcgcccccctcttcacaggaccatgtaatcttgactctctaacttcatggcaagcttttaattttgattttcaaccatgttccaaactgtactctttgacttggtagtgtcaataaataacgtaagggatgtctgacaggcttacagcctttggccataaatggaatgaaacaaagtagtccagatagggctcaaactcataacattgacctcgttagtctagaaccacaaccagctatccaaatgtgcctgggaaatatttctttgagtaatagttaattttttaaaagaaagaaaaaaacctgtgactatgataatcttatgttgagtttctttattcatcttgagtaaacagtaaatttttttcactttgttgtttcaatacaaagagttcttgtgtttaatatagaatattattaaattagtgtgggattaaaaatatttagatagctgatttaacaatatgtgatagcattaatcaactgccttgttataattcttgaaattgttattactctacttgtcaagcaattttgcccttctcgtcaaatgatgcatacctgttcaatggaaggattataaaagttcatgcttcggaaaattttttttttttttttttttttttttttgagacggagtctcgctctgtcgcccaggctggagtgcagtggcgggatctcggctcactgcaagctctgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccggaaaatttttttaagagtataaccaactccccgaggatacaggggtccagggaagctaaatgactgcttcaaggtcacccagccagtgagtgggaaagctaaaattagaacctcagtccgctcccacattttccaccaatttgcaggctatcgttaaagaatatttcttctgcaatcagaacattgagcaatttggaaaaacgtgtacagtatatcgaatattctagcttcatttaaaatttatggttatgtggcttgtataatgttaaaagctttaatctaaaatgaattgccatgtggccaataaccccaacataatactcataatgcatataaattctctaatattatcataatttcttaagggtacaaattaattagtacctcttttcctgcccaataactttcctcacaccccttaaaatggaatttgaaatgagataaacagttgctgctgctgaattaaagtttcaaagaaataaaagtgaggtggcttcatatacaaaatctgtagtttttttcacaaattggatgaagcaattgttattgactaagcccatattggtgctgcccttttctctgttgaaaagaaaagcttgtgagtagtctccaagagccatattattaaaaatgatgtttcctccccatgatggctgagatactaatccattgaaatgtggcgataattcttgtgagaaaattctatgagtctataagtttgaagaatttagaagtgtaagaggacaggggttcatttacttacaggccttcttccaagttaggttttattttccttttctcctagtctctggagtctcctctctccagacaccctggaaagccattcatggcctttcatatttaacataagagtatttaatactaacactaacatgtcgaaggaagatgtttaaagcatgtgaattagacttgatcatatatgtttcattggcacctgtttctctactttttggaataaaataaaaacgacaaaaacagctaagaattttggatagtgatgtgggtgggagggattggggcattcatcacaactgagttgtttaatttatagtaagtgggaacttttagagttgagagaagtttaattgtagtttagagtttcattattagacagtagtcttaaacaattcccaagaagctaaaatgtgggattaacattttactttcattgtaattcatatcctaaatataaatgttaatataaattataaagtttctgaatttcctttcataaaactgggttctttgggttcttagttattttggatgaaacaaggggagggctagttggaaatgatggaacatttaaccactgtcaccacagttagtcacaattggtacatgcagaattaataaagcagcttgccttgtttttatttcttgtgaggtcagatgacagtggatgatattgacttgggaagatggccagaagccactatttaccatgtacatatatcagagagccatttattaagtttgaggagattggatcttaagtacttaattagaatgacattaataattttaataaaatgttttgcattgagagaactattcactcagaaatagcaggggtgaacaaaatcatctccaaagaaatcatttaacatgaagttagtctaggattaccaaccaagagcatggcattctcccatgtatctgacttaaaagcaatacttgtctcttgccccatggtgccaggtggtctgccatgcttccctcttcgtggctgccaggattcccggtatagaggcaaatacaacctgtaaaggctcaaacgcttcatcaaaagccatgactataatccaaagctattaggtttaagcaacttatttggaaattatcaccttcaaataacatgtagggcaacctcagtagagatgaaatggacgaagcaggcatggaaactgcccttcctgccttaaatacagaatgccagatcacagctctgaataaaagttaagaccacattgggccagatcaggactaacactagatacacagctgagataaagttccagtgactttggcagtgtgaaagtcaggaccagtaggcacatatactgaaggcaatttaagctgtgtttcctgattaaagccagggactgaaaaatcactacctattcatgatgaaagactagaaaacttctgaagaccagacagagtttcagagtggtatagttactaatctactaaatactgcaaatatatagtatctgcaaatatatatataaggttgaaaactaagctcagaaatgagcattaaaaacttttccagatcaagggagtgctgtacccccaagctgaggtttcataggctaccatcatccaggcactcagtcttcccaagcaagttaattcccaccaaaaatgaacacagtcaaagattacaaaacctaagcagaagtccattatcaagaaacagtgtccacaagtgcaataaatataatttatacctgaggaactataaatagtaaagcaattgggtaggggctcttaacagacagatattcaaaatgttaaggaaaataaaagaagaagtagacttcgtaaaataggaacagagggctaagaaataagaacaagtagatctgaaaaagaaacgagtaaaaagcctagaaatattagtgccaatttctatgggtcaatgatttcacaagtgaatagctaacagttatttcctgtggccttacttggcagagagaggtgggggaagcaacataggagcagaaacagttcctttctaagtctgacttataaaataggaacaataaagacaacagtttattgaacaggatggtttattgagctgtccagcactataagcaaatggcttacaaacattttcctactctttttgatgcttgagagagatactttgatagaagattattccaaaatataattacttggtcatttagttctctctttattatcataggaaactatggggaatttttttttctttagattgcaaactagttttaaaaagagcttgtaatgaacaatttaattagattggttttggcttgcctaaaagcttaagaaggtattaatattctaatcaaaagtcttgggaaagcattcttagaataaaaaaaggaaagaaaatcttcattcttatgctttaagaaccaggaaagctgtcaaaggatataaggtaactcttacaaaagcaattgtaaaataaacgtggtttggccacaatgagccaacacctatgtttgccacagacttagattcccacctcactcatggcaaatttattcagctgcttaagattattttttactcatacttcgaaagaacaacagcctggaatttttagacttttaatggcaatggaaggaacttacctatgataaacatttttctttactctcacgctttcttaacccatggctgttctgagtcaatgtttgccttgcattcaaaaaataatagtaaagattcaagtaaaacatattcattaagcactatttgaaagatataccaagtgctttaacattatctcactttattcctacaaagatcatgtgcaataaatatcactgttcatgtttcctacagatgaaaaaaaactgagggtcatgttcagagaaattggatgacttacccagagccacacagatttgtacgtggcaaaggaggattccatttcaagtctttcaaccccaaattcatcttcctttctctaaggggaaatggtgctatggaattcatgtaagccacagagcttggataaaaggaatagtaagaccaaaaataggaaaagtaggaagaggtggatcctcctatgtttttaatcagggttctatctacctgtaactcttctgggaaaagaagcaggatgtgactgaaacatagctgctttctagatctcacaaatctggcttttctagtcaatcacatctctctctccttcggcttctcaccaaaccagcatccgttcagcttcaaagaaaaaagagccctactgtttcccactcatttatcatcaatctaaagtaactgccaatcacaaaagtcccatctttatttctttccttagaaacaaatttctctagggaagcttatcagtagcagaagtgcagactgggaaatggcctatgtcaccctcccatctagaaatgcccagtgcacatccagatcccacacccccaagagcgttgtgcaatatctgttaatttatgagagctgtttcccatagatgatgctgcaggcattagtaaggagggcaaagttcaagtgatgacaccatctctactccacctggctggtttccaggtgccatctcctgatccctctccccacccccactgccctctcaccatccttcccccaaaccccacactccccaccaatctgggtcagtgataaacacagagtattccacatgcctctgatatgatgtaacattcgacacactaaagataatactgcctttaaggctcctgtccccctggctagacttaaactgtgtagaggaggagaactgtgactttattccccttgcatcctggacacccacacatggtaggtgttcagtgaatatgtgatgagttggtgaatacccactgaatgtgctatttgcattgctacttccttgtgcttccttccactgtttctatcgcctaaaattcttctccctttttcctccaccctcgagtaggaaaaaatttgtttctttattgggcagggagttctggtcattatacatttatgtaaaatgttcttctaattggcatattccatgctatgtccagattctttcaagcgaattctcattaaggtaataatacctcaccgaagtttccagggatgatcccctagctgttcaaagctaccttttatatattaaataccagtcaatatgaatcaatggtaactgaaaaaaaggctgatagcttgtgaaggagttggagtacaaaactatgcctataaattgatcctcacaaaggcagactttttcccacagaaattgtattatgaatgctagttatagtttgagactagttaataaaattctactcactccaaacataggattaatggaacccacatgagttgtgtgctgtcaaagtcgagtcaagaggagagagaaggagaagaaaatttcctccctgttctcatagctcagggcacccaagggattctagagcgtaaagtgtactcccttctattttttactgcccttattcccaagctgaaccaaatatttacctctgccctcattttcagttatggagttcactcaggcccttttcaaccttcgaggttccttaacctttacattattaattctttttctaagcaaaatccagctgatctctactagatggttaaaaggatagtaaataggtaaattaatccacattaagccacaaatgactgctagccctaaccctttaatgactaattaatttttaataaagaatatgtgtctatataaatgaatttatacttctaagttggcataagttcagaaaaaatagtaagatgaactggaaaatctacaaggtatagggaaatcctctgggtgaggaagaactagtcatacctccctaaaagcctagccctagtttctgttacattatttcttcttttcatcttctgttttctaaaccacaagtttctaaaagcaccaaggaattttctacctgtttatttcgttttgtttttgtttctgtttttttgtccaaggtgaggcccaagttgacactgagtattctctgtgaaactctgcaaggagcaacatgtgatttcacagaaattagtctcgatacactatattcatggctgtaagttctatgctgctcacccattcatttgtccattcagtcactcattcatgagacatttatcatctgcctcctggaacataccagggcctacaccagaaaacaaggaaacaagtaaacactagtaaactttaaacaggctctccccacaagcaactgacagaccagtggagaagacagatatgtcaacagatgattacaataaagtttcaaggccgggtgcggtggctcacgcctgtaattccaacattttgggaggccaaggcgggtggatcacccgaagtcaggagttcaagagcagcctggccaacatggcaaaaccccgtctctactaaaaataaaaaaattagctgggcatgatggtacacactggtagtcccagctactagggaagctgaggcatgagaatcacttgaacctgggaggtagagatcgcagtgagccaagatcgcaccactgcactccagcctgggcaatacagtgacactctgtctcagaaaaaaaaaaaaaaagtgtcaaacctacatccaaaatgtcaaagtgctcaaaaaagttgggaaggcttcaccaaagatgtgacatttagggtagataacacctgtttgtggatactaatgtcctggtgagtcaaagaagaaaaggatgtacattatataagctggatgcaaaaaggaacaataatgaggacatgcaaccaaaaacttacatagggagaacaactttacttactcagggaaggcaaagagaccacttaagaactccttcacatgtgttatgtcttaaaagctgactactggagttgtatcccttgcacagcatccctttgcaccaaagtgaacactactctaagaacatgtgttcagctctcctgaatgccaagcacaaccatgcttggcatggcagtggtgtcttatttctgctcctctttttccccagggcatgccattgcaagagaatgctcagccatgttcatctggggacctgctcctggtagagcaataggatctgtgtgcccagcaccactgcccacctagctgtcctggcctgtgcccaatgctgaccttcacctcagagtgtggctgtaccacattcggtgatgtcactctcactgaaccttcagcctccttcctgggacttcctgatggactgttatccagggcagaatgtgttgattttctaaatcacataaatgaatagcttgactgttgattatgtagaaaatcagagcaaatatttgcatggctttgtgcagcccattcttgagcatctgattctccccagaattctaaaaaacctgctgctttctcaagccctcagtaaagacatgctttcttgataatcctagccaaacctattcatttgacatctttgttacacaaatggttaaccacagagttaacttcagaaatggctggcaggtatgaaggttagaagattcatgcacttttgctagactgaattggaagttaaagagtaagtagttactgactgcagaggcctggaaaaccatggaaaaaatcctattcctcaaagtcgagccctacctcctacgcctcttaaatcaattgccacagtgaccaatttgtcagtcacctaaaggcagctatcctgaccacttaagggagaatacttataatctttatacctaagtaaagattgtgagaggaaagaaatggtttaaagaatatgaatgtgtcacacttctgaggttaatgataaatgaattggtcctgcttacctcaggaaaaactttcaagtctttctgaaaaactaatttaattcagtagtattttctaagatttaggttatgtttttaatcaatttggaaaccaagatttacttatagaaaaaaaggaaaaggacctagataggtttattcacatagaatcccaatttcacttctctggatgataccattttctacaaaagcaattatgttctaaaatttaagtgtgctttcttaggctttatcagttcacagtgtttccttaagaaatatgatccagtattttttcctaagactaaagttgagttactacgtttatgactgagaaatgaatgtttgttagtttgtttgtttacaataagaattttttctttaccattttatttttattttccccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgc

SEQ ID NO: 36746 - DNA, 32053 bp, Homo sapiens
gaggctgcggcctacagccggggagaggccagcccggcctacagtgcggacacaggacagaggggagccaggtgagccaggtttttgggcagggagggactgggagaccccagaggagagggctgcccccatgatgaccctgtccgcagctccgagagaccctgagcaaggctttcttcactgggcacctcctgcaaatcaggccctgcactaagtgttagggtcacggcatgacagtgacaaagatcccggccctcttgcagtttctgtgttagtagcagggagatggaagtaaacaaaaacatatgaaatgagtaaatgatctcaaatgtcagaaggggataagtgaaaagagaaaaaggagagcagagtgaggaggacagggaatgccgggggagggggcttggggttttaaagagggtggcctctttaaggttaaatgaggttcaatgcaaaaagccctagtgacatttgaagaaagggtgttctgggcagatggagatgccctagcaaatgctggcagtggcagggaggcctggagcattcagaacagcaaggaggcagtggcagcagagcaaggaaaagaggtaaggcaggacgagaggagccgcactaggggcacttgcaggactccggggggcagaggatggggccccttgccagcacccccacagccctgctgggggtattggtttgaaagcctcatatgaatcatttgctacatgtggttgcatgacccttataaagtctcctccctttccaaggcccacatcctctccataaaatggtaataacagcagtgcatctgtcaggttgaggtcaggaaggaaggggatcaaaagcatggcagcctgccggagagatttacaacatacctgctgcaagctaggaaatgcagagctggcctcccaggccttgtgggaggaacatgtaagcaaataagaacttgtccctaaccctagagcacccagggaacgagggagctgaactttgttcagagagaacagcaggggcaaagggtaggaagagaatgagtggaggccagggatgagggcagtaagttgacataggagagaggtgagtggagtagggttgggtagacacagcaaggactccattccacaaacagtgggccccaaggagcagattccaagcaggagaggaaaacaatgtgatttgcagttcaagagttcacctggcagctgggagaacaaataagaggaacactgaggccaagtaagagataacagtggcctggatgctagccaaagagatagcaaggagcagatggactcaagagacttgtgaaataggatggactgcacctcatggttgcctcactgtggaggaataggggcttctcagaggccaagcacttgccatgaaggagacagggtccaacctgggtatgaaagacactcaggggctccaggggaacacttcacaggcaggaagaaggcttcctcccttcagttccacaatatacctgcagggctcatagaaatggagctgagtgatcctagaacttatgagcagtttaatgagaccaaggtgcccccagcaatcctccacagtggagctgtagtatggacaagtcatgtgctttgtggtcagaccccatccaactcctggccatctccagctgtgtggctaggggccactcaacctctccaggattattttcttcaggtgtaagcttcactgacttttttgtgaagatttccctaggcaattcatgtaactcaaactgcagtggatagagcccaatctttggggtcaggccctgtccaattttggctaacaagtattgaacaaacatgtaccaagcaatggctgcataccatgcctaccatgcacacagtgcctggtccacagccagtgtccacagggggagtggggaggtggagtggcattcaggtacttagggatgtctttcttctaccaaccagccctggctgacacccagccctaggcagttcctcttgcacacaggttctttgcactgaccaatgctgagagcagaccctcggagcagccgggttggaagtgtctctccatagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttggtaaggggaagctggggaatgggacatctgttttatgccccatgcttctcttgtaagaagagtccttcattagcagttctgcttccaaataacaaactttgcccttgaaattccactgttagagattcattccttcgaactgtaaagacaatcttcacatgtcaatattgcctgagcccacctaggggatagaagagtcctaggcagcagaagacctggattctggtcctaaaattctgccactgcatagctttgtaaccttgggcaattcactttcccaccttggtcctcagttttgtcatctgtaaaataacaataatgtctgacttcctttccagatccatgaagcaagtgggtgagaagatttcaaggtgccagaaacctcacccaggtccctaagccctctgttctctgtcctctgcagagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacaggtgctcactcctcgagcagccccactagagagggatctacctgggatcacctggaaaccccctagccccatgagccatttcccccaacaaagggaagacttgttgggaaaccaggatgctaggtgccctttatctcctgtactctgctcaggcagggggtacctgggcccctgtctccaataagctactcaactacagcatctctccccaacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatggtgagctaggactgctgcgtgtggtgtttaggttgtgcactgcaaaactccagagggcccatttacatctaggtagtcataggttcatatgctccgagggacatatgtttaataagaaaacattccagcagctggcagtcaagggtcctgaggaaggggtgccaccttctaatttgcacgtattgtatgagctcccagtggggcaagtcattccttctggaaacatcagcagccaccccttctcatggactggctataggggactgtgtgtcccacacacagcccacagatgaaaggggagaactgcctgcaagtacagctgggagctgggccccactccatactgcgctgatgcctaagagttcagacccacctagaagcagcttcacaggtaagaaccccacctcaggccaatgtctaacacctctccttgatcctaagggacatatcttcagggcctggagactgaagccacctatgacgcagccacccaggagtttgtgatacacagccccacgctgactgccaccaaatggtggcctggagactgtgagtatacatccaccccccttccttaactctccccaagtagaagaatgttggagggcagagtagcactggctttgaggtccaacagacctcagattgattttctgttctaggctgctgaccttgggcaagtcagttcaccaacctgagcctcaggttcttactctgtaaaataggtgggatattaaacatttcattagtgagtggctggaaagtccccaaaggaactttgaagtagaggagacaatcgatccatgagagacaaggcctcactcacacacacacgcacaaacacacacacttggtctagtcctaggcactcctcacaaccccggttcctctcatctcccgagttagtggcagagcttgccaccagccagagcacaggccctgtgatgacacagtggaaagaatacgcctgcctgcccctgctgcagacacccaggaaggctcacgcccatcaccagcccccatcaggccaccaacgccgtacctcctgctgtggccaccaggtggcggccacatcaagcgtccctgaggcttggtgatttaccaagccccaacgagggatttccccttcctcaaacttgagaatttcacctccaaggacacatctgtggcacttggggacccacaccttgtgtggaaaaaattaaaacaaatatgctgagcccaactaaagcaggagagtgacagagatgagagacacatagagagagggagacacaggcagagaccagagacataagagagagacatgagccgggtgcggtggctcatgcctataatcccagcactttgggatgccgaggtgagtggatcacctgaggtcaggagtttgaaccagcctgaccaatatcattaaacctcatctctactaaaaatacaaaaattagtcgtgtgtggtggcgggcatctgtagtcccacctactcgggaggctgagacaggagaattgcttgaacctgggaggcagaggctgcaatgagccgagctcaggccattgcactccagcctggcgaaagagtgagactctgtctcaaaaacaaaagaaagaaagaaagaagaaaaagaaaaaaaaagagagagagagatgagagagtgatgacagaaagagagagagaaaataaatgaccactgtcaaaaatgaagacaaaagaaaccagccttttagatcagacagaccagggtacagatgaatcctagctctgcccctccaggccaatgaccttcagtgtgtcactctactctctgagcctgtttccttaactggaaaatgggactcatcatcctctctcccctgcaagaactggaaagcatctatcacagggtctagcgccacctagattttgataaatgataattatctgtattcattattataaggttgatgacagagtaattcattaatagttggggggggcaaaaaaaaagctggatcatttcacagtgcctttgccaacgctgctaggtttgcttggttctttgggggcaatcccctctctctttgatcagtgacttttcagggccccagaggtacccatccaaaaccccagccccaggaggctgggttggttgggaaaagcaatgcacaggtcttcctgtgacgggccgctactctctctgccctcagtgggacggtcagccacccatgccctggtccaggcccagctgatctgctcaggagccaggcggggcatgcacgcttttattgtgccaatccggagtcttcaggaccacaccccactgccaggtaagcccataatgctccctcaaggaaccctgccaggaggagagcccaggtggcctccctgacctggggccccagagggccacaggagtagctaagacatgtctcccttgggcagggagcggtccagttggacagacttggtgctaactggctaggtgaacttgagcaagatttagcatctttctgacctcagcttgttcacctgcaaaataggtacaataatcccagtgtcacaggctgctgtgacctggaatgtgtgtatgatacctgccacatagcaagcactctctcaactgataggtgtcctcatctccatctccttcaaggaatcatcattggggacatcggacccaagatggactttgatcaaacagacaatggcttcctgcagctgaaccatgtgcgggtccccagggagaacatgctgagtcgctttgcacaggttacagatctggggaggccggggacttgtacttcctggagaggggacctgcgctttgtgcaggctgggcctgggtcctccatagagcttagtttgggccacataacctcctcccccaagagaggctctgatatcccacagattggggtgaaacccctgcttaggagcagtatgatcttgggcacagagcctcagacctctcatgcagaaatgctcgtcacataggctgacagagcaatcgtggggtggggtggcagccccaggagaggatagggctgaggtgacctgcataatatttacccacagtgaggcctgacacagccaatcgcccaacagataccagccagaatgccagcaggagttctgaaggtcccaattctgccaggcatcacccctttagttatgggtcgtggggaggtccggggtgtcccaggagaggcactgtgaagcagggcacttggggaaatggcctggtattttaacactccaactccagatgcgccggttgaggggcgaggtgccctccatgtgtggagccccacagctctggagaagcgagggcatcctgggaagccttggcccagaacttgtgcccgtccttgttccacacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccaggcaaggggtgcccagtgactgactaccgcagatatgctgcctcttggtcccacagtgcctccccctgacaccacccttctgccagagccagagtgctgggagcaggcaatgccccccaccacatacacacacacaaacacaaaatctacccagcctggccccatctgggcatgtcagaggagtctctctggctgcctctaacagggctgaccagccggcctaacctgcatcctcagtgcctggcccccatcgggctctatgtgatagtgtctttggccctgtagcaccaggtctgtctgactctgtgtctgtccgagtccagccgtgttctgtgcggctgtgacgggttggacgggtctgggtcagccagttgccagctgcatcagactatggctggctgagttgattctgtcaggccgagcctagcaaaatccaatatcatatcgactgtgtgtggctgagctcgttctgtccagctgtgctgtcagcatcccactggtatgtctagtctggatcccttttgttgtaattggttgtgttgctaccactccctccaccccacagcacagaatagcaagggctgcctgaaccctctgtgaacactcagctcggccatttcacttcatccctcagcttcctcagctacaaaatgggtgtggcagaagtggcctttcagtgtggtgtggagggtgaaatgcagtaaggcacattaagtcctcagcccagggtcctttcctctggcaagctcacagcgccctcgcctggcctgggcttcagaatctgggctgcaagagttctctggaggacagggccactgggaagaaggggcttctgctgctgtcctgcccgaggcccatttatctgggctgcagaagtgtccccagggtggttataagaaagatgcgccaggtaagcagctgctgtctgtagaggaggcttcttgtaatcacatcctctttcaatccagttactgcgagctcctaaatgccggacatagccttgggcactgaggacatagcagcggataaggcagacacagtcccttccttggggttccatcagacctgagtttacatcctaagagttattgtttaggcttgacatattcctcagcgcgcggcaagtgcacacgggcagtggaaggtcacaggttcaaatcatcacaggtgcagggccacaactcttcacctgaaatcttgggaccagacgtgttggagtctcagaacttttcaggttttaggataatactgtgtatatgctggaattctataagcctcccttaacaaggggcagtacccaccaacaaatgtgtcagtattcctgcagtgaaatgtgtggatgttcatgttagatgggatttttaaaggattatcaatggcctcatgtcagttcaagttttgcaatgagttctaaggaactgtctgtttttaaggtttttatggtgtcggggataggggaaggtggacacaacaggtagtgatctaaatcttctggttcttttcccttcagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgaggtacctgctgtctgcggaggggcaggcgctggcaggcgctgggagctaagattgttccactcactggggagcagccacagccccatccccatgggcactccccacccccacctctcccagctttcagcatcccagggcgtctgggtgaacggcaccctggtatataaatttacccacaaccagcccccagagagctacaaacatactaagagaaaacaatcacacctagcgtagagaacacaggtccacaacccctgatgtgtatttgaaacctgaaaagctccgaaaaacagttgtttggaactcatttggtggcatagtttgacctgaactgacctgatttatccctctgagtgtgaatacattttgcagtaaaattattaatgtgtttaatcactaaagctgccccaaaccccactggggctattatataaaatgcactttaaatgccacttggcctctctataatccaaaagttactctgattcctaaacacatctggctcacaggtctcaggtaaagcattgtggacttacatatatagtaaaattcagtctgtccaggctaccatgctttataagcactgctcattaacccttccaactgcaatgaggcacagagagatcaagggacataactttcctcccaaggacttgaaagctccaaagataggcagggtcttcaagaaccaaaatctgaaagcagtcctgctgcccagcagcctctgtcctgttggggccactgtaacaaaataccataaagcagtggtttataaacaacagaaattggcctggcatggtgacttacacctgtaatctcagcactttgggaggccagggcaggaggattgcttgagcccaggagttcaagacaagaccagcctgagcaagatggtgagacccccgtctccacaaaaaaaaaaaaaaatgaaaaattagtcaggtgtggtagcacacacctgtagtcccaactactactttggaggctgaggtgggaggattccttgagcccaggagtgcaaggatgcagtgagctgtgattgtgccactgcactccagtccagcctgagcagcagagtgagacgctgtctcaaaaaagaaaaacaaacaaatttattgctcacagttctggaggctgggaagtccaaggtcaaggcactagtgcatttggtgtcaggtgagggcctgcttcctgaacggctttttgctgtgtcctcaaatggtagaagcagcctctttctttcttttttttttttttcctgagacagtctcactctgtcacccaggctggagtgcagtggtacaatcttggctcactgcaacctccgcctcccaggttcaagagattctcctgcctcagcctcctgtgtagctgggactacaagtgcacgccaccacgcccagctaatttttgtatttttagtagagacggggtttcactatgttggccaggatggcctcgatctcctgacctcgtgatccacctgccttggcctcccaaagtgctgggattgcaggtgtgagccaccacacccagccagaagcagcctctttcatgagggcactgatcccattcatgaggcctccaccctcatgacttaattacctcctgaaggccccaactcctactaccatcataatacctcctaatcctagtcctaatcatcaatacctcctaatcctagccctaacccttgagggttaggatttctacataagaattttaggtggacacattcagaccctgtcaccctcctacaacccagtaagtgggcttacagtggacacccatcctcataagctagctttctaaaacccaggccagcaaaatccgtaactcctggaggtttgtgggcccaatccaggcagcaccctcttcccaatcctggagacactggccaggccaggttttccttcactcttatgcccctacagctacattgcctaattgtgtgcctctgggtgagtcacataagctgagtacccgccttctcattcataaagttgtgagcagaggaaacacttcttacctcagagctgagctgggcatgagtagatgctcagtaagtggtgcacagggttggtccctatggtggaggccccctaacaccgcccaacccccctccatgttctcacagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggtaaggtccaggctgacccaggcctttgcccaagcccttggggacccaccaagcttctgttgggtggagggttccgtctgaggcccataaaaagagcaggctttgcgaagtgctatttgggagctgtccaattccccagtatgactaacctatccacttctaggccaccatcctctctcacctccaccacagcctcagacccctccctggtctcttgcttctatcctgtcctgcttctccacaggcagccggagggatctgttcagagcctagggaggatcacatctttctctggtttgaaattcttcaacggcttcccagtgctcataggaaaatgacatattctatgctgtggcctgcaaggtccatgtgacctgacccctgcctccccgtccatcctgctctcaccacctcctgcctctgctcacttcttcttcttctttttttttttgagatggagtctcactgtcacccaggctggagtgcagtggtgcaatctcggctcactgcaacctctgcccgccgggttcaagcaattctcctgccttagcctccgcagtagctgggattacacaccaccatgcccatctaatttttgtatttttagtagagatggggtttcaccatgttggccaggctgctctccaactcctgacctcaggtgatccacctgccttagcctcccaaagtgctgggattacaggcacaagccaccgcacccagccacctctgctcacttctgccggccacacacttctttctgtccaggaggcctttgcatttgatcccctcccacccaacatggccttgtttcctttggagcagtttcacaatctatcattgtctcatttttttgttcacctttttagctctactctccaactagattaggagctccctgagggcagggactacccctaccttgctcgctttagcatcgcctaagcttggtgcagagcctgcacacagaggctccaagcaatggccaagtcagcttcctccacacaggcgatttcttttcatccctcttaggtctgtgggccctggaggccgacagagcctcatcctcacctattctcaggtgaacaaacagggcaaatgcttccctatgcaaggagaaagaagttcactggcaaatatgaaaaacaacatttattatatttttaaaaatatataacatcccttggtttttttccaaattagaaaaggagtacaatagcacatattatgtactctgcactgtgccaagcactctacaaatatcatctcattccatttcacaaaccctcaatcagatgagaactgtcctccccacctagagctagagaaacagagacttgggaggtgaagcttctttcatcacacaggtctcggcgaggctgtatgggaatccagggctgtctaagcccagaacctgtaaccactggattatcctaaagcagcagttgagagtcacctataatcctcctactcctgttagcattcttgcctctatccttcttttttcagctaagaaaatttaatttccacccagtcactgtacaagtcattataaatcccaaaatcacagtgttctgatggaaaattctgtttgctcagatcacagaagggtttatgttcaggatcagagagtgtctggcccagctccacaggtcctgggatatgcctgactgagggcctcgaggcaggacggcccgagggggaaccctcaggagggaggccaggcagaggcctggtgacctggctctcccacgggaaggctggaacctagcatgagcttgcctgtctctgggagtgaggggtgctgggctgtctcacagagtctctgccctctcacctgcctcctcttccaacccccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggtaagccagtgctgagaaatcagccatcccacctgggcacaggctccatgccacactagggcctttggattggttgggtggacattcgtggattcagttctaaaaaccaccccatgcctagcctccccggtcctctcagttcctgccaccatgggcagagagaggggatgtcccccccatcagccatggacccccgtcacttccccatcctggtcacagtagtagaaggacatcacacctctggccagtgagatatttttaaaatctctagggtcctatggtgatttgcaatacaacgaatgtacccatatgtaaatactccaaatgtattgatatgcaaataccaataaataaagcaatactcactcgtacgtttgaaatatcccataatctaaaaataatttttgaaaatatgactacaccacgggatagaattcatttatttccagggtctagtaggctccagggaacatggacaaaaccaaggactcatccattctgtcattcaacaaatattgttcagtacctactatgtgttaggaatgaacaaatgtgccaggggctgggaatagagaggtcctgaccaaacacacataccaccatggaaaagatggaggtttaactacctaaaaagaaaacgttctgaatgctgcccccaaattaaaacaccgaaaacaggctgggcatggtggctgacaccagtaattccagcactttgggaggtcgaggtgggcggattgcttgagctcaggagtttgagaccagcttcggcaacatggtgaaaccccacctctaccaaaaatacaaaaaattttaataaaaaaataaaaaggaaacaccaaaaacaaactggaaaaacatattttcagtatataataagaggtcttatatcccaacctgtggtcccagggatggttaatagttatttcaagatcacaagcaacttggaacattcatttatttattccaaaaatatttattaactgcctataatatggcaggcactgttctaggcattagggacctatcagtaaataggcctgataaacaccccaaactcatagagctaacatttcaattgggagatttgaggaggggaagataaggctgctcgaggtgattaaagtgtcatggtatttctccttgcttgaaactcagtgtgacatctgcttatctattccctgacaaagcaaaaaacatattgcttaataaacagtttgctttacacacaaattctaagggtcatggatggatgggcagggaatagaaaataagaggggattaaaggttatttaatgactaatttagtggtttgcaggacaaaggttggttttctctttttgtttttaggtcccttgggtagaacctgcagcaggctaggtgaccgacgggcctctctagcctttacagaaaaaccattctccttgctcaggccacaggacgtcagtcaacaaaaaggcctgaacatactggtgtgaggctggaatctgcattagaaataggggacagctcctggcctgtggccctgaggctttataacatggcgattaacaacaagtcaaaatcctggctccactccttactagctgtgtgaccctggacaaattggttaacctctctgggactcagttttccccattgcaaactggggggtgcctgcccttaaaagagttaaaaagataataaatatcaatcatttagctttatggcacataagtggtcaataaacaggcattatttctacttctgagggaccacaggaagcccatcagttgtcttttccactcagtcaggaagctgaaccttttttgctttggctttcaggctcataaaggactcagtgcagcatttacagaccctgacgcaatccggagctgaccagcacgaggcttggaaccagaccactgtcatacacctccaggctgctaaggtgagcgcctgccagctgaagctgaaagggatccattttgcttcccaggcaggctaccctgctgggaaaatccgggctctgccattattccccaactctgcttcagtggcggctgccctcatttcacttccaaggctttagtccagggtattttaattaaaggacttaactccaaagcaatcttgctggcagctcttaggggaaaaggtaatgaggcagtgttattggatttgcttcaggttgttcaaatatttcctcccagatagaaaagcaggtcaagtctccccttagccccacaggcaatccttggatgtctgattccatttccactcgttttgtgtttctgcataattcacagtcggtcggcaaatatttgagcacccactctgccctgggcactgacctgggtgctcaacagtgaagccactgcccatgcacggctacaatcaaggaagcaccatgacagggaaatacaggctgctatggaatcccagagcaggtacacttctgcccacctggaggagtcagaaaggcttcccaaaagaagtggcatatcagctaagacttcaaggataagctgaaattagccagctaaagggtggggtggcagctttggagagaaaagtttccaggcaaagggagctgcgcgtgcaaaaggaagcagcaagaaggatcctggtgtgcttgggaggaagtgcaaatctcccaaggaggacctaaggagaaggactgagactaggggagaaggagagacaggcaaggcctctgaccttttgcaccactgtgaaaagttggggttttgttttcattgcaatgcctttgctgagtttgtttggaggtggggtaaagtgatcagtttcattctagaagaatcatgcaggttgcccaggatggaatgaaagggagcaagttagaaaggagcaagtctgaaccgggactgagggtggtcctgaccatgagcatggcagaaggcctggagacaagtgggtagatcagagatgctaagggggaagaaggcagggacaggcctcagagtgctggggtgggaaagaggtaagaacaactcctgagttctagcttaggcagctgggactctggcaccgccaataactggaaaactaaagtgatcacgccaatcctcaggcctcagacccagaaaatggcagccttggaacaggagagccctgaagggctgcagaggccctcgtgggacagggctggtcaggcaggctggacgttgagcaccaccacgtgacccaccacctccaccacaccacacgtgatgggattacctctgcagccctcagttctgctcagcctacagcaggggcaccccctgctgtgctaactgtcctgtcaacacagagggtgagccaaggcttcctgctttcactggatcaccaaaacagaaaccacagccacccattatccactcattcattttccaaacctatggcctgccttcaaatggaccagatgctgcttgccagggttacttcatttaatccacacagccctgggagggagactgacattatttccacttcaagggtgaggaaagagaactcaggacttaggtcccagaggtaggaaatagctgagtccagatgctttcccttcccacaccactgagggtgtgatgagtgactgaggtgagcaacaaattctggggggatggagggtgacagccagccagcctgcgggggaagaacacgtccctgacagcttcctggggaggtggtgccccagctgagtctccaaggtcataatggatagggctttctgtactctctgtgctttgtggggttatttagtctacagaaagcttcagcacccaactgggccccatctagaaaccataaatgtgcaggtagagataactgcaacttgagggaagaggggatgatactgccagaagagtagacaagggggagccacgggctaaattctggtcccagctctgtgtgacctcaagcagccccttccctctctgggctttaacttccctgtctgtagacaaaggggcatggaagagccctttaggctctgtcaggccgtggtcctataattcagactctgaccagaagagatgtcagtctccaggaccatgggaacaaatgctggcctcattataatccagcctcagtctcctgtggctttggccacacagggttaggaatacagccctggtgtggatctcactgctaccacttcctagccatgaccttgggcaaaaaacttaatctttcagagcctcagtctcttcgtctgcaagatagagctaataacagtacctactttgtaggattctaataaagattaaataagtaaaacttagagaggcagctagcacccccacccccaaattagacaggaggcaagatttaaaccaacacacacaatgtaaataatgttcactgtgctcagagcgtggggccaaggttcagctcagcccttccccaaagtgtagaggtcacctctgtctctgatcctcatcctgctttttaaggcccaggcccctgggcagctctccatcactccactcctcaactcagagccttgagcatttgaggatgtggctctcagattaggacaggaaaaggagtgcgggtccgcagttctgccaagctggacccagtctgagcaacaaaggctactggagccagcagaggcaacacagcacatctgctcaccttccacagccaaatgctgcaagcccagcatggctgtgagcacaccatgtctgaatggcaaagtggagttgtcagcacctgtgtgagggccccctaggaaacacaagttctttccaagtgagaaagcggatcgggtcactgcccagctgaagactcccagtcccacagagcaaattctgaccatgttattcacagcccttcactgacctgggccccaggtatgagtccaccctaacctccatggttccccatcatcacctcattataccaccacacttcagcctcattaaattgcctgcagcttcctgaaagtacagccttttgcacataaagctccccctgcctggaatgacctttcccccaactcatgtccgcctgggtgaactcctttgaacccccaaggcactctttttttttctatgatagagtctcactccaccacccaggctggagtgcagtggcacggtctcagctcactgcaacctccacctcccaggttcaagcaattcttgtgcctcagccttccgagtagccagaattacaggtgtgcaccaccacacctggctaatttttgtattttttgtagagacagggttttgccatgttggccaggctggtctcgaactcctgacctcaagtggtccgcccacctcaacttcccaaagtgctgggatataggtgtgagccaccgcgcccagccgaacccccaagacactctaagtcttgctactgaaaatcactacagcagcatgggcatcacaggggaccttgttagaaatgcacagtctcaggccctgccctggaatctgcattttgacaagatccccaggtgatctatatgcacataaaaaactgagaggcagggcggggtccagaggctcacgcctgtaatcccagcactttgggaagccaaggaaggaggatcacttgagctcaggagttcgagaccagtgtaggcaacatagcaagaccctcgtctctactaaaaatacaaaaaaaaaaaaaagccgggcatggtggtgtgtgcctgtggtcccaactactcaggaggctgaggtgggagaatcacttgagcccagtgggacagaggttgcagcaaggcaagattgcaacactgctcttcagcctgggtgacagagtgagattctatctcagaaaaaacaattaagaagcactgctttatactttctctcttccttgctctcccttatagaactcatatatcctacctgacaaaataattgtgtgtgcttgtcttgacgagatgcggactgttcaaaatatgttacaaccagtaggacaaggcaccaaccaatcaaaatggactttagccctaggggaagcaaggtcctgaaggcctcctgctgagtcaaacattaatcctttagttgctgggctgtggagagaaggagggggtcttcgggaaggagtccatctggcagaaggggctctcacagggttgatggcagtggacagttgccagctggtattaaagtattatttttacaactgccacagccagaccataacatatgggctaaataacagcactgcttaccttaaggagtttatactctagctggaataaatttcatatatatcttgaaactttctcaccccatggtgcacacatgtgcacgcacacacacacaccactgacttgaacacagcagacaacaaatagctattttcttttcttttctttttttttttttttttttttttttgagatggagttttgctcttattgcccaggctggagtgcaatggcatgattttggctcactgcaacctccgcctcctgggttcaaatgattctcctgcctcagcctcccaagtagctgggattacaggcatgcaccaccatgcctggctaatttttgcatttttagtagagacagggtttcaccatgttggtcatactggtctcaaactcctgacctcaggtgatccacccaccttggcctcccaaagtgctgggattacaggcgtgagccaccgcgcccagccttaaaatagctaatttcttaagaacagtggtgctgtcctccaccttccccaggccagcctccaatatgcctgtattctttccttctactttccaacctacttgaaaccgctccaagcaaaagaaaacaagggccatgtttcaaagcccaccagtcccccccgtccccgctcccccccccaacacacacatatacacaacatcaaaacgccttgatcagacccagagctaggagaaaaggcagctgctcatcagcctgctgggaagcacatcatgcctcaagtttattccagccatcttgccatgcttccagggtgacttctggagtagaaaaccagaaatcaggagaacatatctttgtgtctttgtaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggtgagtggcagagacttcaaaccatgttagtcttcagagaataaccctaccccttgttcacaggtcacttccaactccaaaaccttgctaatgggcagagcagcaacagccctggagaggtctacaccctattatcattacaccagcataaagcattatgaattaatgaaagaaaaaaatgggaaaaaatgggaaaaatactgaagaataaatgagctacctcagttgaactctttacattgtcaaggaaataggaatagtatctaaggaaaatcaataaaatgaagcatgctacatatgaatgatatgtgctaatgtgctaataatagtctcaaccatagctaactttttttttcttttctttttttttagacagggactggctctgtcacccaggctaaagtgcagtagtacaatcttgtctcattgcaacctctgcctctgggttcaagtgattctcctgcttcagcctcccaagtagctgggattacaggtgcccacccccatgcccagctaatttttgtatttttagtagagatggggtttcgccatgttgaccaggctggtctccaactcctgacctcaagtgatccacctgccttggcctcccaaagtgctgggattacaggtgtgaaccaacgtgcccaggcatagccaacctttaaagagcacttatgtgacaggccctgtgccaaaagcttttacatacatctcatttaatccttacagccctttgaaatgggtactattaatctcctcattttattggaaaggaaattcaggctgatgggagttgcccagtatcacacaatcagccagaggaggggctgggtacaatctcaggtctggcccctgggcatgagctcttaacctgtatgttaaggttaaggttgaggtattatatactttgaacacatcctagtctttgttgaatgtgcttaagcaaattcttaccaagtttagtaaacttaccttaatcttccctcagcttcaagatgaaaaattttttttaactctgtaattcatatattgatttataaaataataacacaaagttttttaatgcagcattaatgcagtgccatgtatggtgaatgaaatactaatgcagtgctttcacactattattctataatctaaacgattgctttaaaaacatatcaaaaccaaagcccaacctgatcagagtcctagaaaaaaatagaaataaaaacaataaagaaaaaaaaaagcctgggcaacatggcaaaaccccacctctacaaaaaatgaatcaggcacacacctgtagtctcagctactcgggaggctgaggtaggaggattgattgatcccaggaggttgaggttgcagtaagctatgatcacaccactgcactccagcctgggcaacaaagtgagaccttgtctcaaaaaaaggaaagaaaagaaaacattgcaaattatttaccattgtccataagattaaaaaaaatggactaatttgagaatataatctttttgagacctcactgggcagaaaatatgatacctattgcatggggttagaggcgactcctagaatctccaacaattcttatatcaacaagactaataaaaagaaaaaaagaggctgggagcagtggctcacacctgtaatcccagcactttgggaggccaaggtgggaggatcacttgaggcaaagagtttaagactagcttgggcaacatagtgagaccctgtctctaaaagatttgtaattttttaaaaataagattttaagacaggtttttaaaaaactagaccaaattccttttatttctcacaatatgcaatatgttacatgccctttatgactactcatagcatgtaacagatagctggtggtcaaaaaaatgtttgttcaggccaggcgcggtggctaatacctgcaatcccagcactttgggaggccaaggtgggtggatcacctgaggtcaggagttcgaggccagcctggccaacatggtgaaacccggtctctactaaaaatacaaaaattagctgggtgtgatggcacatgcctgtaatcccagttacttgggaggctgaggcagaatcgcttgaacccgggaggcagaggctgccgtgagccaagatcgtaccactgcactccagccttggcgacaagagtgagactccatctcaagaaaaaaaaaaaagtttgttcagttaaatcatcaaaaactgtcaaaaatacgtttgacacaattatgtcccaggtataaaactttccctaatacagggaatccagtggtgaaaactattaagagcataattaagtactgcacagttcaagcccaagggtgtccatctttttgaaactctcagaatttaaaagcacttgaaaataatgttctagccccggttgtcagtgatgataaaatacaaaagattaccttaacaccctataagcatgttttttaaatttgcaaacagcatttctaagtgcttgccttggctccagaaacttacaattcaagacaagacagacagcccagatgcaatctgccaacttactcatgcgtcaaacccagaaattgatttacttccatgatggttcctaagtagccttactactgcagggtaattaggcacataacagattctatgcatatcactgtttggtgtcacagttccctgccttgattagtcactatctccctaagatttctgagatgaaaactgaagggcggcatagtatgctatggatgccaagaacaagctctctgcaatgttaactgacccaaacagtttttagttgtttaagcggtcataaaacctcagctggggggacttccaggtaaagatgacagattaaactatgcatttacttctgttctttcccgaaaccctactaaaacatcagtgaatggactgaaattttttaaaaggcataaacccacaaagagaaagagatgttgtctctgtgttgtccaggctgctcttgaactcctgggctcaagggatcctcctaccttagcctcccaaagtgctgggattacatgcatgagctaacacacctagcctctgtgagtaattttaagactttccttgactctgccctggcagaagggtaaatagaggatctgtggactagggagcatcaggtatagttgataataaggctacccttcagaaaacacagggttctttataggccaaatactgacacctccctcccccagaccttttttcccactggttcctaaaaaactggcagccagactagtaccctgcaagaagatggtaagatgatccttctctggagaatctgaccagcccaaggagaaggagctaaagacactgacatcagagtcccccaatggtccacccaattcactccatagtgaaccccatactagcaagcatagccacaagtttgtaatcagctagttaaggctttgcttttagctatgatcagacactcagggatcaccaaacacctgaagaatgcccctaacataaaagatggagaccaaaacaagcaagaacaaggcaattcagaggacataagagaatccacagggagaagaaaacttaaaaaaaaaaaacagtgatatctcagagttaagagacggtattgcaaccacaaaataaaaacctgaatgccattatttaaaactaatattcagagaacctaaaaaaagagctccttgaagttaaaaaatgataatggaaatgaaaaactcaatgtaaggactggaagataaagttgcagaaatctcacagcaagaaagcaaaaagacaaaaaaaaggaggacttttaaaaagtaagaggaccaatcttagctgttcatcatctgaagaacaggtctagaaagaagacagagaaaacagaaggaagcgaatcattaataaaataattcaagaaaacattcctcaaatgaaggatacgagtttcagatgaaaaagggtcacagatgcctacagactagaggagaggagacaggcacacacatgcacaaaataagtcacactgtataccatgtgaaatggtaatacctaccatgaaagaaaggatagcaggaagtggaggaaagaatgctgggggtcagtagggaggagggggagctacaattttaagtaggccagagaaggcctccctgggagggtgacatttaaggaaagacctgaggagaaggtagggagaagctgttgtggctgctagggaaagagcattacaggcagaacataagtacagtcatgcatcacttaatgactggaggatccgttctgagaaatgtgtcttcaggtgagtctgtcatcatgtgaacatcacagagtgtacttacacaagcctaaatggtatagcctattgctcgtacagtcacacctgcaaagcatgttgctgttctgaatactgcagccaattctaacatcaatcactaagcaataggaatttttcagctctatcataatgtcatgggaccgccatcatatacatggtccatcattgaccaaaacatcattatgcagtgcatgacagtacaaatgttggagaccagagtgtgcttggcatatccatccagagaacacagaagaggccacaggggcaggaatggcatgactgcggtggaaaatgacggcagagggcagagagttaagggagtacagtagggggtgggaagagacggtaaggtagatcattgcaaagacttaagagaatgcgagggttttgagcatgggatagaatgggagggttttgagcattggatagacacaacctaaaagaatctgatgtgtatttttaaaggcttgctccagctgccatattaagaactaagagtgaaaagcagggagatcagctggatcgctaatgcaatcatccaagtgagtgatgatagtggattggagcagtgacagtgctggaggtggtgggaatggttgaagtttgaatatatcttgaaggcagaacaggatttgctgacagattagatgtatggtgagaaagaagagaagaatcaaggtttttggtcagaagggcagagctgccatttactataaatgcggaagactacaggaggcccaggtttgggcagggtggacgggaaggagtttgggttcagatacattacttttgaagagcctatcagaaatccaagtacagatgttggtaagcaggggacactggagggataagtttggaagtcattggcgtatggttgatatttaaagccttgagaagaacatcacaaggagtgcatgaagagaagaggtccaagtactcagtcttgagaccctcgcaagataataaggaagtaaccgtggcaagagctatttctgtggagtggtgggagtaaaaacatgaacagatccagttcaggagagaatgtgaaaattggaaatcataagcataaacacacataacactttcagggagttttgtcctaaacgggagccaaggtgatggagaaggaaatagagtcaaaagcttgtgtttaagatgggagaaatgattgtctgtttgtatactgatggaaatgatccagtagagaggggatttttttttcttgtacctttctttgaacttgatcttggcctcccatcacgccttgtgtttaagagcaaggtctttgaggagatccttgttgatgacagtttgtccaagaggatatctacagagtaccttgtgggcatgaggtgattgcagttataagcttttgcaaaagacttgatccttgacctcttggagatcttcttgcctatggcagctgtcactttgtgaggatagcagtcaattccagctaccaaagcatgactgtaagaatggactgaggtgccatcatcaatgtccttcatgataatggctttgcgtccagagtagcatccagccaggaccagcaccactttcccactttttcatgaacttgcccattttgacagcaaccagccaggcctacagtaaaaagaaagaagggcatttccactaactttttacccctgaggggaattttgatgttgttggagaaaggcaggagaatgttgttctccagtatgcaagaggaaaagacatctagtagacaaggagggactgaggcctgagctgagagcctgaagagagaaagcattgtatgtataaatgcaagggtgggaacttacacagattctcttactgcttccacttcattagtgaaatacgatgtaaagccatccaggcaaaagagatgggaaaggtggatagtgtcaatctgaggatcaaagagatggtaagaaataactgcctaagaaaaagaaacagtaaatgaacaatgagtaaatatagcaatgtaatacgattgctgagctgcaatcagggcccacttgagcccttattacaccagttatgattgttttttccagccatgtatagttacaaaggtggtggcacaaagtgggtggaaaactaaagacaaagaggtatgcgttttgctaaacaggtatgacaaagcaagaaaaatcgttgagtgtgtgtgtgtgtgtgtgtgtgtgtgtgtgtatatatatatatatatatatatatatatatatatatatatatatattttttttttttttttttttttttttttttttgagcgggagtcttgctctgttgcccaagctggagtgcagcggcacgatctcagctcactgcaacctctgactcccaggttcaagcgattctcccacctcagccttcccagtagctgagactacaggcacacaccaccacacctggctaatttttgtatttttagtagagacagggttccgccatgttggccaggctggtctcgaactcctgacctcagctgatccatctgcctcggtctcccaaattgctgggattacaggtgtgagccatcgcgcccggcctgttgaatgtatttttgagagagtaatagaacatggaatttcagctggataaggaatgaagtgagaccacaagggggcagggggacattaaattggcggtagggctcatatgatgttggggatcatcaagaaacgattacattggatacagtatcccagttaccaccaatgctttaatgacacacaatcatcataatgtcaatactaaatattggtctggccaaaattataactatattgggaggcccgaaggccaggaggaagaagaatgggaacaaggggaggtaggagtgaagagagggggtgataaatataaatctttaccttttgaatgaagattcaacagataatatctcaaactgaaccatcaacaagcagcaatataaacaagatattttgacattcagataaatactgaaatatcaactaaaagattgaaattgccagccgggcatggtggctcatgcttgtaatctcagcactttgggaggccgaggtgggcagatcacctgaggtcaggaattcgagaccaacctggccaacatggtgaaaccccatctctactaaaaatacaaaaatcagccaggcatggtggcaggcgcctgtaatcccaactactcgggaggttgaggcaggagaatggcttgagcccgggaggtagaggttgcagtgagctgagattgtgccactgcactccagcctgggcaactgagactctgtatcaaaaaaaaaaaaaaaaacagattgaaattgcttctgaggaaaaagaagtggaaatcagacaggtatatgctcgttatttatttatttatttatttattttgggacaggagtctcactctgtcgcccaggctggagtgcagtggcataatctccactcactgcaacctccgcctcctaggttcaagtgattctcctgcctcagcctcccaagtagttgggactacaggcatgtgccaccatacctggctaattttttgtatttttagtagagacggggtttcaccatgttacccaggatggtcttgatctcctgacctcatgatccacctacttcggcctcccaaagtgccgggattacaggcgtgagccaccacgcatggccggatatgctgtttttttaaacaagccttacggaaccctttgactcattatactatgcacatataactgattaaaaaataaaaactaaaaaaaaatgctgaattgtttgaaaagcgaataatcatgcaacctctaattaggtattgttattcaccatccaagactagtttgattcataagagcaatctaaaatacttacaaactcttgtttcctatcccaggaaggatgccatcctgttaactgatgcttttgacttcaccgatcagtgtttaaattcagcacttggctgttatgatggaaacgtctacgaacgcctgttccagtgggctcagaagtcaccaaccaatactcaggtagttgagtggaacacattataaattatgtaagaaagcagagaacaggcagtgaatacaccttcatgttctcccattttaattgattcccgttaggttggcaatcacttggcgtagcacgtctgtttaaaatattcttagagaacacataaaagaaacaaggagtggcagtatggcctggcaggaactctgagcctggattgtaatcagcaaaatgcactgctcggaacttagtaaagggaattaagaggaaggcccaagctctaaatcatggcttgacagacccaagtgcatacacacagagtggtaaaccggcttttaagtaacaaaaagaaggagataaatcactgcggtaattgaaccaccttattttcagccttttaactttcagttttgtgtagataaaagtaggtattcagaagtggtaggaagcttgagggatgtctctcttagacctgattgcctgctagagatgataccctctcctcttcactctaaggaatacaatccaaggagcaaagaaagctgctgcactgccattagtagcccaggaaagccatatgagtgacaattaaaagggtcatgccaaaaaaatccccagccatcctaggagagcacaccagaactctacatcattaacagcgagaagacggggaggactcataaggtcccaacactcaagggccagggtatgctcgcagctctatgcttatgagcctctttgggaaaagttgtaaatgtcaatgaatatgttaacaggagtgaggtaataaaccctgtagttagaatatgaggaaccaatatttaatagcagattttacatagatgatcaaaacaaaaagtctataggtacaaaacagattattttaaattttatagtgcaaatacatgattcaggtggtgaagctttcttttttacctctttggtccaatttcagaaaaggtgtcttaacaccacatcaaattggcaactctcaggctttcattcacacccagcatggtgttagacttgctcttaacaatttgcagcctgtcataccacatggcttaatttaacatgattatctaaagttacaacacaactaacccatcttggtcactccctgtccccagaaagacatccttttaactcaaggaaatataaacaatatatgttcactgctttagtacagttaacctacttccagtgtgttactttttctaatgattagatctaacatttcaatcttggcataaaaatacagcagtcctcccactccagactagcttccatggtctaaagataaatgtgtgccctttggtgctccacagaaaaacccgccctgctataacacctgtcagaaatgctgacatatatagcccaaacctgttatactggcaacacaggaaacattctggtttctctagagagaatggagggggctttcttgtgttttagttggttttaatatttattttaaaagactttaatctggatactacatgagaacatgtttatctaaacgagaggaatgactgacccagagggtcaacacatttgggaaaacattgatgcacttcatcccattcacttctatctccttccacttgactgtgaacaacgaaggagtcttcaccttcccaactccaagatctatcacagagtagacactccacgtctatggaataaatgaacatggttttacaacctgcatagtgagacaaaggaatctgctgcatacacagtgccacacactcttgtcatcctagcttatattaccttcctaaaaaggtgacaggtatagcattgtggatctttcacgcatgataatttgggaatgtgaagttacaaatgaccttagtgaactgtttccagtcagttaaaatgacatgaggctgcctgctaatgtacatgatcttacatttctggctccttttagagatcaccaaaatagcacttttaaagtgtattttttaatgtgctgtggataattttttaaccctactcttaagatataatgctataattttgaagctgcaataagagacattttcctcatttgcactaatagaaaaaggcacactacagatattttatgtatttttatttattattatttttgagacagagtctcgctctgtcatccaggctgaaatgcagtggcacaaccgcggctcactgcaaccctctgcctcccaggttcaagcaattctcctgcctcccaagtagctggcattacaggcacaagccaccaaacccagctaatttttgtattttgtattagtagagatggggtttcaccatgttggccaggctggtctcaaactcctaacctcaaatgatccgtctgcctcagcctcccaaagtgctgggattataggtgtgagccaccatgcctggcagatattttaaataaaacagcagctatgttgaaacacaccctgtagacataaaagtacagacaggaatatatttcactgacatttttctaccaaaagaaaagtgctatgctaaggtaaacatcttagaatcataggagaagctctcttctgtctggggcagcgttgagctttattcctggacaggatgatgtgctttcttggtttaagggaagaatcattggggataatttcaaaacaaaaatcctgtttttccccaattattctattgtaaaaatgtgtccaagtaggagttagatgcattaaatacatctactgattcattcattcaacaattcaacaaatatttactaagtacatactttgtgccaaaaactattctagatactgaagatacactggagaacaagagtcataaacccagactgagtgcagtggctcaagcctgtaatcccagcactttgggaggctgaggcgggtggatcacttgaggttaggagtttgagaccaacctggccaacatggcaaaactccgtctctattaaaaatacaaaaattagccaggtgtggtggtgcacccctgtaatccaaggtactcgggaggctgaggcacaagaatcgcttgaacccaggaggcggaagttgcagtgagccaaaatcgcaccactgcactccagcctgggcaacagagcaatactgtctccaaaaaaaaacagtcaaaagcccagtgttcgaggagcttacagttttagtgtagacaggcacacacacacacacaaagtaaatattataaaagatgagactagaactaagaaacaaagaatcaagacactgaattacagcataatgaggataacctagtcggacctagaatactgcttatatgatccctatctggttccttgctttgtgattaatgttcagtttcagagagcctcaaagagtcaagccttttatttgtatgaaattccaaaagcaagtgataagctgtgtttttaattggccacctgcatccacaatttaaaatctgcatgagaaaaggaaggatgccctttggaaaaaatgtttctccatatgttcacacaaaatgagtcttagaaataatttttaaaattaagaatcttacgtaatgttactttttgaagctagagacttaatttgaaagtgaaagtcattaatcctggcagaaatgtactgtgttaataatgcgtttctttctacaaacaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattag
